United States Patent 10,113,201 (METHODS AND COMPOSITIONS FOR DIAGNOSIS OF GLIOBLASTOMA OR A SUBTYPE THEREOF) - sequence listing, part 8

SEQ ID NO: 97 - DNA, 581936 bp, Homo sapiens
gggagaagtgaccaggcggcggcggctctgctgaggtgacaacgtgctagcagccctcgctcgctctgggcgcctcctcggcctcagcgtccgctctggccgcgctcgaggagcccttcagcccgccgctgcgctatgaaggcccctctctggggctggccgaggctggagccggctccctctgctcgcgggcaagtgtgaagagagaggcgcgggcgggagccggggctgcgcgcggcgctcgcgggccggcgcgggttccaggtgagcgcggactcggcgagccccgcactcggcgcggccggccggcgcctgctgggcttgatctgaggctgaatcccgtgtgtggaccgccgttccctcttcgcgggatcgttggccaggatagcaggtctccgtctctttctcgcttcccctcttttcctcttgattgtctgggacgagctccctctgggctgccagagtgccggggctaggtgccgcaaagtcccgcggcgagtgccggggcgcggagccgagcgccccgggccggtcccagggcaaaggcaggggcgcgggcggacctggcgacgcggcctcccgggagctccgagtgcgctcgcttgcggggctgcaggtgttgcgggaggaccgcgtggcgcggaactttctgccgccgcccaccttctgctctgcttttctggctaccccggtgagttgttggtggcgggggggggggggggagcggctctggccccctctgcgttctggtgacgttcctccgcgggggtggctcggcctccaagcccagacaactttctcgcaccagctgcaggcagccccggctgcgttgcgggcgtttctactcgacccgacaccaggcgctccctgggtcttgggtgtcttcctcgacggttgccttcgtatagtgccccctttgcctcgctttttcagagtcctcttgcctctcattctcgccgtgtgtgtctctgcctctgtttctctttctgagccttggtcccctcagtccacactctccggccatgtatctgtttttttctcttattctgtttccctctttctttcttgggatatctgtgtccctgttaatctgtctttccttttgtctctccgttttgcaacatttgttctctttctgtgtctgcttctcgcagcttatctctgtctccctctgtcatctctctgccccgtcttcccgaacaccagccccgcgatcccgaagcgccttggttaggggagcaagccctggcgcatctaatgggtatctccaggtgcagagattttcctgcggggtcagtggggacgcggaggagacagcctgcccttgtccaggctgtcgtggacctgaaggaggggcgcaaggggttagagtggagggcaccgcagcaggctccccttgccgggtccgagggcgctgcgctgctgcgaacctgagcgcactgaggctgctactctggacagcgaaagctgcgcaagcccctcccgcatacccgattctttgactatggttagttgaatttccaggaggagagtctgcctccccaacctttatagccagctgcagaagaacggacagtgagcaggcaaacatagatgctttggggttcagggaaactaacctcgaaagggtgggagctttcttcaggcaaaggtgttgctagcagaggagaggagctttggggactgaggtatgcctgccttaaactaccatgcattcattgcttaggaaagcggtttccttggagagatcgtggtcagccttccctgaaacaacataacaacatagaggttttattcgcaaggctaaaggcacttggctgccaaagcccccttgaaatttctggtatccttgaatattttcagctttatgtgaaagctgcctttcctcagagtctcagtccgtctctctctctttctctctctctctttttctgtgtctctctctctcgctgtctccctgtctctctctctctgtctcgtttgcgttcatgccctctagtgttaaagaaacctgctggttcgagaatattgaaaagtaaggtcaacctattggttatttacttttggacctctcaccttccgggataattctccttgtattacacgcatcctttccttttcctcaaagaatgacttttgcattacattactaatctttctttccccccgcacccccctcccgcaatctctgttttttttttttttttctttccccacgtctcctgcagaataagaaccttcatattgaaaccctgttcgtttgatttgggaattggataggtctggagaatttgcgtagcctaaggcagactttgaacattaaaaagatgcatttctctgcactgtttgccataaaccaggatttcacatctctcctttagcccctatccaccttcaattccatggagaattttcctggctgcttctgcttgtttaaataaatgcttttatttcaccatttctgtgatgcttatcccattccagggcttaaggtacttgcttaagtaggggcactgtgtctcggatccgctttggagaggaagaatagaaagcttttctaaaggaattatagggtactgctggtatagattaattccagttcggaaagtcctgagtgggaatgtgagaatggaggctgtctcagatatgtagtccctaggacagtgtggggaaactagtaagtgcttaataaaacttgttggttgattgattagcatgcagcggatcataggcttccaagttaccaggtatgctaaggagcctgcagctaaattccacctccccgctccttttttgggaggtttcatttagattttttatgaatggtaattgagaactagtagaagggatattgaaacaggggtcttctgcttctttgtagttcatgttattgcttgaatttgcccctttttgcaagtctacaacttggctggtgttctttaacacagtcattgcagaattgaagaaatgagtttagaggggccctgaaatgtggcatctctcaatctccttacctgaaagtaagttgggacatggcatcatttttgggtgaatactttcatgtggtttctaacaagtgaaaagttctctcttttaatataaagaacagatatatcagcttaaaatacttgggggctatatattgatctgtaagctggatcacttaccctaaataatttatggattcccctactgcttcatatatatatatatatatgagatgtgcgatactgcatgaatgtgagaatttcctaaagtacctggaaacataatgcctcctaattcaaagtaataatagaaatccatgggcagcaatactactttcttgatgatatgctagtcacctcttaaaatagttgctaatttatcatgagtatggtgcaggagcatgttcaaagcaatttttctttaaaaatattatttataaatcacttgatactgtacccaatttttatatttaaaaatagcaaagacataatgaaggtggaaaatctgatattgtttgagagaccttctatttgttttacaggtttaacttatgcatctaactttttaacttactgggcagtcatttcagtttaaacagttatgtcagagtgaactatgttgttatcatgccaagttgatttctagaaatagtagttgtaacaggagcattttcatgtaatagagcttgtacagcttataaagacttcgggattttaggaaaggggtgagataagaagtaacagtaacaaatgggtatttttattctttatgaatgggcagatgaagagaatcctggtgtttctgaataataacagtcgagaaaatgcttgagaataaagtaggaatagaattaagccttactgtctaaaataaattataatgctacatatctctgttaggtgttcattgtccttttaaaaatggacacttcatatagttatgacctttaactaatttgccttattagacatgatattttaaagagaaacctcttgcaacaaacaacacattcttgacagcgactcttagtacatcaccttcttgtatttgtgtccctgtcagaaggaacatgtagacatcttaaatctaatgggatctaacaggatcactgctttgaagtctgaatgaccatatgcctaattatcaaaggatttaaactgggctttggttctaaatccttccctctgctcttgtcatcaaaataaacacatgtgaaacatcaaatcaagtcctacatatatatactcatatttattctgacaacctatttaatgacatttctaacagcaacccccccacactacacacacacacacacacacacacacacacacatacacacacagtggctaagcatatgtttgaaaacgtaaatcacatttaaagatctggcactgtctgctttgataaaccatttattattttatcagattagacttctgtttacaatttctatcaaggcacattgttgaaggacttctgccattcaaatatatgcatacctgtgtttgaaaagtctggtttttcattgtgaaatttagcttttcaaggaaatttatgaaaatgaatacatttaattcagtaatagtcatccgtttggggcattataaacaattatatctagtttttgggaggagcagtgtaaaccaaacagactttaatcacttgatatttgtttcttcttgatttcatatttagacctgtgtctgtgttttcagtgtagtgtatctattataatacatttaattggtgttagcttgattaccaagaaatgattacaggtggctaaagacatctgtgtgattctgattactgtgtgctctcatgtccttaaattcatttatagctatgagtttttcaagctgtttttagtatgtctttagacttatacatttaaatgaaattcttaatttttaaaagttatcactgcagagattgatgggatctaaaatttaaattgttaagttaaagttgggagacatgcttttcctttaagggctcaacttcattcaatgtccacgtaattagagtcctcatgaactgtcaggctctctcttaatgtgtacactaccataattacctacccttcagaaatgaactcaaacacaattcaaaatatcagttattaaaaattgttccaggttaatggttaatcctctcaagatagtttgagagggatgtagggagaagaatgactattattaccatagatatgaacatatttgttatcatcttgtagactatgtgagaaaattaaatacaatgtccataataaatacttagatttctttcatattttttaaagatatgctcattgttaagatagatgggggctgtgcaagatatatcatgttaaggttttaacatgaagaggaattaattgggactctgtttcatatattccactacattgaattgtcacttaaatcttatttaagctcttatacaacattttaggaagagtgtgattaatctgcttgttgacacattggtgaacgtaatgcatgtggtgagtagccactgtaaacagaaagaagaatttaaaagcatagcacaatcaaaaatcatccaaataacatcttgaagatagtagtaaatgtcaacttagtctcttgtcttatattaattgccttgatattacaagcaaagcacctcttttttgttaataaagtggattttgacatatgaggaggattatgtagcttagaagcataataactgacttaatttcctcttgagattattattatataattagtttcagatagagaaggtgagatttatatgactatcaaaaccccaatgaaatacaaccattagtttaaagaaagaaaaatggaataaaatatatgtaaaggtgtatccattccagcttatttatgaagaaggtaagatggtgtattgggttataaattgataaagtggctaaaattcgttggttgtttactttgtatttgtactgtggtaagtaaacatctggcaggtcttaacatgttttatctttataacaacaatatgagtaatagtatgttactgttgccattgtataaatgaggcatcacctcagaatcacacagctaatatgtgtgagcatcaaggatgacaccagtttattctgccttgaagccaataatctaatagttctcagtctgacattttcactgactgataatttaaaaaaatcaagtggtaaactttatgtgattattttcttttgtatagtaagaatgattgaaaaagtctacttctatcatctcaattttataaaagtggatattttaacaccaaataacatggaagaactgaatctcaaaataaataatagttatttaaagagaataaattaagctccctgtacatttttccacattgtactcattttcctaatttcacccaagactgatgaaaatttcatcacaaaaaatttcccgtagattgtgcttggatgcccatcttactctgaaccactgtgatatgctgcctactctatgcacccacacagctctggccggcatggtcatcatattcatgacttgatgacataatgcttatagcttattccattctcttcctagtttcaaataaaatttggacctaggaaagatgctagcacttgctttagccttagtttactgtgttaatgtttgttgaaatgattggaagattagggatgacttgttccttcttggtagttaactgccatttactgacactaagatggtgccactctgtgtcctgggattggaaatgaatattgggcaatgacaaaaagagcttgtcagaactaatttctccatcttccctccaaaaaacacatcccaacttgtacgggtcagtttgctccatttttacttctttgccttggcgaaagtgaagcaggtttggttagtgctcttgtaaaactggtggttggttttacatcccaggttgctttagatagtgtctatttgggccatcaaagaggaaaagaatactggtggagtgtgtgaaatgtggctaaattgacctaagacattagtttcatttctaccaaagcaggttgtaaatccaaattaccttgagtttatttattcattgtagttacaggtgttcaggtcccactgatacagagtctcatttaactgggatggatccacagaatctacctttatgcacattttcctatgtgattctgaggtgcagtgacatttcaagcaactaatctgcttgtagtatatcacttaacagatttatttaacaaaacacagcaattactatgccccagagttgttctaagtgctttgcagatattgattcatttaatcataaagaccttcaaaagtagattttattagtattcttattttagagacaaggaaagtgagtcacagaaaggttaagtaagttggccagtgtaagaagatcagtggaagggcaaggatgatgttaattttgataaaataattaaaactacctacgtgtgtgtgtgtgtgtgtgtgtgtgcatgtgtgtgtgtgttctgagacagagtctgcctctgttacccatgctggagtgcagtggtgcaattatagttcactgtagccttaaaccccttggcgcagcctcccaagtaactaggactacaggcatgtgctgccatgtcaggctaatttttaattttttttttttttggtagagacagagtctcactatgttgcccaggctggtcttaaactcctggcctcaagtagtcctcccgcctcagcctcccaatgtactgggattacaggcatgagccactgatcctggccgtgctttgagccacaaaacttgaagtagcagaattgaaaacagaacacagatttctatgtcttttccctatttgagtaagttttgcctttgaaagtgaaggaagaaaagctgatatttctcgagttggaaaatttttaaaaagtttatattttagaagttgttgcaccagataaataaatataattatgaatgggatagtaaacatggaaaaatcagagtggttttcctcaagtagtgtcatcattgacttggcctctaattagaccaaaacaatattaataatcagtaatacataatgttgcagacaagaatatttttaaaagatttggaaaataaacagctgtttgtttcaatccataacaaaataaccatatatacttcaaatacgtaactaagatttacatctttatactaaataagaaacaatttattttcctgtaatgctcctcataagatctttaagttacattaggaaatattcatatttatggaaggattggggaaattctacctaaatttatggattttttctcaataatttttgtaagctttgtataagatggaatatttgtaatttataatcacttgtgaaaactgatgtattgatctttaacaaagtacattttctcctttctgttatttaatatttttgtttaatacactaaaataatcttgtaaaatggcttttctttggtgttttttaaaatgaattttattttagaccgatgtttgattaaattatgtaaattatttgaattctaaacccccaataatgagtcattccacttgtgtggtttaaaaaagagttaaaaatcggcatttagaaacaatgtgatttccaattcagtaaatgatttaagggtttatggggttactgactattctactttcaagactcactaccatcttttctctttttcttatagcaaatttcaccaggattcctgagacttatatttcttcgattctcttgatcattcagtctcaaataggattatatatcacttgtcctgaaaaatattagaaacagtctgtcactgaatatggtgcagattttattcatatgttatagattttaagcataccttttgatttttttcttaaggtaaatactgtatttattattttttagtattctttttctttgctccatatcttgttctttgttcttctttccattcttcttcatggtgctttttgctttaaattgtctctcttttatgacttaataaatcttcatgtagccagactgaactatgtattggtttccttgattctggtaaaacaaaacaaaacaaaacaaaaaacaaaaaaggaaattaaaaaaggctgttcatttaatcatttagtttctgaataggtaagagacactatagctcttgcatctaggtcatttaacaggtggaaggggatgctaaatttgcatctcattacctttgtctacttttagagttgtgtgcttgggccctgtggtcagttggcaggtggcaggccatggctccaaaggaatgccgtgttatttgaggggatgccaatttcacttgccacacggttctcacattacttggtcagactttttaaaaataaaacaaccaatatatggttcattatttatgctagattactgacttcacatcaaaaatcattgtgatattgataggctgtgataaataattttaacaatttatattctgtggtacccactgtcagacttatggatagtatttcctctattttggtaacctagagcagacattttgtcaaaaatttttaaaagacttttattgttgtgcactaaagttgagatgaattgtaggtaattggatggtacagctgaattaacacattgaattgctagttatgagacacttcatttgctgttgcagacaacaataggcccatttttgcttctacaatgcacaaattcttattatctatataaaatgctaattcaagtgggataacatgtatacatcatttccattccttttgtaaggaaaactaacttccacaaatgtaaaatatttgcaaatatctcaaataattttgaacttcaattaatctttttttgcaaatgttaatcagttttctcattttccacaaacagaacaggatataaggcatttcaaacatgaaatcagtagtatcaattttaccctgtgtcccttaaggtctgtgcagatgggcaattcacatttatctcaacagagatccttatttgaatcattctgaagaacattattactatcatgattatggtgacatgcaatagtgtaataattttgttggctcttgggtttttttcatttagactttttaaagtatagcttcttcgttttcaatagatgagtatccattttaagaggaaggaataagaactatttttatctaaactatctcctgaaaactcattaagtcaagcattaaatggagggattaaaagttataaaactattacaaattgtagagagtaaaggaaggcaaaggaaactgcctagaatgtaggggggggtcgaggcagggggaggtgggttggtggcttgaagttgaggagattcactctgcccatattaagcccccaaaggcctgaggctcaataatgctgaaaaaagtaaagaacagaaatgagagtctggggctaaaacaaaataatttatcaaacatgtatagatgaaatagccttgtattcacaactctattttctatgtaaacatctctatagtaagtttttctcactcactcacctaactatccactcttaacatgtactaactagcaagggacagcaagggcaactaaggatgggtcttagaaaaacaatgcctcttttattttggcacttacagtctttaagcctaatgatcagctttttgcttgccctaaagcaaagtcttttagtcaacaagacccactcaagttcacagagatttgcactttttattcctttatattctttacttttttttttttttcttgagccagggtctcttgcccaggctggaatacagtggcatgatcatagctcactacatgtaacctcaaactcctgggctaaagcaatcctcctgccttagcctcccaaggaagcagggctacagaaatgtctcaccacacccagctaacttttataattttgtagaaatgggggatcttgctatgctacccaggctggtattccttcattcttaactacataaaacagcaatcaaggatcacagacatttaagatataatgtaggaacaaaaattttagaacgtctgcaacatgaaaaataaagagaccaagttaaagaaaccagtaacaacaaaatgactttgcaagaaacacacagaggaccataaaagagacaaatatatgttatttttatatatatatctatatatacacacatatatatgtatattatatatatatatatatataattcttgaaaagatccaggaaaatattgcattcataaaacaagtggatgatatagaaaaggaacactaaatgagtaagaaaaactcttggaaattgaatattttcaaatattttaagggaaaatttgtgattttaaatggagaaaaatctatcaattctaataaaaatgaaacaagatggaaaatatgagtcacagtgaatctccacgaagcatgacttcctaattggacgtctagtaagaaaacaaaaaatacagttagagcaacattaatgaattgaggataattatcaaatttctgaggaaaggtgatttacaactcagcataccatacccagtcaaaatatcccgtgtcagggtagaattaagacattttaagacatatgaagacaaacgttatcttctttaaatataacctttcttgaaaagttactccaggttgaacctcagcaaactatggttaagaaaaacagaaagacatggcatgatggctatgtgaagtagtccaggaaggtgaacaaattgtgttgtttcaacctggtataggattagtataaagaaatggagggtttggttggtgggaggatttgggacaaaaaggggacattatagaatatttaatgtttaaggagtatttaaaaagacaaaaaatgtacaaagaaaaaaagtagaaatgtcaggtaaaacaaaagaatatgcaaaaagggaaaataaccataggactttagttggctccaaaatgaataatatttttatattaaatatacatggtatttactgattttcatcttttgattgattttcagtcaatcttacttaaaatgtggaagataattgtggtgatagaacaaaatgcaaatattatcaagactgacaatgtcacgataaacatacaggtggctgaggttgggaattaggtatggggactggagagagttgaaggaaaggttagggattggaatagtagcatatcacaaaataggagtcaagagatagtgtctatagttaatataagaaatagcactgatatagtccttaaaattacaaagataaccaacaagaggaataatgactacattaggaggaaagatacagagaagttctgaatatgatgtgaagtgacttagataatggctaaactactttgagtttgcttggtcaaacttgctttaatttttttgaaaaaaaaaatgtgattatgcttcgatgagtgtgtacttcccagatttccacagattccaaccactctctgtggaggcatcataatccataaagatattgggatttaaagattccattgtagagctaataaacaattaaaagtgagttcctctggggagaggaactggttggggttgagggggtttactatataaagaaatataaattcttggcacttttgtcactgaacgtgatagcaataattccctatagtactacattatggggctaagaggggaacattggatttagtcctgataaagccattaataaactctataacatgtcatttaagttctctgaatgtcagtttcctcatctttaaagcaacaggtgctgggtttgtaatcccagcacttttggaggctgaggtgggcggatcatctgaggtcaggagttcaagaccagcctggccaacatggtgaaacccagtctgtactaaaaatacgaatatatatatatatatatatgtgtgtgtatatatatatatgtgtgtgtgtgtgtatatatatgtgtgtgtgtgtgtgtatatatgtatatacacacacacacacacacacacacacacattttttagccgagcgtcgtggcacgcacttctagtcccagctactcaggaggctgaaggaagagaatcattttaacccaggaggtaaaggttgcagtgagccgagattgcaccattgcactccagcctggcaacaagagcaaaactttgtctcaaaagataaaataaagtaaaataaataaaataaaataaaataaaaataaatcaactgatattaaaaagtccccagtaccactttgtagtctaatgtttattttgtgaagataggtctatcattttattgagaataaagtgaactagaatttttctaggtataaagcctaagactgatacagagctcttacttgctctgggtctttattagactaaaggtgttcattgccttcttaacaatgatcttcagtctctgtcctgtatcctttaagtttgattctttactttgtgtctaactgactttaccaatcaaatcagaatcatacatctttagttttatgaatgtgtgtaaccagatcctaaatagaattgttttaatagaacttttttcattcttcaaggccttattttcccacagcttaatggttttttttgctgatgtaaaaatgcacattacaagatgattgtttaaaagatcgtatctccatttcacctgttttcctaaacactttcaaagcactgaggaataatttgaaacaacattttatagtggattccagatagaggcagtacattttatagttctctctgtttttaaacggtaccagttactgtgattacctgatgtgcttgcaaatttacagaagaattggtaaatgaaggatggccatttcagtgttcacagatgtgaagatattgccatcttagatcagcagctgctcttgaaatgttcactccttagtatccttgggctaacactaattttgtagctgatcaaaataattgctgtaaagatactagctattcctaattaacgtgagcatatgggtagttcccacaaaaaaatttactaacctgccggttgttgctgtgtatatgttcatgctttagcattcttaactatgaacatgaatcagcaaactaaaaaataatcatagttagctttctatggatagaaatggagagagagacagagagagagaaagagagagaaatgaggaagtttccaaggttccccccatagtgtaggatacgtataccacaaaaatatattgtggaaaactgagaaaaaatactttatttaatttatgtggtaaaacctagtcttttatagtataaaaggataggggattctgaactgaaaaaaaaaaaacaaattaacaatgaggcactcttttttttttaaattatacttttaagttttaggatacatgtgcacaacgtgcaggtttgttatgtatgtatgcatgtgccatgttggtgtgctgcacccattaacttgtcatttaacattaggtatatctcctaatgctatccctccccactccccccaccccgcaacaggccccagtgtgtgatgttccccttcctgtgtctaagaaaatgtggcacatatacatcatggaatactatgcagccataaaaagcgatgagttcatgtcctttgtagggacatggatgaagctggaaaccatcattctcagcaaactatagcaaagacaaaaaaccaaacactgcatgttctcactcataggtgggaattgaacaatgagaacacatggacaaaggaagaggcactttttaaagctgtgaatatctgttttctcttgatagtttgtgattaccgtctctcttggtcccctcattttaccattttctgggtgatcttgatttgaggacagtaacttgtgggcagttagagctcttttgtcctgttattttatgtggttggtgaatctaaggtccattaagttacatattaaagttgaagttcttggcaattaattaggaccttttagcatattaacttcctcttcattctaagataagataaatgtagagattcaagttaggagacagtaaaacacaattaagtgttaaagacacaagtttaattttgtggtgcctggaatcacataaatgtagtttaaaaattcttatatctaattactagaagtatgacagaagacagttacatagcctgcatggaacttagttacctcatctttaaaatggagataatagtcatagtagataacatgaatacaacccaggtctcttactgggcaagaaggtctcttttaagtgctttacataacattaactcatttaattcttacagcactatgagctagatattctcatccaccttataattgtaatgacatgagagttgaggtgacaatgcatgaaatgtactgattgttgtgcttggcacttagcaggtgctcaataaatgtgagctgttatttgtgtatctcctctccgatggtcctctcttggtatctagtgtgacaggtgcctagtaaatttggcctgcttaaccgattttcgaaataaaatctaagacctggaagagttattgtaaggagttactgcaaaattgggccccaagtgccaataaataaataggagttaaagatgggactgaagccaagtgaagtagaaacagtaaaactgtgttagtgaaatattgagaaatcttacttgagagaagggaagataaatgtgtgaaggcaaaggtgcattcatttcatgataaatattatgatattatacacattatacacaatgctaaacaatgacctaccactttgcaaaaaagtgcatctagctgagaacaaggttgatatcttctatttgggaatttccaacatcaccgctgatttttgttaggtgttctgtgttaagtgacagccatcttgcatttcccccttagttatttgatctgctttgactatgttgtttttcttgtggaagaggcttagagaaattgaaagatcaatgctttttgtgtgtgtaaaatagagaacattttaaaacattgccatcccacccttcatttctgaatgaaaaagatgaaacattgtatatttcttattctttaaagacacagattttattttcggtatgtgatatctagtttttaatgatttttatacatgcttatttggagactttctgcttttttaatgtggaagaaagcataatttgaaataacaaattgtaattgatttcccatttagaaatatttgaattccacttctcttttcttatcaagtgaggagaatatgttttgagcactggtattttgtcatttccttcataataacttgtgcaaatgataattatacataaattaataaactgctggtgggaatttaatgatgcatcatactgtttttgatttatttccaaatcatttgcagaatgttgaaatgtacaaggactaagttttaaatgtaacctacaacttcctcagctccaagaacatattcagtaaaataaaatagttatttttaaaaatggtggtacagaaataaattgcattatgttttgtgagcttattatatgaggacattataggttattaaatagtattgtatttatctgtgtttaaaaaatgtttcatattgcaagtaaataaattatttttaaaacctattagaacttttgccatgtgattcaagcaattttctagtgctgcctaaaataatgttgggtcctcatttgcatttccttagtgctcctgtttcattccatcttgaagttttgtgtgccacttgaaaatactttaaaagtaattaaaaataaaattttgttacaagcttcaataactttgtaaacaatttctacataaaatatatttaaaatcaagtactaactcctgccaattctggggaccatgcatgaggttaaccattttcaaccaaggttacatgtactcacagacagacaattgattcattttcttgtattattgcatctatctgccaacatattacaccaattataattattttatttatagagtgatagtcaattgataattaatcctgtaagttcactttcagaacagtcttcattttattcaacaccaagcaccttggaagttagtaagtcacaaaagatgttttccatagttataaaatatttagcaatatgattaattttacagtgtattcttcacgagcatgaaatcaaagatacactgtttcctagcacagggcagagttgatgcaaactacctgtgtgtgtgcttttctgcaaagcgctcctatggaaagttgatttttcatttttctaagtttcctggcagtttttaagtgtggtcctccacgatcttggccttggacaccactaaaactaagtataaattattgatcttatttcataattcagattcattcttgactttcagttccttcattaactctagagtttattttgacctgatattagatcaaattaaattttgccaggtggattaaaaaaaaatgctccttatcccaaaccttacgttcagtataactttcttgttaggttctaatcagttttaagtttttaaccaccctcaaagccttcctgacactcttttatccttcctcaccccacactaacacactctaaaactactacatgtagtgggagttactttctgtctgtttgctttttataaaatctcatatgtatttattacttaccattgaaaaattttattatgtgattttaatcatgttgtattatatgcacttgccattttactataattcactaaataccgatgcacttttatttggccagaggcctacatctcacagtaactgggtatataaaattgtgggccagtaaaatgctgctacattttaatatagaaatgactgtactttattgatgcatgaaatgattcctgcttaagcagtcagtatacataatcaattaataaatgtagctagtgattttgagatctacatagtttaaggcactatgtaaatgcaagatcaggcacttccaatttattgagatacatacttaccagtgggttttcagcagtgggttcatgctcatggcatgcaattattgaatgctttttgcaattataaaaccctgggggtccactggccaaaatttagttttgtgggtgtgtctgcacttctgcttgcttcctgtgaagtgtctgccctactgaagtctcatactatcaagataattgttctctcattcttgcttctgagaattattttctcaatcaggaaagagtaacacctgcgaaatagagctacatgttttcatgaggctattctatcaagaaaggatgtctttgtaacataaacaaacacaaaaatcatctgtctatatgaacagtgttccaaatgtatgaatcatgaattacaaatgtataaattacatgttgttattttgtagaatttttagttttccttttctgtgttttagtaaatgtgttcatattatgttatttatggttgtattttatgggaaaatatgtgcctcattcattcacttatcactgtgcaggggttcaaggacagggagttttgttagtatcgacagttgtgatctcatgatatacttggctgattgccatcaaaccagtcactcaggggacttaagaattctgatctcatacacaatgtacttggtctcagggataaaattcacactgcaccccaacttaaaactttttcccgtgttgctttctcaatccaggttcacaccttctatttattagaaatggtatgagttcctgccttttagctgacacttttatctgggtctccctctgtaaggctaaatgcccttgttagaatggcacaacaacaacagcaacaaaaacagaagagaaaacaaaaggaaaggaaaggagcttgtatccccagactcatgctgtgtggtggctggtttgtttcttctttcttcagcacatcactcctgtgacatgctgtgcctcagactgcttgactgaccttgccgtttagagctgttaaacctgaatagagcagagcttttcttttcccttccagtaggtctcaggagtgagatctggtcactggcatttattctctgacccttaactgtggttccccttgaaatggagctaatcaaggtgttgttccacttatttattgatgctcatgaagcattcattgttggtacatataattttgcctattcctatacttgaataaattctttcttctacctaaactatggatgtatgtctacatctctttgctatttgtagattagaaaatccagaaaggcagtctaacagaattctttttgtgctgtacctagcaaaatgctctacacaattaagtccttactgcatgcatttagctacatgcatttaattagattgcatatgtacagataggtcccttgggccttccagagcagtagaggctactttgcaaaatgatgcaggccaaaaaggatttaggtcagtcaaatttttatctggctttcccagtaggatagttgaaactgcctttctacttgctataagaatgtcttccatgtgactttttttttcttctcaaattccactgttagctagtcagagattgtgcactttatatgcttcttgtcaaactcatttggtatttgaaatcacaacgcctttatgattttcacccaagtggcttcagagttctgccacttatgtcatttataagaatttgcctggaaattgtttcctttgcaggagacataagtcacagggtttaaaattgaaaaggatctcaagggctgattctgtcactcctgctagccctcagtcaaggttgtgcttaatctaaacccaagactaatatgtttctctaaaataaaactatgcctcatcattggtttgttaaatactctacattgtcaatagagggatctctgaatgagcatgtaactcctgggtgttaaaaaccttcaaaagctctacaggttaaatttcaaattctttagcatatcattcaaggtccttcttagagatctattccaaatgaccttttttggccttgcatctcactttttaccccctcttaatctactttcaggattcgctgaattgattctctgttacctggacttatcatagaagtccatgattgtttctttgctcacgttgctttgcagccttgaattacctagatgctcatttcaaagatcagctcacacgagcaaaaccttgaaggatttctccaaatccccaaggcaaaattattctattttctgtgttcccatagaaccttgttcctattgctgttgctaactttcaacctgttatcatagtggtgccctcacatgcctcccattttagatgagaagctttttcacaatggagacatcacatttctcattgttcctctgagacctaccaaagtccataatacaaccattcattctataaatgtcttgaaaaattgttaaatattgatgcagtaggataaagggctatgaatttaatgatgctctattgaatgaatctttgtgacatgccttgtatctttttctggaatataatgaggatataaaaatattaacataatctcttgcaatgataatctctacaagtttataaaaatcatgggtccaagattatgctaaaaataaaacccatttcttccatcccatgtttatagcacacttctagttggaccgttatttgaaaggccccagatttaaagttaggtttaaagatgttctaaaatgtcttcacttaaaaaacaaaaagacaaaattaatatctaagcaatctttaatttctagaaatttatttttacagtgtagtataagctctcctggtactgttaaagctatttctttacttataattttaaaaataacttttcacattactaaaaacaaactactaaacatttttcaatgaaatataaatttctttatttgggtcatttttaatgtatcctaattttccaactgttaattctttccatttctgtcctctgtcttcattttaaatatgattcgacatgtgaaccctaatgtatgctagccaaatactcattaaacccatgacaaaaacattctttaattttatctgcaaattcttagataatgtgtatcatttaggaattgtgctcagtgtgtatccagagtggcctaaagaaattggtactttatttttccctcacaagatatgaagtcttgatgttggtagtctgctaagatgacctctgtaatgttaccagagatcttggattcttgcattcattctaggattcttgtactcaaaatagctgtcagggttccaatcattataactacattttgaacaggcgaaggtcaaagagcataaatgtgccaatagcagctaagaaaggagagattagacactggcgaggcacctttcaggttcaaccacattcgtcaaaaaatcatgttttcttaacttttggaaaattgattttgtttcttacttatgttgcaactttgtactattttccagctcttttaatgttgaagttctgcctaacttatagctgtgtaattagttcttacctatgcactttgttgcttttgttcactttcagcttttaagctagtatttttttggattataacatgatatgtattttttgtggaatatttggaaaattagaaaaaatgtaaaaaagaatatgaaaattacttacatttttacaccatttagacgtaacaatgttaacatttcactgtatagtgaattgttatactgaatttatatacatatataggcacatgtatttacatatatgtaaattatgtcattatttacaaaacaactttattctccatattattttagaaattattgatattgttttgaagattagattttggaatataaataaatattatttgggacattatttttatgactacatggcatttcatcatatggacaagccataatttacttagttgatccctaattgttgcttttatggatttaaaattgtagcattataaatgacacggatgaagtactttgaacgtgaaattttgcctgtatatcttattatgtcttagaataacttgatggaagtggaatgggtcaaaaagtaaggatatgcaaaggaaaaggcagcatttcttcagaaactaggaaataatgaagcaaaaggtataaattatgccatgctttattgtgtgtttactgggaatggagtgcagtgaataaagcagaagtgttccagttttcatcccagaagacagaagagccaatattttctcctgtttcttcaggtagcgaggggccagtggtgaaggagctgtcattgaacactcttcacgttggctggtgactgcttggaacaatcattttgccacttctttaaacattcaatgaaaaaaaatgaaacaaagggaacaaagaattgacagacaacccacttgaatctctcgagaccccacttgagaacccacaggtctctggcctctcctcaactggttgaataaaaaggaggaatggatgatagagtattcagttaggaaatgcaacaacatggcacctaaccatgatgtagagactggatatggaattacgcagtgatataaattggctgatgaagtacagagaggttatgtttaaatattggttgtgtacaaatcaggggattctgatttgtcatgcctgtgatcgaaaatatcatgagatcattatgaagtagtatttacaataagaaaatatgcaagggagttagtggccttgaaggtcaaattaaaagagagagagagatgggggtgacagggagggaggaaaagagggaggacatactagggatgacttttgaagttatagattaatcagtttgctttgatatttatgaaaataataagacaaaatgatgattgatttccatacacttctaagagcagaaaaaatggggtaacagccaacatgtctgagagaagtaaataactcagagttaatgtaattttcttctctaacacaataacagaacttaaatatgagaggacaaaaagttcatatatctttacttcggtaaggtttagtttttgtctgacatgctgttctgatcaaccagcaaagaatatgtagtcttgtgtaaagggaggcatagcttgttacttgtccctgaatcagtgacctggtagagcaaacaaagtaagactaaaagtgtttattggggacttgtactgaataatatttgtaataatctccataatttaataatacaaaatgtggaatctacagactaggaaaattgctaaatctatgggaatttgcaggaatctaaagtgaatatgggaattaaaaaagagggactgaaataagttggctgtgtatgagaaccattgattaaaatggcattaaaaatggtaatatctagtgttgctgagacgttttgacacattgttgctataaattggtgatgagacctggaatagttgtttgtattgttcagggggatttgtagtgtttcctgccttaattacatcccttatcctgtaatgaccatttttttctatgttctgagtttcaagattgtaacacatcttcctctatttgtaagcatttttctttttttagctcaacaaaatgaataattattttactaaagttgctttgtttccatgcctttccgtataaacaatttttcatttcagtgttacctttttgtgtaatcttttagaagacattttgaaaggtaattaaactcaacatgtagaatacctagagtgcatacaactgaaatgaaggcatgaccatatgcagaactagggtcaagttggggcatcagcaggcaacaaacactttgtcatgactataactggctgcagtaattgtaaaatataacctgatttggaagatggtcaaataggaaagttgggtacatcagtttcataaaatatggtttaacaagttttaacagtctcatgctacttgacccagaaatcccagttctgggcattttatcctaaggaaacaatcacgctgtggcagaagatatatgcacaaggaccttcacagtaacttctttttgccacaaatatttgatgataatttatattcagaaaataagtaaatgatggcatgccatagcaacaggatattaatcagtgatcttgcagtgtaatgataaaaaaagatattgtcacacaagaaattcacaattaagtaaaaagagaatataatcataaaatagtttgtatgatataattatttaaataatagtctgcgagtaagaacaggatagttgtttctggaattaaggatgattttatatttttatgttttttcctaaattaaaaaaaacttgccactttcgatttagaaaactaattgtataaggaaaaaccacttatattgctaatctttaaagactgataaccttttgtcttttttctttaagtcctgactactttcacttattttttgattaccattttattatttaactttacattgcttaattttctgactataatataatgttgtttgtgtgatttattttaaaactctaaagttggttttacatttgttctcattctcctgtattttatatatttaataggtatatatcaatgtgtaaattatgaataaatatatctttcatttaatctgaatatataaatattaaatatatatgaagatgtaaattgtatatacataaacactaaatgatatatagtatgtaagctatcactctggatttctcactatactaattattcaaaaacatttatgattttgaattattttttaacctttactttttttctgatttatttatttttaacttttagcttcaagggtatgtgtgcagatttgttatataggctaattgtgtgttacaggggtttggtgtacagattatattgtcacccaggtaataagcatagtacccgataggtagttttttgatcctcaccttcttcctacctttcagcttcaagtaggacccagtgtctgttgttctcttcttaaaaatactttctcgatatatgtttgaatattattctgtaattcctaaatataaatgtctagattaaaataaaaccttttatttttatttttaccttgttgcataattttaaattttgacatactttcaaatgtacagaaaatttataagaattgtgtttaagaataccttttgttcagattcaacagttgtttacaattttgcctcttttgcttcatttctgtctgtgctttctctctatgtgctcatgtgtgcatgcacacgtgtagacacaccacattttttttcctgaatcatttgagaatcagttgcagacatcatgcttccttaactgaagtgtttaagtgtacatttcctaagaaaaagaatattgccctctataaccggtgtgtaatttttaatgcaatattcacaatatattacttgtattgtgtaactcccagtatatttctaggatcccaggtgtattttgttgtcttatcattaaaagtccttttatctggaacatttcctcagtctaattacttggtcattataagagttcagatcagatatggagcgcaatattctcaatttggctttactgaatgtttcctaatggttaattctgttttgcatttttgacaggcataccacaaaagtgatgttgtgttcttctcaagtgcatcatacttggaggcatgtcgtatttgtctgattattgatgatgttgtctttgatcaatttgttaaggtggtctctgccaagtttctccactactagttactattttccccattgtaattaataagtaatttgtgggaagatacttttagactggaaataccatgtttgtcatcacactttcatgcgctggtgctgatccactaatgttttctttactgattcaggtacctaaaatattatggtggttttctaactccatcagtccatctatactttttagttgacattatactcgaagaaggagttttcccttcttaatttcatactttattatattttccttaatacagtttaatccattacaataattatttatttcccagttgtcccagattaaaccagtaaaagcctcttgaagctaggacctgtgtccttttgacatattcccatcattttataaatgccttacttgcttttcttccagaaaaaaatgccacctcaaatgtcatgtatttttaagtcttctctctgtgtccatgttctaatatgccagaatagtttttcagaattttcataggttgagtggattttttgtgagtgattttcatgtcactgttaggaattctggtatcctttacctttttcacagtttttctggaccccatatatctctgtatatagtgggagcttgaaagatagctctgttagaaattggtgtctaattttctgtttacatacaatctgacatgtttattattctccagcttccaattgtgccgaaggacttggatttgtgtgttttaatttgtttttttaggtgtatatattttttaggatatgtgaacagtttcagatttaggtggctcctactacctgagttcctcagaatgccagtccatatttttatgcattctgcaaaatatattgatatttgaagacaattgcaatatgccattgtttaaccaaaatttatggattgtatagctttacctttagctgttagtgttatcttaatccagtttatccaattaaattgaagtgtttaatgtatcataattattttattacatagtatgcctatcaatccaggaaatagctctctgaaaggcatgtccatggtaaatgtaaaattattatatgaggtctcattctttcacttgatgatgtactaatcaattgtttgtaatatttttcccttagctatgaaaattatcaaatatatatttaaaaaataaaaaatattcaaacccacaaaattttaaaacatatatagattgaaataagataaccaatcaatagcatgtgattataggaatctagtgaaatgtagtattgtaagtggttatttcaattgacaaaatacagtttttgagaataataaaggtaaattcttcctccagttgcacagcaaaaaaaaaaaaaaaaaaatgatggcaattcttaataaaggagggcttggatctggtggaaaacactccagtatttaaaattgtcagagtaaaagatggtttgtaaaagtaggaagtagatgaggggcaaccatttttctgttccatacctgagtctagccttataaaaatcttcactttttcaaaaaacctacatataaggattttttatgagaaatcttctgcttttgaatattatgtaatattttaaaaaccatggtgtgggacaaacgaaatgtatcagtaagccagatgtggttttcatgcccccagttttcaatctctgctctggatgcaacctagaaactagcagatattgcggtaagatgaaacccaggtcagaaaagctggttttgagcccaggcttgcctcctattggctgtgtcagattgagcaagtgatgtaattagtgttcacctcagtcttcttgtctatgaggatgaatatgctaaagtatgaagaaatatagagatttactaattgttataactttataattgtattgaattatatgtgaagaagaatatatatcttttattatgttttaagttttaaacttagaaaatacaaagtttcttgggcatttcttgatttttttccatttaactataaacttgctaactatatttagttttctctgtttgagaggttctgtgtgaaacattagcaaaatcatttattcatgggccaggtagagacctgtgcaatcccaatgtctttaacatactagaggaagataaattagattttatattcaaaatgcttggtctgaatattgaactgttgatttggttacagttggttttggtgaacacaaaagcacaacctctgtattatttaactgctatttctgcttagtaccatcaagacccagatctctcagcagaaattctgtttgttgctgagaacttaatattcctttaaagatgtttggtacttaaggggatttttatttatattgttcatagtctgtctgatctgtctgaaagaacacactgtatttttgaagggagatatatacatatatatatatatatatattttttttttttttttttgagatggagtctcattctgtctcccaggctggagtgcagtggcacgatctcatctcactgcaacctccgcctcctgggttcaagtgatggtcctgcctcagcctcccgagtagctgggactacaggcactcactaccatgcctggctaatttttgtatttttagtaaagacagggtttcgccatgttggccagactgatattttcattaggttgtattttattatatgtctttgaacagttcttttataacaccgtatatactccgtagtgtaaaacccatttaatttgaaatattttgagattcaaaatcaatatgctctttcaaaaccctactctaaaacaaattaattaataatgcttgattaaatcactttctcctcataatcacattgatattctgaaacacagagaatggaactgtttgtgtatttttgtggggtatgcaggtcgtgtgcctgcatttttctcagtgcatggatttcaattagaatttaaatgcagttacaaagtgaattggtgcaactctctggataaatcaagccaaattcttttctaactcagtgatcctcatatgtcagataatagtaccttttaaaaacttgaaatatttgaataatcacctcaactctccacgtatatttacttatgaacatctcatatttttgaattacttttatgccattctgccaatattctggggggcactgtgtttcttgcatataatatgaagctagtatgcagacttctcttacctctttcttcaaagtgttctccttgactgatgttttggaatatttgcatatagttgggaatacttctgttcatcagcccattatactttggtagatatatggtctacattttgtaaaacctatttaagcacgttaaagtatatagtgtttaagtgtgtgttggtctgtattagtttttctgtgatcttgacaaattgtttactcttttggattttttcttcctccacagatgcatttttgtagaagcattttgaggatgaatgtttgcaaatcattttgaaattgccaagtgccacatacagtaagtaatatttttatttttctactcaattgcagtcatgttcgattaatttggcagacagtcatgaaagaacccatttctatttacagtctttgatattgtcaacattgttaaagataagaaggttgtatgtgtgcagcattatttctggggtctttattctgttccattgttctgtgtgtctctttttgtatcagtgccttgcagttttggttactacagccctgtggtatagtttgaagtcgggtaatgtgatacctctagttttttctttatgcttaagattgccttggctattttggctctttttggtttatgaattataaaatagtttttcctaattatatgaacaatatcgtttgcagtttgataggaatagtattgaatctgtaaattgctttggacgtcatgaccattttatcaatcttgattcttcctgtccatgagcatgggatgtttttctatttgtgtcatgtctaatttctttgaccagtgttttgttgagaactttctcctccttggttagctgtattcctaggtattttattcttttgggggttactgtgagtgggattgtgttctcgttttgctgtcaggctagaaattgttgttgtagagaaatatacctctgccctgatgaagtgttctggccaacactacccatcagagtaaatgagtattttgtgactgaatttcaaatttaaaaaaataagaattgccttatattcagtgtcaatagaaccaatcagcaacccaaaatgagttgccttgaacaaaatgctatttgattagagaaaacttaaaaatatataacagctcctcccctaatggcagatataataccttactcttctattatacttttcagcatttgcagtggctgaccacagccttttcttgcactcctttttagttgctttttgcagtgaagaagagattgcaatgaagggttgagcttgacttaccattctcttccctctttattatcttcagatgtgtagtgttcatagtactatcctttacatcacactggccacattgatgctttcccttttggactctggtgatcttcaaattctttcacgttagccatccattggtcctaacccctgtacactttatttcttgaaacaaatcatcagcaacattttatctggggacattttcagaattactagtatttaaaagattattgctctaaaattgaatggattaaatcgttcatgctcccacactacttttggttttgagactgaaggatttacagagggatgagaataagagatgaagtctccatttctagatttgacctctggaagacaaagctagtgattttgtttagtaattttatttcctttggttcaattaatagtccatgctcctaaatgtgagaggtactgtgttagtaaggactagagtaagtgggagagaaagacaaaaagaactctcaaggaaactttgtcattagtttgaggaaactatttttcctcaaactaggaaaaaggtatttttaaatgttattctggtgatatcttcaaactggattgcagttggaagacttgttgcaaaaagatcaatttttaagcatttgtagagggataagaatgaagggatgagggcaagacctaaggtcatagcagtggggatggactggcaggggttggagcatgtgagatttatttggaagtaaacaggttcagggagtaatagtaataattaatgcttgtgcaggattcactgagtaccagggttgttttaaatgttaatgactaatgtcatccccattttgtgcaagaggaaactgagagaggcatcatttaagcaaattgtcccaggtcacaaaagtaaaacataccatgcctgacatttggggccatttagtcaagctccagagtcattgcagtttaccagtgtaccatcatttatctaaaaaaataactgaagcttccaggattactgagctggaaaatgatgttgccaataatcagagaaacatattttgtttacagagtttaccctttctttagataggtttttggatagccagaaaaatcttgacctttagggagaaatgtaccttatggttagtgataaatctcttgtatatattcacttgttgggcaatagcaacagtaatttattatattattcaattataagttacgatagtaaacatgtcatcttaatctgatttgtcttccttccttagtagaacttaaaaatgaaacaaggatagagtggtaaaaaaaaagattttgtatcttgggtccgtaaaagaacgcattttaaagttagtttaccgatcatgcaaaactaattttgacgagggaaaaacgtaacactcagcatatggagtatctctttttctattaggttaatgtaaaagtaattgcatttttgccattactttgcaaaaactgcaattacttttgcatcaacctaatatactggagaagtagaataatatactgcttaagaccatggtctccaggaccattctgcttcattgattcatgttccaagtaaggcccatttgctgtgtgactttgtgtcaattattgatgctctctgtgcgtcagcctctgtaccttcaaaatgtgttattaatagtactgtgtcttctggatattgtaaagcttaaatgagataaatcacctaaatggctcttggtagcagcgaattttaaataaaagttatgtttattaaaatttatctcaggtaacagttttctatttttcaatttcacctacataattattactcttttaagctttttgctttgaatttttacgcattaaggagacagagcaatgattttcacaagcaaagacccatgtaaccatcccacaggtcaagaaatagaacaattgctgcatctccaatcctactttttctgcctgccagccattacctcctttccatcagtttcccgtggatgacattattcctgatatttgtgggaattacttccttgcttttcattatagttttaactttaaataatgtatccttatatgcaaaatattggtttagcctgatttttaaattaatgtacataatattcatatgacacacattcttcagtgtatggtgtccttttctgaatgtatgtttgtttttaagtttctttaatgtttttgtgtggttcattaattttcattgctatatagtattccattgtatagaaatactacagaatatttattcattgtattgttgatggacatttgtgctctttctaggtttgggccattacccaaatgtaatgctgccataaacattcttttaaatgtgtttttgctaaatatgtacatatatttctcttgaatatatacttagcaatggaatttcttagtcatattgcatgcaatctttcaactttagtagatactaccagacagtattccaaagtaactatactaatttcacttcattcattagtgtgtaagagtttccattgtttcatctttaccaaagattagtataatcatttcttttaattttagccattctggtgagagtttggtttacattttcttgttgattaatatgattatgtcatgtagcttaatagccatgaacatattattgtctataaatttcctgttcatatgtgtatttttctattgtgttgatttttaaaattgttaatattcacaagttagttacactagattaagagcctcccatcagttaaatatgctgcaaagttctccttttctatgatttggtttttcaatttcttaatgaggtttttttgatgttcctaattttaattttaatcattatatcacctcattatgtttatatctttccacttgccttcatttttgtgagtgatgtgaggtagaagtcaagttctagatatccagttgttatagaatcatactggacaattctctccttcgcccactgttctttaatgtcatatttactataaattaaatttctatatatgtctgggtcttttaggagccaacttctatttaattggattattagtctcttcttaccacttataacactattttaactatggctactttttaaatattcttaatatctattaaaacaagttcttctaccacatgttattcaaaggcatgttgactttgccttctttcatgtaaattttagaattactttgtcaagttaacaagaataattgtttagattttagttagaattgcattcaatctattgttaagtaaatttttaaagagctggtgtaattacaatattaactgatttcatttatgaacataatatatacagcatttcctccttattaactggggacacattccaagatccccagtggatgcctgaaactgcaaatagtactaaaccttatatatagactatggttttttctatatatacatacctctgataaagtttaatttataacttaggcacaggaagaaattaacaacaactaataataaaatagaacaattataacaatatactgtaataaaagttatgtgaatatagtctccttgtctctcaaagtatgttattgtactgtacttaacctgcttcttgtgatgatgtgagataatacaatgcctacatgatgagatgaagtcttgtgaatgattttggtcataactttcatagtttgaggtgcaacagcaaaactaacataaatctcttgttctttcttcacaatttcaaggacagaagaagcattcttaccatagagcttagcaacgtgagcaaacaactttttccctttattattttcttaaaggaaacactttatggcttctctttggcatattcaaattgccaacatcaccagtcttgtaatttgggtccattattaagtaatataacggtgacttgaatacaaacactgtgataactttagcaatcaatctgataaccgatatggctactaagtggctattgggtgggttgtgaatgtagcatgaggatgctggacaaaggaatgattaaagtcctaggaggaatagagcagagccatgggaaatttcatcaagctacacagaacagcacaccatttaaaattataaattgtttatttctggaattttccatttaatatttttggaccacagttgacgatgagtaactggaaccatggaaggcaaaaccataagtaaggggggacttatttattttgatcttttagtttctcttaatcccatgtctggttgtttttttttaatgttgagttcaagctaatttttctttttttctttttttttaaattttattattattatactttaagttttagggtacatgtgcacaatgtgcaggtttgttacatatgtatacatgtgccatgttggtgtgctgcacctattaactcatcatttagcattaggtatatctcctaatgctatccctcccccctccccccactccacaacagtccccagagtgtgatgttccccttcctgtgtccatgtgttctcattattcaattcccacctatgagtgagaacatgcagtgtttggttttttgtccttgtgatagtttgctgagaattatggtttccagtttcatccatgtccctacaaaggacacgaactcatcattttttatggctgcatagtattccatggtgtatatgtgccacattttcttaatccagtctatcgttgttggacatttgggttggttccaagtctttgctattgtgaatagtgctgcaataaacatacgtgtgcatgtgtctttatagcagcatgatttataatcctttgggtatatacccagtaatgggatggctgggtcaaatggtatttctagttctagatccctgaggaatcgccacactgacttccacaatggctgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcgttttttcatgtgttttttggctgcataaatgtcttcttttgagaagtgtctgttcatatcctttgcccagtttttgatggggttgtttgtttttttcttgtaaatttgtttgagttcattgtagattctggatattagccctttgtcagatgagtaggttgcgaaaattttctcccattttgtaggttgccttttcactctgatggtagtttcttttgctgtgcagaagggttttttgtttagaggtcttatgtattttggttaatttgtgcctagaagtttaatgcagtttaatattaagattatatatatacacacacacatataattatatacatatgtatcatatacatataattacatacataataatacatacatattatatacacttttttaacttttattttaggtttaggggtacatgagcaggtttgttatgtaggtaaacttgtgtcatgggggtttgttgtacagattattttgtcactggaatactaagcctcgtacctaatggttatttttttctgttcctctacctcctgccaccctctatcctaaggtagagttcattgtctgtttttcccttctttgtgtccatgtgttctgatcacttagcctccacttacaaatgagaacatgtggtatttgttttctgttcctgccttggtttgctaaggatgatggcctccagctccatccatgttactgcaaaggatatgatctaatttttttgtgtgtgtggctgtatagttttccatagtgtatatgtgccacattttctttatccattctaccattgatgggcatttaggttgattccatatctttgtcattgtgaatagtgctgcaattaacatatgtgtgcatgtgtctttatggtaggataatttatattcctttatgtatatacccagtaatgggattgctgggttgaatggtaattttgtttttaactctttgaggaatcatgacattgctttccacaatagttgaactaatttacactcccaccagcaagcagtgtgtaagtgttccctttcgccacaaccttgtctgttctgttatttgactttttcataatagccattctgactggtgtaagatggtatctcatggtggttttggtttccatttctctaatgatcagtgatagtgagctttttcatgtgattgtttgccacatttatgaaaagtgttggttcatgtcctccgcccactgtttaatggggttgtttactttttcattgtaatttaagttccttatagatgctggatattagagctttgtcagatgcatagtttgcatatatatttcccattctataggttgtctgcttactctgttgatagtttctttttctgcacagaagctcttcagttgagttagatcccatttgtcaatttttgcttttgttgcaattgcttttggtgtttttgtcgtgaaacctttaacaggttcttcatccagaatggtattttctaggttgtcttccagagtttttatagttttgggttttacatttaagtctttaatccatcttgagttgatttttctatgtggtataaagaaggagtccagtttcaatcttctgcatatggctagcctgttatccaagcacactcccattgaatagggagtccattcctcattgctttcttttgttgactttgtggaagaccagatggttgtaggtgtgcagccttaattctgggctctctattctattccattggcctatatgtctgcctttgtaccagtaccatgccatttttttattgtagctctgtagtatagtttgaagttggtaacataatgcgtccaactttgttctttttgctgagatatcttgccttggatatttgggctcttttttggttccatatgaattttaaaatatatttttctagttctgccaataatgttatttatagtttgatagggatagcattgaatctataaattgctttgggcagtatggccattttaatgatattgattcctcctatccatgagatccatgaacatggagtgtttttctatttgtttgtgtcatctctgattgctttgagcagtgttttgtgattctcattgtagagatctttcacctccctggttaactatattcctaggtattttgtcacagttgtgaatgggattgctttcctgacttggttctcagcttggctgtcattgccatataggatttttaatgtgatttttgtacattttttgctagtttgtacagattttgctagtaatttttgtacattgactttttatcctgaaactttgctgaggtttatcagtttaaggagctttcaagctgagattgtggggttttctagatacagaaacacatcatctgcaaacaggaatagtttgactccctttctttctgtatgtatatgctttatttctttctcttgatggatctctgtggccaggactttcaatactatgtttaataggagtggtgagagggggcatccttgtcttgtgtggcttttcaagggtaatgcttttgcccatttatgtgatgtttgctgtggttttgtcatagatggctcttactattttgaggtatgttccttcaatatgtagcttgttgagagtttttaacatgaagggatgttgaattttgtcaaacatcttttcagcttctattgcaataaacatgtggttttgacttttacctctgtttttgtaatgaattacatttattgatttgcatatgttgaatcaaccttgcattccagggataaagcctacttgatcatggtggattagctttttgatggcactgctggatttggtttgctggtattttgttgaggattttttaatctatcctcatcaagaattttggcctgaagttttctcttttggttgtgtcactgcaaggttttggtatcaggatgatgctggcctcatagaatgagttggggaggagtccctcttcctcatttttttggaataattgcactaggaatggtaccagcccttctttgtatgtctggtagactttgtcggtgaatccttctggccctggctaggcttttttttttttggttggtagactatttattactgattcaatttcagaattcattattggtctgttcatggattcagtttcttcctggtttagtcatgggagggtatatgtgctcaggtatctatccatttcatgttgatttttgagtttgtgtgaatagaggtattcgtagtagtctctgatggttatatatgtgtgtttctgtagggatagtggttattgcctttgtcatttctgattgtgtttatcttctatctttttctctttattagcctagctagtttctatccatctttttaattttctcaaaatgccaactcctggattcattgatcttttgaatggtttttttatgtgtcaatctctttcagttcagcattgattatgtttgtttctggtcttctgctagctttggagttgatttcttcttgcttctctacttcttttatttgtgatggtgggttgttaatttgagatctttctaagtttttgatgtgggcattttgtgcttcaaattttcatcttaacaccgccttatctgtgtcccagagatcctagtacgttgtagctttgttcttattagtttcaaagaccttcttgatttctgtcttaatttcattatttaccccaaatcattctgaagcaggttaatttccatgtaattgtatggttttgagtgattttcttgaattctctttttttgtgtgctgttgtctgagagagtagttgctatgatttcagttcttttgcatttgctgattgttttatgtcctattgtgtggttgattttagtgtatgtgccatgtggcaatgagaataatgtatattctgttgtttttggatggagagtcctataggtatctatcaggtccatttggtccttttgagttcaagtcctaaatgtctttgctaactttccgccttgatgatctgtccagtactgtcagtggagtgttgaaatctcccactattattgcatggaagtcgaaatttccttgaaggtcactaagaacttcctttgtgaatctggatgcttctcagttgggtgtatatacgtttagaatagtcaggtcttgtcaacctgaatcctttaccattatgtaatgccctcttttgatctttgttgatttaaagtctgctttgcctaaaattaggattgtaaccctagtgtttttatgttttccatttgcttggtagacatttccccatcccttaattttgagcctgtgagtgtcattgtatgtgtgataggtctcttgaagacagcataccactgagtcttgcttctttattcaccttgccactctgtgtcttttacttggagcatttagcttcttatattcaatgttagcattgatatgtgtggatttgaccctgtcgcagtgtttttagctagtttttatgcagatttgtttttatagttactttatagtgccacttgtctgtgtacttaaatgtgtttctgtagcggctggtaacagtctttcctttccatatttagtgcttttttcaggagctcttataagcgagtttggtggtaatgatttcccttagcatttgcctgtctgaaaagcatcttatttctccttcgcttatgaagcttagtttgtttgtatatgaaattcttggtcagaatttatctttttgtaagaatgttgaatatagacccccaatctcttcttgcttgtagtgctgtttctgagaagttggctgttagtctgatgggcttccttttgtgggtgacctgtcctttgtctcttggtgcctttatcattttttatttcagccttggagaatatgatgattatgtgtcttggggatggtcttcctgtgaagtattttgtgggggttctctgcatttcctgaatttgaatgttggcctccttggctagataggggaaattcttatggatgataacctgaatcatgcttcccaagttgcttccattctgcttatctctttcagggatgtcaatgtcatagatttggtctctttatataatcccatatttctctgaggtttggtttgttcctttttattcttttttctttattcttgtctgactgtattatttcagaaagtcagtattcaggctctgaaattctttactcagcttggtctaatctgttgcttttacttgctattgcgttatgaaattcttgtagtgtttttttcagctctataaggtcagcttcatgcttttctatactggctattttgtctatcagattctgtgtcattttattatgattcttagtttccttagattgggtttcagtgttttcatgaatcttgaaaatcttcattcttatccttattctgaattctatttctgtcatttcagccatctgacctcagttaacaactcttcttggagaactagggtggtcatttggagaaaagaagacactcttgctttttttgagctgtcagagttcttgtgctggttctttctcatctttgtgggtctgctgttccttcagtatttgaagttcctatcatttagatgtttttttttcttttatcctatttaatgaccttgggggtttaattgtggtataaggtgtattcagtcaattggattcatttctgcaagattttagggagtcaaggcttagctcaggactcccggactgtgttttctaattctgggtgactcttattgggcactggctttgttttctggcccctcatggttaggaacctgttgcacaggataggctgaaatgttcctgaactgctggtcacaatacttgtatgcatggtgccagccaaagctctttgtagggcagtggcagtggaatctatcctcatttgcatgtgctagcaacagtggcagcagcagcatggccaagtgcacacttgtcagctgtggcagggtggtagtgggtgctgggtagccagcaggtgtttgcagcagtggtgatggcagtattactcagggagacaggggtcctccactggcaactgtgcatgtgtttatgccagtgttggtgttagcatggtggtgggggtgctggtgggcgcaggactgtgcatgccctctatgcatgttcacactggtggtggtggctgcctaggttgtgggcaagctgtctgttttccctgcctagtttcactttggcagcagtgtcagtgcaagtggtgggtgctgctggcagcagggcaggcggctttcatgcctgccaatgctctgaggacaatggcaatgtgacaggtggggtggggggcagcatgcatccatgtcaacagcagtggtatagcagggtgcgtgcacacacatatggtggcagggaaaggaagggaaggtttgtctgtgcacacatgtcctgtctcatgggcaaaacagcccttcagagttcaggttggacagttcccctaaggctaaagtctcctatggaagcaagttgagcccaggggaatgggcagccctgaccatgctccgctacagacactccaacaccaaatcctctgggctctgcattggctggagttctggctctaacacttttctaagttactctttctgccaactgaagggtccatggtggtagaggggtttcctactgctgggattccagagggctgtgatgagagcagcttgctccttgtgtgttcaactcctactttctgcaggagttcttcggggccaggaataagtcctggtgaacggcagtcccatgcagggtgcccagtcccctctcccttcagtccagcatctgtgtcttccctccatctgttctcaatgccttgcctctgaagatatgctcagaggactccagtctttctgatgttctggtcccttggagggagatgttcctcctagctgtgtctagttggccatcttggggtaggcaagatatatcttaaaaaattattttctctttgttccttgtataaaaatacatgtttaaatatcgcccttgcatatagtagattgtaaactcattaattctagtgtgtttttcagtgcattattttgaattttctatgtaaacatccatgttgtctgtgaagaaagatagtattacttaacactttcaaaatcttatagctttattgtattttctgtgtcttattgacttggctagaatgtccagaacaatgctgaatgaacacaggaagaatgaacattctgctcttgttcacaaatcaaagagaacactgtccatcattttactgttaagaatgatgtccttgaggtcaggagttcgagaccagtctggccaacacagtgaaaccccgtctctactaaaaatacaaaaaactagtcgagtgtggtggtgtgtgcctgtagtcccagctacctgggaggctgaagcaggagaatcatatgagcccaggaggcaaagttacagtgagctgagatcacgccattgcactccagcctgggcaaaagtgcgagtctccgtctcaaaaaaaaaaaaaaaaaagatgtttgctgtattattttgagaaaatagcatatatttgattgagagaatctagttttattctgattttgttaggattcttaattatagttaggtttttaatttttatcaaatgcttctgcctgtattgagattttcaaattatctcaaacctattgagattatcaaattatctcttttactttcttatccgatgatttatattgatattattccaccccccaacccccgacaggcttctttgcttagtatggtacctggggcacatgatagttttttcagtgttttttttccaaccctttccgtcttccttgcatgtttgcataggggaggaaacctcttattacattctggacaatcctccagtggtaaattgctgttgcatactaatatactactcctggtgggggacaggagggtgcctggatcctgttctccagtctttatcttagacatggcctgtgcacctgtgccttagatgtatggctcttacacaatacctacccattcctcccatggggcccaagctcctcctggagtctgtgggattcatgagtgggagaggtgtcctgctcttcccccagtgttagcagacctctgttttatgttagcttaagattctgggcacaagaaagttacctgcccattcagcaaggtttgatggatcattctaccccttcctgagaaactatagctcttttccagggtgttgggaatatgaggatttttttcaccctaaaaggctaaattttgctttgtattagagaaaattttggggaattggtaaggattttgtgactttatacctccaaagagttctcactggtctctactctggactgaatctttcctcataaagaagtttatgaatgaacacatgtttatttgtatataggggattcctgggtgtctacactgttctgttggccaattctgatccttaagtatttgttacacttttagctgttttcttcttacctactttcatggtgactacctcattctctcttattctgttaaaagtgaaatagttcatatgtcctgtcactcctcagagtggctgttaccctctgaaattttgttcatctctttgcctggtgacccctgccctctgcatagaggaagcctgatcattatcatcatgggctgaaattatagctcctagatcattaggaatctagtctccttttgtagttcttttccacagtcttagctacataacttcatccacaagagttttccagtagtttgagatgacttctgcagcctagccatcacatttgtgttctatgcagcaagaatgaaaaaaaaatgcaatgacaaatgaggcatgcagccaggtgatttacccctcatcaaagagattacctggaaactctttcttatattttctacctacccatcattactcttagttgtaaaggagactgttgcacgtagtgttgtagctgcacacacaactgttttgttggttacctagtaaggatgaagggaaagatagatatttagtaagctcttagtggtcatagtcacaaggagaggataggaattacattgaggtgatctgatcttttcttttctttttccttccttccttctgtccttccttcctcccttccttccttcgttccttccttccttccttccttccttttttctttttctttttttttttttataaggtcttgctctgtcacccaagctggagtgcagtggcacaatcatagctcactgcagccttgacctcttgtactcaagcaattcccttcctcggcctcctgagtatccgggatgattggtgtgtggcgttgtgcctggctaatttttaaatttttagtagcaatgaggtctcactatgttgcccaggctggtctcgaactcctggcttcaaacgatcctcctgcctcagcctcccaaactgctgggattacaggtacaagtcactgtgcccagcctaggtaatccgatttttgaggcaggatggagtgagttaaaatgcacaggttctaacatcatacagaactattctgatctcagttcagcaaatactagctgtgataccttgagcaaggtttttatttggttatacctcctcagctgtaaaagggcatgatataactgtgtttaaatgtttcggtgtggatagaatatgataatatattcaaagggttcattgcataggaaatagtcaagaaatggtatatttagtttacctatcttatattagcataaattcagtttaagagaggacggtgtctataaatgactaatacagattgatagagtacaaaggcaactaaccttgtttctcttgagtagagctttaccttttagatgggattgagtctcaatttctgttctttgatgtataatttctatactttgaattaaactgaaagattgctcaaagttaaggtctatgatagcagcactttatgtaatgtcaaaccaagaaatagataagaatttaaaggtttctctttaacctttgccattggtaagttatgaaactgacgaaagaaattatacacctctgggcctcagtttattcagctgacaagtcacttagttgatgagatgacctctaccacctatttaacagctttaaaacaccgtaattctgtgcattttttttttgcctaacacagattcttttgccaaaagaaatatccttgtctctgtttgtgtctgtgtgtatgtatttattcatattgccatcatctttaaaatatcttgaatataccatatgtgtattaagatgtgtaaagtacactaatattaaatatatggattgatgggtttttacgtagttatatgcctgcattactgctacctatagcggtaatatagaatcaggaacacacagaatatttctaacccccaataacttccctttacatctcttccccatcaataaccttctggtttttattattttttattttgactttatgataatataatttgaaaaaggtatgcattattttgaggggtaattcaaacttaaaaatttttctagaagtattaacaattatgataaaaccaaaaacgtctaaataatgctgaaaagtgcaataaactataacaatgatgttataagtaataaacttaattgcacatccactgaaatgaaacagaattgcagtgtgaaaaatctcttaaaattctatccaaatctcccacctgtaagccaaaaaatagagctaccacacaggctggtgagtattctatcagtcatgttgccaggcaaccttagtcagtatgagagacacccaattgagcagccttggagtcaaactaaaaggtatcttggaaacaagggttcaactgatagagagggaggatagaagcagagagagagagaaaaaagaggcagaatgtcaattaggcagttatctgttaatcatgaccacagtttttttttttttctagtaaaatgcagctagcttacagcaaaattacttggatttctacttccttctctctgttttctcctgcatgtacacatgtgtgagtgcagaggtttggcaagatgtatcatcattacttttttggagagaaggatgttcaaaagcatttttagcatactcaaaacatgttaactaggagttcattgagattttattaattcaggattatgtttgattcagccaagtttaaaataattaatctgatttttaaattgaaatactgtgtttgaaaaattgggaatacaaagtaaaaatatctttctaccacttgaactgaaatccttggaaggtaaaagaaatggaaagggagatgctcctaattctctctgggtgaacttcggtagagataacatacaccaatcaaacagggtgagaatttgggatgacaaagtcaagtaagcccttgactctgcaaagcaactcttaatgtggttttctagagcggtatcttccatttcccacagtttcattttcatagccaacctttgctactcccctatgctctaacccaccaccactcttctcccttccttcttaacagatcatgtgcagagaaaatagcatctgtgagacaggaaattttgagattcctactaacttaccagtgtccctaaatccttttattctccccttctattgatgcctcttcctctataaaccaattctttcatcagtgctctggatcctacagctatctgtgcatgttctaagggtgatagttcaaatgaatattttcattttgcatgttcaaccttgtccctttctcctgattccttcctcttggcattaaacatgtaaaaatatctttccccttaaaaccaaaaatgcatttgtgcataaatcttcaccttatttcaagtccattattagctacactgtaactattacctctactcatagctaaatgtctccaagatttttcaatattttgtgtcacattcattcacacctcaacacactgaggctttccttgtctggttgtctgaagctgcttcaagctcaccaaagttagttgtgtgacttatattgcatatagaatatacttctttgctcccttagcacaattttgtactattgatcattcattctatttcagaatattattttttgatgaaatctatattattgtacttctgtctttctcctcccttgatagcattgcccaatctcatttgtgtgcttatctttcttaaaatacatattctacaagattctttatggcaccctcattttctatcatacttagattctcactgaacaaattttatcaacttccatgtcttcaatttccattgacttgctgactccctcatctttacctcttctgatattcagtccctatactcacctgtcttctaggcagctctgcttgtatatcccatatgaaattcaaaaattattaaaatataccagcagatttgtgaataccactattttttctgttataaataattaaaatatatgtgatattgatatatataaacaacaaaatgaaaataataaaattaatgttcttaacaatgatgcagaccccagaaactttaatcttgagcaggcctttgattttatttagaacttctagattataaaccgtgaggcaaggtgtctcaagcacctaatgtgggctagggttgggagcatattatgtactcaaaaattatttgggaaataaataaaataaatagcttaatatttgaatgaatcttaaaggattttctttttccaagttgtgttaacaaattattttgctcatcctaatattgattacaataatagcaatggctaacatgtactgattaattacattgtgccagttcctctgattgtcatttcatatataatctttaccagaattctataagtagatataattcttattgctatgttataaacacgggaacaactggagttaactgggcaaattaacctcttcagtatcttcaaactgaatgtgtataggggttggacttgaatcaacattgtctaataccccattatatataatacagttatattatatatattataatatataacagttatatatattatatatagctaaatataattatatatatttatatatgaatttttagaaaaaataataccttctatattcctggttctttgatacagacattcatattctgatgtttttgctattagtaggcctcttcggattctcagtaggtgcacatgacttaggtgtcatcaattacgattatagtttggattgtcttgaaaaaataacttagaatatgcattcagaggctacagtaatcaaaacaggatggtactggtacaaagaccaacacatagaccaatggaacagaatagacaacccagaaataaggcacctcacctacaaccatctgatcttccacaaagctaacaaaaacaagcaatggggaaaggactctgtattcaataaatggtgctgggataactggctagctatattcagaagattaaaactgggccctttctttatactacataaaaatatcaactcaagatggatgaaagactttaatataagacccaaaactgtaaaaaccctggaagacaacctaggaaataccgtgctggacctagaaactggcaaagattttataacaaagatcccaaaaccactgcaacaaaaataaaaattgacaaatgggacctaattaaactaaagaacttctgcaaaccaaaggaaactatcaacagaacaaacagacaatctacagaatatgagaaaatatttgcaagctatgcatcgaacaaaggtcaaatatccagaatctttgaggaacttaagtgtatgaacaaaaaaacaacccattaaaaagtgggcaaacgacatgaactgacagttttcaaaagaagacatgtatgtgaccaacaagcatgtgaaaacatgctcaacatcactgatcatttgagaaatgcagatcaaaaccaccatgagataccatcttacagcagtcagaatggctattattaaaaagtcaaaaaatagcagatgctggaaggttgtggagaaaagggaacgcttatacattgctgatgagcatgtaaattagttcagccattgtggaaaacagtgtaatgatttcttaaagaacttgaaacagaattagcattcaacccagcaatcccatgtttgagtatatatccaaaagaatataaatcactctaccataaagacacatggacgtgtatattcattgcagcaccattcacaatagcagacatgaaatcaacctaaattcccatcaatggtagactgaataaataaaatatggaacatatacaccatgaaatactatacggacacaaaaaagatcatatccttagcaataacatggatggagctggatactactatagtaagtaaaataacacaggaacaggaaaccaaatactgcattctctcatttgtaagtgggagctaaacaagaacacatggacacaaagaggggaacaacaggcaccaaggcctgcttgagggtggagtcttggaggagggagaggatcagaaaaatacccattgggtactatgtttattcttgggtgatgaaataatctgtacaccagtcccctgtgacaagcaatttacctgtataacaaaactgcacatgcacccctgaacctaacacagaagttataataataataaaaaagaatgcttaagagtttatgtaagagtaagggagatagaatgcaagtagaaattatgaggaaatattggaatggccgagagatacagtgttttctccatagtagaggaagaaaatacagtaaatttggaaaagatggcagaaacaattgacacatggacaaacaactaacaaatatatcctgcagagccaattaaaaactgaaatataaaatccaggtcagatggtttttataattgaaaaaagactatggatggcaaataagatgaataaaaaaaggatattagaaatataataaggataaacataatttaaatacgttaaaatacatctataattttaaaaatatgaggagtggaataaccaggaattaaaatgacatatagaaaaaaatccatgtatcggttagtgggttttattaatttagattgctgtctttgtacatatctttcccagaaatgtgaagcaaaaaggaaaataaaatgttgattgctattctgctggagtagagctgaatggatgtgggaaatcagagaatttttgtactgattatggttttttgcaggaaggggagtcataccaatattttcttctcagtttgaacacagtttcatttcacagaaattaatagataagatactttgaactggagtacacctactgatttcttctgatgtcagtcagttgttagaatgtatttactatgcttttcaaaatcaaaagaaaatattataatcattcagccacataaacagtggaagattttccttggactaaacagatcttttgatcttgaagctttatacctttcccatttaagctatgaaaatatataatctttacagaaaatgtatggactgtttccttttagaattttatccttgtctcaaaaataaactataattagaaaagctgtctgttagtaactaattgcttctccctgctatcaaaccaattatagagactaattttaagaaaggaaactttatagttgaggcaaacttaggtaggtgataatccttcccccaacccttactctccaccttcccccagtccactatcatgtttcgcacagctaacttctggtggataatatggaaagaaaaattgttttcagaaattgctttaattagcaatgactggcatgaagtgataaatggaaatgaatattttagaaactcagagatatattatttaataattatattaaagtaataaggtcatttgaagtagcatttttatttttattttttattttaatttttaaattttttattttttgaaacagagtctccctctgtcacccaggctggagtgcagcggtgtgatctgggctcactgcaacctccgcctcccgggttcaagcaattctcctgcctcagcctcctgagtagctgggattacaggcgcctgccacagtgcttggctaatttttgtatttttgatagagactgggtttcactatgttcaccaggctggtctcaaactcctgacctcaggtgatcctcccacgtcggcctcccaaagtgctggaattacaggcatgagccactgtgcctggcctgaaatagcatttttagattagacatttaaaaacagaataaaatgtatgtattagttaatagctttattaattcaggttgctgcttttgtacatatctttgccagaaatgtgaagtgaaaaggaaaataaaatgttgattgctgttctgctggattaatagcaaattataatagaaccaattacattcgttatatactactactttattagttatgtacttttttggcttttgaataaaatcatactctaccttgcttacttttaacagggagagtattttcttcatgttgatttgattttggaatctgattttttttgttaaatctcaatcatggttgtttttatttttttttattatactttaagttctagggtacatgtgcacaacatgcaggtttgttacatatgtatacatgtgccatgttggtgtgctgcacccattaacttgtcatttacattaggtatatctcctaatgctatcccttccccctcccccgaccccacaacaggcccccatgtgtgatattccccttcctgtgtccaagtgttctcattgttcaattcctacctatgagtgagaacatgcggtgtttgtttttttgtccttgtgatagtttgctgagaatgatggtttccagcttcatccatgtccctacgaaggacatgaactcatcattttttatggctgcatagtattccatggtgtatatgtgccacattttcttaatccagcctatcattgatggacatttgggttggttccaagtctttgctattgtgaatagtgccacaataaacatacatgtgcatgtgtctttatagcagcatgtcaatcatgattttttaaaatttccaacttttatttttaaattcaggggtacatgtgcaggatgtacaggattgttacataggtaaatgtgttccattgtggtttgctgcacagatcatcccatcacctttgtattaagccgagcatccattagctattcttcctgatgcactccctcttcccacccccaccctcagatagtccctggtgtatcttgtttgcccccatgtgtctatgtgttctcatccttcagcttccacttataaatgagaacatgtgatatttggttttctgttctgcattagtttgctgaggatagtggcttccagctccatccatgttcctgcacaggacatgatctcattcctttttatggctgcataatattccatggtgtatatataccacattttctttatccagtctattgttgatagacatttagattgattccatgtcgttgctattgtgaatagttctgcaatgaacatgtgcctttatgtatctttataaaagaacagtttatattcctttgggtatatacccagtaatgagattgctggatcaaatggcatttctgcctctaggtctttgaggaattgccatactgccttccacaatggttgaactaatttatactctcaccaacagtatataagcgtccctttttctccacgacctcgtcagcatctgttgtttttttactttttaataatagccattcttattggtgtgagatgatatctcactgtgtttttgatttgcatttctctaatgatccgtgacgttgagctttttttcatgtttgttggccacatgtatgttttcttttgaaaagtgtctgctcatgtcctttgtgcactttttgatgccattgtttttggcttgtaaatttgcttaagttccttatagatgttaggtattaggcctttgtcagatggatagattacaaaaattttgtcccattctgtaggttatctgtttattttgttgataatttctttgctgtgcagaagctctttaatttaattagattccatttgtcaatttttgctttcgttgcaattgctttggcatctttgtcatgacatcttggcctgtgcctatgtcctgaatggtattgcctatgttttctcctaggggttttatagttttgggtatgtattcacatatttaatccatcttgagttgatttttgtatatggtataaggaaggggtccagtttcaattttctgcatatggctagccagttgtcccagcactatttattaaatagggaatgctttccccattgcttgtttttttcaggtttgtcaaagatcagatagttgtaggtgcgcagtcttatttctgggttctgcattctgttccattggtctatgtgtctgttcttgtacctgtaccatgctgttttggttactttagctgtatagtatagtttggcatcaggtagcatgaagcctcgagcttttttttttttttttgcttaggattgtcttggctatttgagctcttttttggttccatatgaattttaaaattcttttttctgattctgtgaggaatgtcaatggtagtttaatgaaaatagcattgaatctgtaaattgctttaggcaggatgaccattttcacgatattgattcttcctatccgtgagcatggaatgtttttccatttgttttgtgtcatctctgatttcttttagcagtgctttgtagttccccttgaagaggtcctttatttcccttgtcagttgtatttctaagtattttattctttttgtggcagttgtgaatggaagttcatttgtgatttggttgtatgcctgttgttggtgtataggaatgctagcgatttttgcacattgattttgtatcctgaaactttgctgaagttgcttatcagattaagaagcttttgggctgagatgatggagttttctagatttaggatcatgttacctgcaaacaaagatagtttgacttcccctcttcccattctaataccctttatttctttctcttgcctgtcaatcatgatttttttcaaattgtggtacactattaataggagacaacgcttttctaaagcagaaatcactacgcatctcagatacctcaagttgcatgtgattttaatttaaataatataaaaaagaataatgttctagggtccaagtatatgttttcaatatattaaaatttatttacatgagatgaatatacaatttattggtgtttttttcttttctgaagatttaattggatttgagggaaatacaggctgcaatggtgggaatagttaaaagtgagtagtcttttccactttaaataatcacttttaaatatggtcctgatggatttaaggttgtatttgtttaaacaaaagccacatatacaactagaaagagatagttcctgaattttggttaagagtccaggtttgaaaagttagccattttcttcaaaagaatgtggagttttaaaataatttcacatttgaggcaaattcttatctttccagagactgtaatactagagactagtaaaagttagaattttggaaacagattacttaaatcaggcttcgttttaatggggaattctgtcttccttttctttctcatttattctgttttgtgaataacccttgacagtcctttgggtctgttggtctatatttgcacggttttcatgactgtatgcgtgccatgtactcacgtacacatcggcacaaatatcagatgagtcagaaatttagtccgtatcactattattggtgattttcttattactttaaaataaaacatatatcttcctcattattcagataataaatactatttctagttactatataaaatcacaaaacgcattagagaagcacaatgaaaattcccacatttacacgtttttccaatgcttgtatatgaataagttaaaaaacagttgcaatcatagtgcattcataagtagacattgcaatttttaaaaatagtgtcataatatctcttaacttaaagtcttttctcaatatggggtatttaaaacagtgttcagtggagaaattactagttcaaagtatatgataatttttaagaaaatgggtcaaaaatcttatttttaataaacgctatttctttccaaaaatgtttttaccaatttatgtttctatctgcaaagaaagaaaggacccgtttatcccatctttgctaaaatataattttgttacaaatagtatttaattttgatttatagtcctttaatatgcacaattattaattaaattaattagaagttttgcagaatgataggggaaatgtcgctttgtttacaggttggcttttcatgtgcttgtacacataatggtaatctctgcttacctgttatatctcgcattatatttttccttttctcctatatttatggcagattttcttgttttttaacatctgtgttttctattaatggattatacactccattatattagttgctttatattgattgacaaattatcatctttagcaatattatatgacaagttttctttgctaataagaatatgaattttaagtccatgaggacttgaaacttttactttactgttaattaattggagagtattcaatatttggaatatttagttctttatgtaattatttacttctttcctctaattgcctgtcttttaaggcacttaacttatgattaacaactttaccaggaagtttgcaggaaaaaaaccgaagctccaagtcaaattattaaatatgtttatataagctttaatgagttgttttgttttttcccctgtggaagaagactatttcacctattaatactttattaactagtttaagaaaagagtgcatttattccatggataagatgttgttaaaaatcaatcattaaaatatgggagcagacaaataaaactttgtttacatttgtgcaagtttagtatacctctagagtaccctgtaaaagccccttcttcatctcccctttatgctactgggggttcttttgtgtctagggttctgtgcttttgtttgactttatttcactttctatcccccattaattgtcaaccagactagtcagagtgactctgatacaattttacaagataatatattattcctcattatttttctacaaataaatgcccctgttttgaaatggaagcctagataagaaataaccacattattctacacatttcaaagaaagaacacttgtaatatatttcttacatattttgtcatgaagaattcagaagccttaaggccaactaggaagctgcagtttagattttctaatggttggatgtctcagtggaaacatttattttctttttaatcaggagatttatggcagaagatggccagctagctgatagatgtctactgggaactgtctaaatgctctagtgttgttttaaatctctagttttatatctacttgaacattctgaatttctcccttcccctcttgaggactattaatgaacaagcttgaatcattggtttgccgtgttataagatgaacactgagcagtcattaaatgctatatcaaatgaactatgataaatttttaggttgatgaataggatttttaaaatcactaaatttcattatgtttttgaggcccatatattcctttttaaaagctttctttatgaggacttcttaatttcattatattttaataataatctattccttttaaagtcccaatatcatatattttaggttttgacaaccatagcatcttcatagaatgaatatccctaaattcaagcatggctgaagagagctatgggtaacaaattgccttgacacaggacatctgccttataaaatgttactgctttctaaacattctctgtaaatttatctccacccttatttcactcactctatggccaagtattgtttgtcacttcattctctcaacatttgtagttatgtataaaaactatctgttaggagttttacatattggaattactccatatgtttcatacatcattttcttatccctaatccactgcttttgtatatctcccctcctggatcctaagacaaaaggcaggaattgtgtcttgttgtctgttttgttttcttctcatatttctttttatttaattcaagagaaaagttgaaaatacctcacagtacctgcctatcagacaatgtgaggtcgagtgggccacagcactggcatcaccccaggttgttagacatgtgctatccccggccttatcccagccctactgtacagaaatctgcattttattttatttttctttccaacatttattttaggtttacgggggcaggtggaggttcgttacatgggtaaattacatgttgtggaggtttggtgtgcagattatttcgtcacccaggtaatgagaatagtacacaaaaggtagtttttcagtacttaacttcctcataccctccaccttcaagtaggccattgtgtctgttttttcttctttatgtctatgtgtactcaatgtttagcttacacttataagtgacaacatgctgtatttggtttttctgttcctgtgttaattcttttaggacaatggcctccagctccatccatgttgctgcaaaagacacggtttcattctttttatggctgtatagtattccatggtgtgtatttagcacattttctttatttagtctaccagtgatgggcatctaggttgattccatgtcattgctattgtgagtagtgctgcaatgaacatacacatatatatgtcttaataataaaatgatttatattcctttgggtatatacctactgatgaaatggctatgtcaaatggtagttcggttttaagctccttgagaaatcttcaaaacgttttccccattggcagaactaatttacagtcttattagcagtgtataaacattcccttttctccacaattttgccagcctctgttatttttgaattgttaatagccattctgactggtgtaaggtggtatctcattgtggttttgatttgcatttctctaattattagtgacgtttatcgtttttccttatgtttgttggtcacatgcatgccttcttttgagaagtgtctgttcatgtcttttgtccactttttaatggggtttgttttttgcttgtttatttaagttccttatagattctgaatattagacctctgatggatgcatagtttgcagatacgttcttcctttctgaggtgagggttgtctgtttgttgtctgcttggcagaggctctttaatttaattaagtcccacttgggaatttttgtttttgttgcaattgcttttggcatcttcatcatgaaatctttgctgggacctatgtccagagtggtatttcctaggttatctcctagagtttttatggttttaggttttgcatttaagtctatagtccatcttgagttgacttttacatatggtgaaaggaatttcaattttctgcctatgactagccagttatctcagcatcatttattgaataggaagtccgttcctcattgctagttttttttactttgttgaagatcagatggctgtaagtgtatggctttattcctgggttctttcttctgttccactggtctatgtctgtttttgtaccagtaagtaccatgctgtgttggttactgtagtcttgtggtatagtttgaagtcaggtagtgtgattcctctggctttgtttttcttgcttagtattgctttggctatctgggctcttatttggtgccatatgaactttagaatagtttttttctaattctgtgatgaatgtccttggtagtttgataggaatggtattgaatctgtaaatggctttgggcagtatagccattttatcagtattgattcttccttctcatgagcatagactgtttaaccatctatgttatctctgatttctttcagcaatgttttgtaattctcaatgtagagatatttcattgtcctgggtagctgtattgctgtattcctaagtgtgtgtgtgtgtgtgtgtgtgtgtgtgtgtgtgtgtctattgtgaatgggattgcctctttgatttagatctcagctctgacattattggtgcataaaaatgctactgatttttgtacattgattttgtatgctgaagctttgctgaaattgttcatctgatctagtagccttttagcagagactgtagggttttctagtataaaatcctattgtccacaaacagagatagttttatttactctctttctatttggatagcttttatttctctctctcgcttgattactctcactatgactcccagtatgttgctgaataggagtagtgagagtgggcttccttgtctttttctagatcttaaggagaacgtttccagcttttgcctattcagtatggtgtttgtcattggctgcggttttgtcataggtggctcttattttaagatatactcatttcatgcctagtttgttgaaggtttttaacatgatgccatgttgaattttattgaaaactttttctgtgtctatcaagatgatcatgtggtttttatttttagttctgtttatgtgctgaagcacatttattgattcacgtatgttgaaccaaccttgcatcctagggataaagcctacttgatcatggtggattagcttttcaatgtgctgctggattcagtttgctagtatgttgcttttacctctatgaggatttttacatctatggtcatcagggatattggcctgatattttctcttttctttgtgtttgtttttaggttttggtatgataatgatactggcctcacagaataagtgagggaggatttcttcctcctcaatttttgggaagagattcagtaagattggcaccagttctttatatgtctggtagaatttggctgttaatccctctcatccagggctttatttggttggtgggttttttattacttattcagttttggaactcacccgggaatttatccatttcttctgttttctagtctgtgttaatagaggtgtttataatagtctgaggttttttgtatttctgtggagtcagtgataatgtctcctttgtcacttatgattgtgtttaattttctccccctttttattattctaactagtggtttattaatcttatttattttttcaaagaaccaacttttggcttcattgatctcttctatggtttttcatatctaaatttaatttagtttagctctgtttctggttatttcttttcttctgcttgctttgagatcaatttgcccttgttttactcgttcctttaggagtgatgttatgttgttaatttgagatcttttaaactttttcatgtgtgctatagactttcttcttaatactgctttagctatgtcccagagattctggcatgttacttctttgtttttcttagtttcaaagaatttcttgatttctaccttaatttcattgtttgcccaaaagtcattcaggagcaggttaatttccatgtaattgtatgtttttgacagatcttctttttcttttttttctttttttctgtctttcttttttttttttttttttgagatggagtctcgctcttgttgcccagcctcgaatgcaatggtgcaatcttggctcgctgtaacctccgcctcctgggttcaagcgattctcctgccttagccttcccagtagctgggattacaggggcctgccaccacgcctggctaatttttgtatttttagtagagatggggtttcactatattggtcaggctggtctcaaactcctgacctcaggtggtcctcctgcgttgccttcccaaaatgctgggattacaggcatgagccactgtgcctggcccgacagatcttcttagttttgatttctatttttattgctctgtgttttgagagtatggttggtatgatttcagcttttttaaaaatttgtttataattgctttatgggtgaacatgtgattgattttagagtatttgccatgtacagatgaaaattatacatcttctgtttttaagggatgaagagttctgtatatgtctgttaggtacatttggtcaaatgttgagttcaggtcctgaatttctttgttagttttctgcctcaatgatctgtctaatactgttggttgggtgttgaagtcccccattactattgtgtggttatctaagtctctttgtaggttcctaaaaagagaatttctgtgccccagtgttggttgcaaatataatattcttcttttgtcttttttgatctttgttgctttaaagtctgttttgtctgaaattagaatagcaactcaatatttttttggctttctatttgcttggtagattattgtccatacctttactttgagcctatgggtatcattgcatgtgagatggttctcctgaagtcagcatatgcttgagtctttcttctttatccaaatcttcactttgtgccttttaagtggggtgtttatcctgttaagtggggatgtttagcctctttatgtttaaggttaatactgatatgtgtagatttgatcctgtcatcatgttgttagagtagcttgttatgtaaacttgatcatgtaggtgttttatagcgtcagtgggctatttatttaagtttgtttgtttgtttgtttttttggtggccagtaatggtctttcattttcatgtttagcactcccttaaagacctcttgtaaagtgggtctgtgataacaaattccattagcttgtctgaaaaggattttatttctccttctcttacgaagcttcatttggctggataggaaattcttagttggactttcttttctttaagaatactgaatataggccccacagtctcttttggcttataaggtttctactgaaaagtccattattaaccagatggggttccatttgtaggtcacctgcctctcctctctaggggcctttaacatttttctttcatgttgaccttggagaatctgatgactgcatgtcttggggatggtcatcttttacagtatctcagaggatttttctgaatgtatctttaatgccttagcacagtgttggcatttatgtgggcactaaattatatctgttggataaatgaaaggaatattttagctttataattaaggtggtaattttattcttaaagtaatacatgattgtagcaaaaattcaagcttgcagaagactgtaaattctgttgttcggagattaccaagtttagtgagtgtatctgtaaattttctgggaatgtgaaaatttacacagacagacacacatacatatttcctgcttttttgtgtgtgtgatgatctcaggtctgtgaaggttctggaatttgattttacctcacataaaagctaaaagttagcttgttattatgtcatggatttgggcagaatggacttctgtattagagcaaaggacattttttactcatggcacaggaagtacatgaaccatcaaatgtcacgtgtcaatgcagtttgtcacatattggtcttttaacacatgcttgcatatacggatatccattctatgaagatgctatgactataaaagtacaatatatgtttgtgtgtgttccacttgcttcctgtgtcctattgagggtatgtggatagccccagtggattcctacttacatggtgggttgcattacagaaaaagaccaataaccttagataagctactattttataataaacatttttcaatattccttactgcaaacacagttatgaaaagtggcctggctgtttggggccttgcattcttggcatccccagcaagaagtattaggagtttatgagagtggaggagtgtctctcaatgatatccacttttgatctttgatcatgttggcttctggtgaaatttcatgtgattatggcactccattgaacaccctaaataatatgacagtggctggggtcagatgtatttagtttttctcatacagcatttatataaggctattatgagcagaacttctaacaacaggattaggccaacttggagttttgactttactcatgtttccctgtggtccgggactcagtcactgtaaataagtctaagaggatatcaataggttttattctataaagccaaactgtggtagtctaagaacagtgtattatccagcacaactgacacaagggagtttacatagaactgcttatctttggttatcattgcaatagatgatttaatagaatctgaatttccatggagagatagtccatggctcactcagcccatatacaaacatatagcccaaagggacataaatctgtccaatcaggattttttatttaactttatttggatcatcattacattggtctgattaagcatgtgtcatgtcactgaagagttgtagcctggattgtttacatggcataagccaaagtgctcagatatcaggagaagcaagtgaatttctatcagccagatagaaacaatgttatgcaagttcctgtgtttgtttaggtgggaggaagggtatctttttgggagcagccatttatggcatcaggcacagcagagcagttcaggactggccatgcccacatgagtttttctgtttcatagcacttggaagagatgacaaatggaacagcaggctggattgtcagccacagatgctacttcactcaggcaggccatatgattattttgccaggctctgattctggatctaggtgacaaacagagcattaattaacccatcctcttccccacaactcttggtgtacaagccatttcttccccagatgtcagttattgctttctccacagccatgaaattttgtgtgccctatttcagtataactttgctttacttctctccagtcctctattaatctaacccagagctttgatatgaaagtattaaatgcaagtggaacagagacatttttacaaaatatacagagactcattatacctcccatgtttgcccacataggccattgtagagggattcagttagcagtagagttagctgtctgtgtctgcagtttctgcattcgcagattcaagtaaccttggattgaaaatatttgtgaaagaacacaataaaaatagaaatacaacaataaaatcacagataaaaacaatttagcattaacaactatttgcataacactcacattgtattaggtgttatgaataatctagaaatgacttaaggactacaggaatatgtgcataggttatatacaaatactatgccattttatataatggacttgagctttgagtttggaaaatctaataccttgactatcattttattattaggtggcctttgcaacaaatggcacaacattgccagactgtagatggtctggaaaccagcaaatatgacccagtttagtttcatgggccacagtggtatggctggaggtgactgattggcctgaaacagcagccctgtagcctgaaaccaggtaggatggtgatgtaggcacctttatcacagagagccataaatattcttattcccgccatcccttcttagcgatgaaccatacttgtgtttcaggccaaggataggatttacaatttattttaaatgtgatagaagctgttgatcaataatgagcagaacagggaagatatctaattaaatttaattttttttttttttgagacagtctcactctgtcacccaggctggagtgcagtggcatgatcttggctcactgccatctccacctcccgggttcaagtgattctcctgcctcagcctcctgagtagctgggactacaggcgtgtgccaccatgcccggctagttttttgtatttgtagagacggggtttcactgtgttagccaggatggtctcaatctcctgaccttgtgttccgcccaccttggcctcccaaagtgctgggattacaggcgtgagcaaccgtgcctggccattaaatttaaattttaacaggaaccacctgccttttgtgagaagactagattataatgggggtgcatttaagatgctaagacatagcatatgatcaagcaattctacacctaggtatatacccacgaacaatgaaaacatatgtctacagaaaatttgtacctaaatgttaacagcttaaatttttcataatagtcaaaaggtagaaacaacacaaatgtgcatcaagtgatgaatggataaataaaatgtgtatagctatacaatggaatattatttggcaataaaaagaaatgaagtacttgtatatgctacaatgtgaatgaacattgaaaacattgtgctaaatgagagaagacagtcatgaaggcaacatattgtatgattcaatttgtatgaaacattcaaaataggaaaattcatagccaataaatcagattagtagttacttatgtctatggatgatggtaggattgagggttctagcaaaggggagtggtttactttttgaggaaaggaaatgccctaaaattgattgtggtgatagacacacaatgtgtgactatattgcattgtatactttaaatgagtgaattatcagatatatgaattatatctcaataaaacttttttaaaacaatctaaggcagcatttcaaaatcctggtggctgcttggtctatagttgtagtggtggaattggtgaaaagtggcacagaatttgctgcacaatcaaatatggaatgtgaaagaaacaagttgctagaaaggagtacacggtttatggccaacctataccaaatgctgctgagtatttatgtaagatgatgattaagaattgatcattggatttgaccgtgaccttatcacatgaggtttccacgtagtggcaggacctaaagcctgtgaagtttaagagagaatgggaagatagggatgtatagacatatgtaattattgtcaaaagttttacattaagggtgagtagatggatgtagggatacctgaagagaggtgtatggtgaaattactttattcaaagattattattaatataacatctttgcatattggtaataatgacttgttagagaagataaactaatgcagaagagaaaagtgcattagtcaaatccttgaatatgtgagggtagagggtattgcattctttaaagggacagttcaccagggtaacagttggacttgtagaatttggtatggtagtaatggaaacaagcaagcaatacatttaacatggcagtatgcaaaattctcttctgattgtttatatgttctctgttaaatgtagatgcatagtgatcagccatgagaaaaagaaagtgtggagatgacagtatgaggaagtcaaataagctgcaaaattgttgtctgaaagatggagattgatttggactccactgcagtgtgggctcatagatttaaaatgagaagtggtggaataatttgggagtttcatgacagccatgttcacctgtttgcatgtagaagtggagtataggaaagtgaatttaactagccagtgttttagtttgctggggctgccctaatgaataccacagactgggtgccttaaacaacagaaatatattttctctcacatttctggaggctagaagtccaaaatcaagatgtcagcagtgttgattttattctgagtcctctttttgtggttggtaaatggacgccttctctctgtgtcttcacatggttttcctgtgtcctaatctccttgaagggtaccagtcatattagattagggtccacccatcacacttcattttgtctaattacctttttaaatcccctatttccaaatatggttccattctaagatactaggggttaggacttgcacccatggatttttggaatgtggcaggcaagggcaattcagcccataacaacaaatgctggagttttaaaatttaaatatattggagtgagagagggcgtatgtaagagaagcgtaatcctgttctcatatagcttaccatttaagaaagggggacaaataagaaacaaaaaaaaccccacaatttttcaataaattgggggtgataattgctaagaaggaaaattaagtggggtgagaagacagtgagtaaggtgtgtgtgctgttttatataggctgataggaaagctcgtggtgatgtgacatttgagcaggaaggaaggaagatctgaaggaaacaagagcagggagccatgaacctatgactgggcagagaaagcacaatcgcacatgccctgaggcaagctagtaattcgtatatttaaggaacagccaggagacctaagtcactgatgtgaacatggtaggaaatgagatcagaaaggcatgaagtagaagctctcttatctggtgaacttgtgactacaatttatttaatcaaaagttgatgatatcagggaatcatatgatacctatttacctttaaaagggaggtacaatttacattgagtgaaatgcactgatcttaagtgcatagttcaatgagttttcactattgtaaaaccttgtgtgactcataccacattagaaactacatctaaaatagttctgctttgtggtacttttgttatccaatcccctgaacacctatacactgagcatgcaatgtttctgcaagggtgggtagggagaatcctcattgttttttcttgctcttagaatgatgtttctgatgataacaatatgtgttactactagtaataataactaatctatattgagttcttatgtgccaggcactgttataagaggttacgtgttacatccctgtactcatcctagccttacaaggtaactactattcgcattttgtgagtaggaaaaccaaggcattaaacatttaaggaacttgaatcaagttgcacaattagtgagtgttgaaacccagactcaaatcatgacaatgtaactctgaaacgttttcttttacaggctatgttaggttccctcctgagaattgaattttagcgtatcatcaatattctccctttccttagtgtatatgcaaatgagggcattttttgttgttgtttttttcagttttgtttattgcttctcttctaccatctttcagtaaaaggcatttatttagcattatatttgttggcttctttgtctcttagtttaacctttagtgtgatgtggttattacagtggacactttggtttaggctgtgagtggatttcctgggtttaacttaagtttttgtctttttttttttttttttgacagagtcttgctctgttgcccaggctggggtgcaatggtacaatctcagctcactgcaacctccgccccccaggttcaagtgattttcctgcctctgcctcctgagtagttgggattacaggagtccgccaccacgcccagctaattttacatttttaatagagaccgggttttgccatgttgaccaggctggtttcgaactccttacttcaggtgatctacctgcctcagcctcccaaattgctgggattacaggtgtgagccaccgtgcccggccaatttcttatctttattcatacaaagatctgttttcctatcagttagacctgaagctaatttatggtattttttcagggcttactcactacgtttatcagcccataaaccaaactgcaaaattatttggtcattagttcacagaagctcctgcctaactatttaaaacatttaaagtatgctgagtgcctgaaacttctggaagcattaccagcagccttacactagtttccaggatcccttggcagcctcaaggatagcctcagaaaatagactgaaaacatttgctcccattacacaattttctacaaaagaaagtttatgactatagataaaaatatgtctaatagcaagtaaaatagattccctaagtaataacttcctaattaaaaaagaacaacaaataaaaaaccaaagcaaaaacaaaagcttttttcttcttaatttaacaacatagttacaaaaccctaaactttatctagattttatttcttatatttaacatcaaaattttttttgagatggagtttctctcttgttgcccatgctggagtacagtggcactatctccgttccattacaggcacacgccaccttgcctggctaatttttgtatttttagtagttacaaggtttcagtatgttggccaggctggtcttgaacttctgacctcagatgatccgcccgcctcagcctcccagagttctgggattacaggcatgagccactgtgcctagccttaaaatcaatttttaataaagataggaaatatggtacacattttcaagtaaaaatcctataacatagacaatcttgctgataccattacttaatgtttttgaaacaattaggaaaagggtaatagtattggatagaaaagtctgtagttcatgcaagttgctcatgcactacactggtttggcaagccagggatattgaagaacttggattttctgactgagaaacagaacagtatttgcaaataagtaggggtttcctggaatagaaacataatacagatgctgattctcttaaataaacctgggccaccaactgtgcttacgttggttagtattctgtgtttaaagtaccatttttctgctcagttttcttcttttaagaggaatattgaaatacaatatataagattattattttataagtgccaggggattagatttctgtgaatgataaagtttagcctgttttcaaggtgtaggtgttttcaaaatataggtaaatttccaaattaaaaaatacaagcagagtctgtttcataattacataagaagtttaaacagcaacttagtttttcacatgatatagttagaattctttcagtgctaatgtcttaatatatagcactagcaggctatgaaattaggataatttgaatactgcttgaagtggcaataatatgtaattttgactttttatcataaataaagtttaagttaaattctcaataacctcaactgttaggcttttattaggaaatgacttatcttagacatttcaatatttaattaatactgagtgatttcagattttctattataataatattcttcatcttttcttgaacgattttttaaattctttatcttgattaagcctcacaatattttgtgagattgatggggcaggaaatatgttataaacaaatgaagcactgagaagcaagatacctacctaaggtcatccctttatttgatgacagagccagggatggtgctgtttacatcttccaggatcatttatgtatatggcactccttataaacttgggaatggccgtgtagtgaccgtcaatgttataggtacttctccatggaattattttctacaataaagtgaaaggatctaccctatcttaagactgaagacagaacatttgatagcttgaattgtttcatatctcaaatttagaaaagaatgtacacggtaacaggaaataaatatgggataatcattcctttattatcaggtttagaggctgatttccaatatttagctatcatttttatagaaaattaaagtggaaatgaaacaaagtagataataacatgttacttttttctaagaaaaaaaaccccaaatgtcatgtattctttggatttacatatatctctccattatatatatatatacacattctgaataaatgtaaatgtaatttttttgtaattactaaaataaaatctgttacaataattattttgtaactggcgctttatgtgaattttgaatttgttgctagtttaggttggttataacaggcaacagaatttctgttgctttatggtgctgtcagctgctgttaatttaaagagcttgtgctcatcaaattatactttgatgtttttgagacaaacgtttatgaaatatttcaagtgtctttgtatttaatactgttcaccccaattagctctgtcaaaacttcatcacttatcttattcacatcaataagcttacattttactcgatattatttaaaatgtaacaaatgatatcagaatatgttttgtctgatttacttactttatagataaaagttggttaaccaggtagttaaacaaatgtagtagtataaataaaatgctcaatgtagtataaataaaacaaataagtgtaaggtattcattctacacttaccttgaaaaatgtctcttaataattatgtacatatctttgttatagcctttaaattcttgctctgattattttaaatcatttatgttaatatatttttcccctgataaattggatgcgtgctatctattctaaacacacatttattgtagatactttctctgcagatcagctgggattttagaggctgtgtaattattgatcgtgtcttgcaattgctctacttaagaatatgagaacaattttttctgttttatgtatttattttattttatttttacgtatgtatgtattttttttttttgagacagagttttgctcttgtcacccagactggagtgcaattgtgtgatctcagcttactgcaacctccacctaccaggttcaagtgattctcctgcctcagcctcctgagtagctgggattacaggcacgtgccaccatgcctggctaatttttgtatttttagtagagacgtggttttaccatgttggccagactggtctcaaactcctgacctcaggtgatccgcctgcctcgatctctcaaagtgttgggattacaggcgtgagccgccgtgcccagctctgttttatgttttattaattatctgttctgcaagatgctttataaatatgattctacataatcctcataacaaatgaggtttagctttggcatttctatccacattatacagatgagaaaactgtggcttagaaagtcttctattcttaggaggtgtacagacccagacgtgtctgtctatgaaggccagattttagccactataatatattgtatcccaggatgatttctatttcagaattattggctagtcagaagtactgaattagagtaaagtcagaattgcactatttgacaacctggagctataaagaatatcatgatatgactttaagttcattacaatacaacttaaaggaatcaagtagtttgtcaagggcctggcagagtagtggcagatctagtattaggtattaaaatgttagccaactagcttgctagcaactttcatttatttaggcttttaattttggattcgaaggcttgagtactgatatatttgagaacattaaataagtcatacatttcatgttatatgttctttatccaaaaatctatgtgtacaattaatgaaattttcttctttgttttaatgcagtggaatgtatcctgctttcatcttggagttcacctgtgtggcttggatttatcacagtagcatttgtcttcaatctgtgtgttaactagaaatcaaggaaagacatgaggagatttgtctactgcaaggtggttctagccacttcgctgatgtgggttcttgttgatgtcttcttactgctgtacttcagtgaatgtaacaaatgtgatgacaagaaggagagatctctgctgcctgcattgaggggtaagtgcttatgaagcaaatactgtctttatagagatgagaaaagtggtgccttgacaaaatgagaaacttcagaatcagaagagttttgccttagtgagttagaagagcattttggcagcactattaatgcatgtttaaccatggggaagttactttacctttcttggtcttaggcgtcttcttggaagaaataagaagagttagctaacctctaagataccgttcaacctaataaattctggtgttctgtgactgtatgaaaagaacagttgagtgaacgttcaaactgggcagaattttaaatctaggctgctagaagccaaaagcctttaaagaccaagcacataacataaaacggaaaaaccactaaagtgagacaggtggcgattttagcaaacgaactgtgcatgaatgacaccgctaaagacttccaaaacagttgaaataaaacaaccaatttttaaaacaaaacacatggcggtatgcagatttaccagattgctggctgtatgttaagtgaaaaagataatttcaagtatactgtaaaattactttatttcagtattttcctcttgagggaccagtttcaaagactaaatatgaatgtaaacataataatttgtatgaatggttatttatcaagtaaagccatagagatttgttttctgtgaagttattccagttttctctatgctttcttttttgttaacttcaagatctataaatatatttctaatgtattcctagaaaattcaatacttctaaaatatgtaagagtactcaaaattagttttattctcattgaactaacatattctctgtttggcaaaagttttctgcataaatatgacaaaaagcaagcttcaattgaagtatcatgacatgtttgtaccttttggaaaagtgaatctaaattatcaagttgagatttacatttatttaatgaatatgatctgcttttaatgttatacatatttttgagatatttattgaacaaaatatttaataaacagaatctcattaacactatcaggttacatgaaatttagggaaacagaagagcatttccaaaatttaatttttgttcaaagagtactttagacatgttgagtttgctttagattgcaaatcaaagattactttagacatgttgagtttgctttagattacagaaatactcttgttcatttagagaaattctgaatcttctgaatcgcttccttgtcttttaaaatggaacttgcattttagattttgactaatacaaataatttaaaaaaatttgcaagtgactgatgctagacccatttaggtagtttacatgcattttttatgcctttatacttcagttattctgagaggggaacattataagtccatgtttttgacaaatgaacatggggaatgatttgctgatctttagttaaaaccccagaattaatcagccttctgagcttctttgtcagaatcagttgagttgctgcttggctgaatgtagaaaagtgtttttgatggattacatcagtttggaatgatcactctgtcatttgttgaaggaaaccatctaggttggtcacatacaaaaaatgtaataatctgattcagcaaaactttgatagccttttctgccagtaacacaaaggtacagttttgctgatttatgtccttaatgctccttaagtcttaaatctcaaaatgtgaaatttaacaatgcaaggcaaaaataacttttccttgtacttaaattgtaaaattaaactattgttctctttgttgataagacttgttattttacttcattcaggttgttaaaaaaatatagacttggtggctaacaaggaacagacatttatttcttacaattttggaggctggggattccaagatgaaggtgctagcagatgcaacgtctgataaggggctgttccttgtaaacagctgtcttctcactaacctcactaggcagaatagttgagaaatctctctggggcatattttataagggcactaattgcattcatgaaggttccaccttcatgacttaatcaccccccaaaggccctatctcctaatatcactttgaaggttaggatttcagtatatgaattttgcagagacacaaacattcagtacattgtactactttaaagttttatattaatactatttgtctggaataaatggaaaatagacttgagggttttaatttcattttcagttgtcacttgttatttcagaatttttactttaggagtttgcaccttgttttcaaaatattttatttgtaagcagatgatgctgtgcaaagtgtacctaactgaaattttcacattttaggtctgctaaaaacaggcttttttacttaaaaaaagatccttctggacctgtgcatctccattattaaagcaaaggttttggagtaggcagtttctaagttcccttatatgtctaaattttaaacaattcctaaggacccaatattaacatacactgttaatgaatttttgacatattttcattcattcactcattcattatttattaagttcttactctatgcaaatcctggggatataactgaggtccctgatgtttgggacataagggaacaaggctcccacctgccatggagcttaaagtcaaatatatagtaaacatttttgtctttctgtatgtatttatgtgactgtgtgtgtgtgtgcgtgtaatcatgtgccatataatgattttttgctcaacaactgactgcatatatgatggtgatcccataatattttaaagtaatgatcactgatgttgagttttttttttttcatatgattgttggctgcacatatgccttcttttgaggagtgtctgttcatgtcttttgcccactttttggtggtttttttttcttgtaaatttgttttaagtcccttatagatgcaggatattagacctttgtcagatgcatagattgcaaaaattttctcccattctgtaggttgtctgtttactctgttgttagtttcttttgctgtgcagaagcttttttgtttaattagatcccatttgtcaatttttgcttttgttgaaattgcttttggtgtcttcatcatgaaatctttttctgtgcccatgtcctggatggtattgcctaggttgtcttccagggttattatagttttgggttttacattcaagtctttaatccatcttgagttaattttccatatagtataaggaaggggtccagtttcaattttctgcatatgcctagccagttctcctagcaccatttattgaatagggaatcctttccccattgcttattttggtcaggtttgtcaaagatcagatagttgtaggtgtgtgaacttatttctgggttctgtattctgttccattggtctatatgtctgtttttgtaccagtgccatgctgttttggttactgtagccctgtagtatagtttggtgtcaagtagaatgatgcctctagctttgttctttttgcttaggattgctttgacttttgggctttttttggtttcatatgagttttaaaatagtcttttctatttctgtgaagaatgttaatggcaatttaatgggactaaaaaaaaaaaagctcaacatgactgattattagctaattgcaaatcaaagccgcaatgagattccatctcacgccaatcagaatggctattactaaaaagtcaaaaaataacatatgctggcaaggttgtggagaaaaaggaacacttctttcctgttggtgggagtgtaaattagttcaactattgtggaagacaatgtggtgattgattcatcagagacctaaagacagaaatactattcaacccagcaatcccattattgtatataccctaaggaacataaattgttctattataaagagacatccatgcatatgttcattgcaacactattcacattagcaaagacatggagtcaacctaaatgcccatcaatcataggctggataaagaaaatatggtacatatacactatggaatactatgcgccataaaaaagaatgagatcatgtcctttgcagggacgtggatggagctggaggcagttagccttagcaaactaatgcaggaacagaaaaccaaatagctcatgttctcacttataagtgggagctaaacagtgaggacacatggacacgtagacaggaacaaaacactctaaggtggagggcaggagaagagagaagatcaggaaaaataattaatgagtactaggcctaatacctcggtgatgaataagtgtgtacaacaaacccaagtgacacatgtttactgatggaacaaacctgcacatgtgcccctgaacttaaaataaaagttaaacaaattataacattttactgtaccttttctatgtttggatctgtttagatacacaaatacaattgtgttataatttcctatagtattgagcatagtaacatgttatacaagtttgtagcctaggagcaataggctataccatacagcctaagtgtgcagtaggctatactatttagtcttgtgtaagtacattctatgatgtttgcacaatgatgacatcgcctagtgatgcacttctcagaacacttccccatccttatgcaacgaatgactgaatatatattcaactgaaaaggaaaagtaagttagaaatgattataaaacataattgatattaggatcaggaagaagaggacactggatctagagtattagataaaatttctcaagccaggcatggtggtgtgtgcctgtaatcccaggtactcagaaaactgaggtgggaggattgcttgagttcaggagtttgagtccaggctgggcaatatagtgagacttcatctcaaaaaagaaaaaaaaaaaccttcacaaaggctgtaacattaaaattgaggtttacagcataagagtaggaaataactagtaaaaagcaaaaaaatactaaaattctaatagaatgataaagattccagaaagcccaggatacttgtaaaggagaaaaatacagagtggggatgtggcaagtaacagctcttaaaatttagtgtaattaaggctatataattggaacagagaagcacagggggagacaaattgtccaaaggaagagaattagccctctgatggcgaaccacatgtgtacatatgtttggaacattctttatatgacaggagaggcactgcagatcagtggggaaaagagaggctgttcaataaatggaaccgagaataaagtggcaatccatgtggaaagagatgaaattggatgcctaactcatgtcatgaagtttggatttaggacttaaatgtcaaaaacaaaatttaaactttagcagaaaaatatttagacatctataagaccttggaataaaaaaattcttaaaacataaaaaaattactgcaaaaaaattgataaatttgactatgttaaacttgagaaagttagttcattcaaatgtaccttaaagaagataaaaagagaagttaaaaatcgtagaatatatataaagcaaacgcaactgaccaattattaagtacgtataagtaacttgattgttatatatatcaagtatatataaaattttttctataattaataaaaaagcccaaataacccaatagaaaaaaatgggcaacagaactgaagtgacacttcatagaaaatgaaacacatatagcaaataaatttgtgaagaaataattaacatgaactttacttggaaaaatgcagatcaaggctacagtgatatatcacttatatttagtcagttggcaaaaactataaatggctgataataccaattgctaaaggtgatgtgtctctacatttttataataacttcagataacagttggacattatctctgaaatctgaacattcatatataactcagcacttatagtcatatacccaagaaaatttttcacataaacaaaatatccatagcactataattcataaaaataaagcctgaaaataatccatagatctattaatggaaaagttgattaataaatgttggtatatcaatacaaggagatcttatatagtagtttaatagttactatgaatgcacttcagagacttccatcaacatgattgaatcttgaacatataatagtaaattatgtacaaaaactacctattgagtactatgttcacagcctgtgtgacacgataatttgtaccccaaacctgagcatcgcacaatatatccatgtaacaaacttgcacatgtaccccgaatctaaaataaaattataagaaagaaaaaagttgtatccttcaaagattatatacagtataatactgcttaaaacactaaaagtaactaaaatttaaaaaatgtagtatttaaaaatatagaaaaatacaacaaaactttacaaaagccaaaaaagactaattatgaatatgggaattaggatgttgtctgtcatgtgtacgggaaattggggtgtgagatgggggtgaaaattttgactgactgtagggtattattacagtcctagatttgatttggatatgggtttgatgtgtctttttctctatgtggataactaaataagtgaataagatacactgaatggattttaaaagtgggaagccactgaatggacttaaaaatcaaagcaaacaggataagagttgtgtcacagaaagattgctgtggatacaatgtagagaatggattagagaagagctattctttccaggaggtctgggtaggagtctgtggcagtattccatgtattctgtgtaggaaatgatgtctgcttagagcaaaatagtgcaaaatgaggtgtaagaggagtaggtaaaaccaagaggcatttaagatatgatattaagagagctggattgcttgcttgattctggcaggtgtaggagaggggagtgtcaaggtcaagtctctggatttttgcagaagtttgtttgatccaatttcctgagagaaggaaggatgtaggagatgatttgagggtggactttgagtttgttttggacacgttgagtttgatatgcctgttagggctctgaaaggaactgttcagtaggaagttggctatatccttaaactctaaatatcaaacttgaaaaaacagtcactttaatggacatttttctaaaatggattacattctgaccttttattaaagtgaagtttatggactgtaatggaatctttgttacagagtcagtattatcattttacacatcaattattgaatgatgttgtaaaaaagaaatgatttcagtgactttatgggagcatgtagttctattccaatattagatacagacccatgaatgctatttgtttttctgttttttaaaggactgctcttgggcaacataagtacttgttaggggatgatattaaccctttcgtgccactctgatgccacctggaattaaagtgcactaaagatatttctgactcctaaatggtatggaatactaagtgctgctactcctaatttggcagagttagaataggtatttgagagaataggtatttaaaaagcccaatgatgccacagtgcacctgcaaacactttgtggaaatttgagggcatgtggtaggtttgcatgggcgttatgacatagtggatccttgtcctggctcccccactcatattctcaggcaagtagattaatctctctgggcctcagttgtaatatgtaatatgaaatgaatatgaatcatgatttttaaaatcatgccagtctgaagtgaatgattatatgtttctagctttaagaaaataagcctatagtaaaccagctattttattatctagcctttggttagtctacagataatatttggtttgagatgagaaatggtcatgcagagaagacacaatgggaaaggatctgcttagaaactccggaggtttcttatcatcacagagggcaaaagggatatgatgttatgatatgtattactcacagagttatctagagggacagaactaataggatagatgtatatataaaggggagtttattaaggagtattgactgacacaatcacaagatgaagtcccacaataggctatctgcaagctgaggagcaagaaagccagtccgagtcccaaaacctcaaaaggaaagctgacagtgcagccttcaatctgtggttgaagttacaacagcccctggcaaaccactggtgtaagtccaaaagtccaaaagctgaagaacttggagttcaatgttcgagggcagggagcatccatcacggaagaaagatgaaggccagaagacttagccagtatagtccttccacgttcctctgcctgcttttatcctaaccatgctggcagcggattagatggtgcccactcagattgagggtgggtctgcgtctctcagtccactgactcaaatgttagtctcttttggcaacacacacacacatacacccaggatcaataccttgcttccttcaatccaatcaagttgacactcaatattaactgtcacatgatattctagaagggaaggaaacctacctttctttgtcttattctgaaccttaaacatatgacatatgcataggaaatgaaatgaaagttacttgaaaaaagggaaatagcaaagcaagaatttctgattctatagaaaaaagatacatacattagtcaatagtaataacacaataataattttaagtattaactattctaaattatttacaagtgctacaactaacactacaagtgttagtaaattctcacaaaaaaatctgtaaagttggcattattattattattattttacatgtgaggaactgagacaaagagagggtaaagagatctgccagaacttttacaaccaatggaatgagctttggttattatagtgtaagttcacaaaatgattctgtcatcagtaaataccggtttgcattggaattcaagtactgtgttttcatttggataccagtgtggagatacacattctgaaaactccgtgttttgtctttactctcagagacattctacaccctccaggtctccctagcctgtaggatgtgtaaatctcagccaggaaaatatttactagtgatctttctgcttgcagataattagtaagacagttatcaccttctctggcattttaagttgctcttattcacttttgtccctcagacctccccaatgctgctctgaattgggggaaatcaaaatgagtggaattgctgaccaatgacttcagttcaaaacatttacatttttcttggtgctgccagggaggctaaggtttcttctcataaatccagggagacagatggccttgctctcttacatgtttggcaaaaggctgttgtgtcagccttttctatttttgttttttaaaattatctcctccttatagccatgcactcatttattaaacagcaaatgtttgttgattttgtctgattaatctttggtgctttggggaagaattcctatgtttacataagggagaactaaagaattaaagcaataaattaaattaaagcaataaaactaacagcaaatttttaaaatatatggcttcatcttttgcaagataggtagagggtatgattgattaaaatgcattgtcagtattggaattgcccttaataagttataatgaccactggaatgttgagattataatatttataattgtaaaacagtggaatataccaacacaattgatttggattaagggcatatatgtcccggataattttcaatcagttctatatacagtttcccaaaattaataggccttataaaattttgaccgctgatatttgctttgctctttcatactcttatccacaattcactctgacccttctgctcttctacatgggcatagtaatgtcaggaataacaattaattataatcaagatcacaatttatttattttaataaataattatagttactataataataatttattataataaataaataatgaaaaattattaggtttactgtgctaggtgctttacaagcaatattttgagtaactttaaaagcatcattaaaaggaggtactattattatacccatttacaaatgagaaactgggctatggaaagattatttaaattccccaaggttacaaacctctgcaaggactcacagctggtttgtcagacttttgagcccatatgttgaaacggtagactgtgttgtgcccctgacccaggcatgcctagactcctttttgccaaagtaatcataacatttatatactatgtatgaactatttatacaaacacgagtatttctggaggatgtagaaagaggtggccactgacttcgggtaaaaaaaaaaaagtcttatttaatagaaaagtgaaaagtacctttgccaggctcacctagccttattttagactagcaattttgcatttattgagtctctagagcacactgattaatttagattgcagtttttctcagcagtgagttttggggtcaacctaacaagtcttagaaaaaatagttaaaaattgaaagcaatagtgaaacaccagtttttccccaaagcttaataaaaatatttgataccattcattcattcagtagaggtactggagatttgatgtgctcataaataataaattacaaaacagaaagtggtacctgctgtaagagaagcaccaaataaacttgaataagagttaagaggccttgaaatatgggagttttatggacatgtgaaaattggaagggaagagatagcagaagaaagtgaagtaccaggagaagcatcttgcctttcccaaaatatggatatgagaaatcagtgaattagttgataggagcagaatcagtcataaaagggtttctagattttaagttgaacatcaggagaaagattttaaagggctgagtgctggggaaaggaattttaaccttgttctttacgaaaagggatcactgatggtttctctaaaaaaagtgtggatttgatgcaggactggcaagccccagagtggatcttagcctgtaaaggttctcagttttgcccaggaaagaattcaagggcaagccagaggtggaagaaaacagttttattgaacagtgttacagctctggtggggttacagctctgtgactggcaaggagtgcttgccaacctccactctcatctggccgagaacatccagctgactacaattcccctgacttgaagtcctctggctctgggggccctaccaagggacacgatggacccaaagcaggcagcacactaccgtagcattggtacaggacaaaataagagcttggccattgacactgccttcagcacaccctggcaaaaaaggtgggctacaaaacaaaacccaaaatccataggccaaagggaatggagttgggcaagcacctgccagcctcaaaacccttctaagcaaaaaccaaaagccaaaatgaggttacacattgaggaacaccaatagcatagaactaagttatgttgggagaaaacactgttcccacagacctctaagacaaaatactttagcattaggcacaacagcagtcataatcagaggagaaaaactcaaaggagctgacaaaaaaactaatggagagagctacatgaatctcagaagctttcaaaagaagtagatcacaggattgaaaataaaaatttctggtaatttagcaaatcaataccttaagaaaatttggttcagatatagagaccattttctaaaaagcctgttatagacagtttccttttaatacttccatacattctcctttactaacttttcaagacttatgcagatcatctataacatgctagaatgttctgacttgtcctatgctgcctatttcttaaataaccagtcattttactctagggcaagaatttactatacgagatcccttctcttataaaattactctttctttatatcattccttgcaaaataataataaatcttctattcatgatgttctctacatctctcttttttactcactggttccctcatattttgaacctcccttttaataactaccaaattagacaaaattatttttcccaataaagaatacatttctttggcacattttatgtaaacctagggaggaagaaatcctagcccaccagacactggcattctatagataagaatcattctatcactttaagacgttaaaccacataatacgctcactatttaagcatctattccattctttcacttttaacagttttatgtagactatctccgagaaccaagttgctatgcaaatctagtcaccatttaaagccattttaaccattttaaagcctatatcagtgatttaccaaagtaaaaatcttaatgtcaaatttcagaagatgtaacattatcttcaaactaatcaactttgactagtcatttaatttatgaagattatttataaaccaatttgatagcatgctagacaaaacatatatcacaatacttgtatatatgcctaaacaaacacattaaataaagttacctacacaagacaactggattcaagttatttacaaaattgggaccatctacttggccaaattttgtttgcctcaataggtttgaaaacaggaagaggcagggaaagggatccaatagcatcaaattagaaagggaggtagcaaacagcattgctcaaggggagaccctggagaccccgaactaccaaagagcgcaaccagcagtggagtcactgaagaaaaatgttcaggcagctgcttgtctgccactgtgggaagccatctgcagggacaatggtccaagacttccagtaaacttacttgagtaagacagtttgtgggggctagtagaagaaggttagctctagaattgatggagagccttttttctctctcttaccagggacagttaggacatgcttattgccaagggccctcttgcttaaagcaggtgcactgattctggcccaggggcaggcaagttgggggctcttgtctaggcatcccatcccagatgccaatttcataacattttctcatgatagataactcttagggggcaggggacttaggcaactgctaacaattgtactttttggctatttctttttcttttttttcctattgccctgagatagttctctaactgtgtcgtaattgactggcttacccatatactttttcctttgcttttttcccacagcagagcaagtagattatttgtaagtcatgatgagttaaatcaaagaacatggtcaacttaacaaactcctctatacactttactggattttctgaaaactttctatgtttttccttgtgtaaagccaaattagacatagaaaatggcacatgtactctaagtattccctcacttccgttaggtatctcctgcaatggacacaggtttgactttagatgctggtatggggctgactcctggtggtactggttgggcttactttctggggcagcaaggggtataggctgaggctagttggataaggatgaggtgtgcctgatgtccttggggtacagtccttcattagagaactggtgggacccctccccaacccactgagagttgggagactgaggagaccctggagggggagtaggcctccaaggggaagcagctgggaggggatcctttaggcatgaatttctgttgcctggaagtaacatgagccagtaaaggtctataaaagcctgtacataagggacctcttcccgttttctttcagttttagaaaagaagtctaattgtaaagtatcattataacatatagaaccatgtttaggccaaatgtgttggtttgccactttgtgtcgaacgcaaatattattgccatactaaatgagtttcttcttcttttagccaaatttgaatttgctccattggcctaaaacataccccagtggtgggtcctctgggatgcttgctgttgcacccatgtctagtaaggatctctacagagggttttggttagcctaagtttagtaaatgccaagttgctttttcccttttacattcccacttttcataggtagcaaggtgttacaaattagatcccaagctacaaaaaggcagtgggatgttgaacttaaattccacagagagagggttacacagaaagggaggataaacaaatggctgtggaagagagaaaggaaagggtaaacagcattgcccaaggggagacctcagaggccctgaattgcaggagaatttacccagtagtggagacaccaaaaacaaaaatatttggatggccacttgtctactgctgtaagtggctgtccatcaggccaggggcctaggaactcccagttcctttggccaagaggggcttaagcaaggcacttgttagaaagcacacaggaagggacttgcagctggctgttgggaaaataatacttctaactctaagggcagaaaaaggcaagaccaatattcccctagggggaggggctataacccaccatacttagaaagaatgtcagtgctgaaaatcccagagcatattggggggtggccaaaaatactaatgctgaaaacccagagttactgagtgtcaaccaatgagggtcccctcaccaaatgctgaaaaccttgggggcaatcagggggcagccaacagtgaacccaagaccaagttgggggtcacagaacagtgtgactctggcatcccagagtcaacacaacaggggacctctaacaaccaagtgtactgccttaattgtccactcacaattaacagaacgtttaaagcaaatgtaagagtgcacatcaaacacattttaaggcataaatcatttaagaaaataaaacaaatggtggagcaataaaatggagttagaagacaaaggacttggagaaggggtgacaaggacgtgtttcaaggcaccgaaactgtgaggaactgacaacttagccaaaggcttttattccctagctttaccaaatattatgaaaggaagggcagaggggataccacccattcagcagaaatggcacagactgtgggacctggtgaagatctctccaggatacctcagcttgggtgagtttggcagggctgcctcagagggagaggcctgcaccaatttggtaatccacccattactagtcagagaggcgggccccacacaaaccagatggcactatggctgccccccaccaatggactttactgctggggtgggagaggcctgtacaggcaggtaactgacagggctgcctgtcagagagttgggccccacacaaagcagacagcctcacagccgtctcaccgatgggctcagctgccacagtgggaggggcctgcatggccagtaacccactgggctgctggtcagagaggcaggtgtcacatgaggcagcacactatggctgcttgttcatctgatcagctccactgcctgccagggaaaatagtggctctggaaagagctttggtagtgacagacctcaagtgttacaactctgttttgctgcctctccgatcctcagtctgctaatcactttttgccaccattggctctgctgatcagtgtcccatgaatcctgccaattgctgcttcactgattgctgactgctgcctcattaatcacccactgccatcttctgtctttgccccatgttgggtgccaagctgatgcagggcaggagagccccagagttgagcttaatccatgaggattcttggctttgcccaggaaacaattcaagggcaagccagaggtagaaggaaacagctttattgaacagacagtgttacagctctggtggtgttgcagctctgtgactgctcctgcagagcaggcccatcccatagacagagagtagcagccagggcagttttgcagtcacatttatacccatttttaattgcatacagattaagagatgaaggggtggtttattcagggaaggggtggtaatcgttgggtcattgccatggaaagggtcagcaactctggggtatcgccatggcaatggtaaattgacattggcagtggtgggaatgtctgagtgaaagcttctttttacctggcctttttaagctggtcttcagtctggtccggtgtccgaggcctgcctctgtagttgagtcttgcctcctatctcagattgattatttgctgatgtttataatacaatagcactaaaatattttagtatttatttaaataaagattcatactgaagttttattcattaattaaaaccactcaaattaataactaaatggaatactgtcatttaaaatttttacgttacaaattaattggtaggagaaagaaagatttttgtcctgtaaaattgagtttagatattatttttaaaggtaactactcaagtccaaattcatcaaaatgtatacatcaaatatgtatatttttgtatatcagttatacctcaataaagtataaaaaagtaactactcaaaaatctttactcatgtagtataagttgagacaacttatccaagaaacattacttgaatactgattgtgacaaagcctggagatagaaagaggaagaatacatatttttgttttcatgtttagcagggaagaaaggaatttggaattaagtgaatgaaatgtcagcacatcaatgctgtactattaggaggagagagactctatgaaattaagaccaaaaaatcaatagatgctatctgtcctttgaaggcaaggtctaatattctttgtaatattgaacagcatattctatgcaaatacttaataagttattacagcaatgtaaatatcaggcagatattttcattcacgtttatataaggcaaatgcattagttagtgtaaagggaggtaatacataataataaaggtaacagtctatcaagaagacagaacaattttagacatgtatatacaacaccctttatataaaattaggaaaaattagaattacaatgaaaaaattagcagacccaacttcatagttgagtatttagcaaaatgctttcaaaaattaataatctttaaaaaatggaaataaaagctatagaaaacaaaatttacaagcttgaagatcaaattttcaattccacaaatacttgattgattagagagtgggtaacaaaactgtttaccaaattgtccaccaataaaatgggaatggacagattttatctctactcagtagaaattattgtaattaaagggccatgttgtacagagacaactggctataatagaattttgtccacttctatcttcatcacctaaaacagtgcctggcttatagtgggtgctcacttaacaattgctgattgaataacgaatgcatgataagtttggtaccgttttcatgatcatagagtagccagtttatatatatgattaagaaacttgatgtaacttcattatcatggcccaaataggcttaaaaaattgtttaccttacacacaacccaagtgtaaaatattttcttgtgtctcttcttggcccatataatttgatttatagcccaaattgggcacatttatagcctggagatgatattttttccttcagaacctgccttatgttacattgtatatactttcactttctccacgatatacagaggttttcataagatcattgcatatttacattgtagtagtcaataagtcaagagagtaaagcgagttctagatggaatagacgtatcatgtggagtatgtggaatgaatcagtacatggaggactcagcaggagcactcatgaaaataagattgaggaactttgaaaaagatggagataggtggtatgtttgacttatgtgtaaaaagcagctaataaatggagacaatagcaaatgaaaataataaagtaataatggaaagttttaagagtgagaaattcaatcagaaaggaaaacaactgagagtaaggtgattacattgtagaacagaactcatggtttagccaataagtaaaactccatgtaagtatagctttgggaataattaaggaacttatttccaaaatcatctttattaaggtatattataaaaagctccattttaattttacagtttcatgagtttggacaaatggatctcagatttaatctcacaatcatgactccctctgcacaatgtccctcatacctctaggcagcccattcctccacttgaggcctgataaccactgatctggtttttgtgattattgattacttttgtctcttctagcaaatcttaaaagttgaattgtactactcagcataagtgttttgagattaataatgttattgggtgtatcagcggttctgttgcataaaaatattctgtggtatggtttctttgtttcatgctgctataacagaacacatgggactgggtaattattaaagaacagaaatttatttcttacacgtttggaggcttagaaagccaagaccaaggtgcaagcaggattgttttctggttccaagttggtgctttgttggtttgttctccaaagaggaggagcattgttgtctttatgtgccactataaatcctattagtagtggcattaattctattaattaggacagaggtctcactatctaaacacctaaaagtcttcacctccctatacctccatactgggaaacatttagaccatagcatatggatggagtacaattatctttattcttgcactggctggtggacatttaggtcgtttccatcttttcattattatgaataaagctgctacattcatacacaagtctttgtgtggacatatgttttcacaactcttgggaaaataccaaaggatggaagtgctgagtcatatgccaagtgtatgtttaattttgtgagatactgccagtctgttttcccaagttgttagactattttctattcccatcagcaatgtaggaaatatctagttacttcacatccttgccaacacatcatagccagaattttaaattttagccattttactgagttaattgtggtatctcattgtgattttgacttggatttcgtgataactattgatactgagcatcaatttctctctctctctgtctctccgtctctctctctctctctctctgtgtgtgtgtgtgtgtgtgtgtgtgtgtgtgtgtgtgtgtgtgtgtgtgtttggccagacttgttttatgaactatctgttcaatcttttgttcatttttaaaattggattgcctgtggcttgcctttttacttttctaaatgaggtctatgaaagagcagaaatttttaactctgatgaaatctaacgtatttttttatgcttcttttattgttctagctaagaaatattttccaatgccaaggccatgaaaattctttctggaagatttatggttttagattttaagatttgatttaattttggtgtagagggtgaggagggttaaagttccttttttttcccccccaaaagaaaccctccattcattcaaaaatatatgccccttgaagataagaaaggcatgagttttagaaataagaacagcatttttggccgggtcctagtgactcatgcctgtaatcccagcactttgggaggccaaggcaagggaattgattgagctcaggagtttgagaccaacctgggcaacatggcgaaaagccatctctacaaaaaatacaaaaattagctagccatggtggtgcgtgcctgtaatcccagatacttgggagcctgaggcacaagaatcacttgaacccaggaaatggaggttgcagtgagccaagatcatgcaactgcactcctgcctaggctacagagcaagactctgtctcaaagcaaaaaaaagaacagcattttcatatatttctcagtactctcttgtacatttctctgttactaatatgaataatttagttatgaatattgaggtttatttttaaaattcattatatattatatgtaatgatataaaattcattagataacttgaaaagtatgtaattgttacagactgaatcttctctagatatttcattgaaggataatgaaaaatatattttgttaaatttctttcaaaaaagtactatttatttttcctaataaaattaatattcattgtagaaaaaaataaaattaaaataaagaagaaaattaaatttgaattccacctagatgttgccctcacggtaaaatgaaatttactttttaaattaatatattatgggcattttgtctttcataagatatcctttaaaaatatggttttaatggccacacaatattttatcatatgtctatatggtagtattcataactatttgtcatgaattttcatgtagattgcacccaacattttaccactgaataatgttattataaatatttttatgaagttatctttgaaaatgtgatgaattttttatgtaatggaaaggatgtttcaatatttttaaggatacataacagttttacatatttatgaggtacatgtgatattttgatacaagcatacaatgtttaatgatgaaatcagggtaatggagatatgtgtcacctcaagcatttacgatttttttgtgttaggaccatcccaattcctctcttctagttatttttaaatatacaataaattattgctaactatacttgtcctattgtactaccaaacactattcctttgatcaaaagtgtatttttgtactcattaactaatttttcttttctacccctaccacattacccttcccagcttctgataaccatcattctactctctatcttcatgggatcaattttttttaactcccaaatgtgagtgagaaaatttaatacttgtttttctgtgcgtggcttgttttatttcagagaatctcctcctgtcagaggagaatctgcgaagggacaaatgacatattctgccatttgtgattacatatatagaacaggacggtcttgttttttggttgtttcataaatcctttcttttcttcttcttaatgtttttctttatggatacataattttatttggtagaaagttttaatttcttggtatttgttttttgtgtatctattttaggttatgctttgtagttaccataagacttgtagatattatcttataatcaatgattttaaagcaatgacaacttttctctggtcacaatgaaaaggaaaaaataagcaaaaaaaaaacccaaaaactaaaaaactctacattttcattccatccccctaactttaagacttctgttgtctctacttatatattttatattatcgatctcataacaaattgttttagttactatttttgataggttggtttttagttttcctactacatatatgagtgacagtctgaagttacagtttcagggtattctgtatttttttgtgaacttacttttgccagtgagttttatactttcatatcatgttgtattgcccattagtattcttttgtttcagattgaagaacctattttaacatgtcttctaagaagggttgatgttgaaattctccctcttttctttgtctgggaaagtcttcatttctcctaactgttctggaaacaatactcaatattctaggttggatttcttttttttttttttttttttactttagcatgttgaatatgtcatcccattccctcctgacttacaaggtttatactgagaagcctggtcctagatgtataaaagtttcttaatatgctatttgcttctttttttgttgctgttgttgggattctttttttttttgagatggagtcttgcactgtcgcctaggctggagtgcagtggcgggatctcggctcactgcaagctccgcctgccgggttcacgccattctcctgcctcagcctcccaagtagctgggactacaggcgcccgccaaaacgcctggctaatttttttttgtatttttagtagacacggggtctcaccgtgttacccaggatggtctcgatctcatgacctcgtgatccgcccgcctcggccttccaaagcgctgggattacaggcgtgagccaccgcgaccggccccgggattttttttttatccttgacctttgggaatttgaatattatatgctttaaggtaatcttatttgttttgaatcttcttggtgttctttgttgttctacctggttattcgtgttttttccaggtttaggaaggtttatgttgtcatttctaccttgatccctgtctctatatcctctttaataaaataactcttagattatcccttttgaggctattgtctagattttgtgggattagttcattctttttttattttttcacccctgactgtatattttcatacagtctatcttcaagtttactaattctttgttctgcttgatcaattctgcttttgagagactgcggcatttttcagttcgtcacttgaattcttcatctctagaatttttgcttgatttaaaaaaattatttcaatcactttgttaaatttctctgagaggattctgaattccttctctgtgttatcttgaaatttgctgaacttcctaagacaggtattttgaattttctgtctaacaggtcacatgtctttgccaatcaaggattggtcactggtgccttatttagttaatgtggtgaggctatgttttcctaatgtccttgatgcttgtagatgtttgttgatatctgggcattgaagagttaggtatttatcacgatctttgcagtctgagcatacttgtactcatccttctttagagagctttccaggaattcaaaggggattgagtgttgttacctaagcttgtcgtcactgcagctctttcagcagtaggtggcccccataagcccaggaacactgtggctcttcacttaattaaatacacagtcttggtggatttggggaagacagagtattccctgtgttcctaggcaaagcctcttgttttctgccctgtcttttccccaggcaaaaggagtttttctccatgtggcactgcctggagttgagggaggggtgatgtgggtactcccatggctctcacagctggtatcatgaggagtcacacctgaaaccactgccttccagagcagcacaatagtggtgctcacccatggaccacatctactactgtctgtctgccccggatatttttgtcaaggcccaaggctactttagtcagcagatggtgattcctgctgagacttggtccaacctgtcagtgcagtggattcccttctggcccctgatgggtctagaaatgcccttcaggagcaaaggtcgggaattaggcacttcagaaatcttcctgataatttactttgctgtgagtgagctggtacccacgttgcaagacaaagtcctctgtactatcttctctcctgacccaagcagaaagagtctctcccagtgctgcacagcctactcttaggagggatatgacacgggcactcacttggccaccacagctggtgttgctctggtccgtaccccaagtccactgcctctgagaccagcctagcaccagagctggaccaaggactgcagtcactgtggcctggttgccactcaaagttatttggagccccaggccattttaatcagtcactggtagagctgactagaattcagtttcctcccactggggcaaaggatacctctcagacccagtggtgttctaagtactccgtctgtgagcaccagcagaatttttccctgtgttgtgctttactgtgacagaatggccctggcttcaatgcaaagtcccacacttcctttgctgtcccttcttcaagcacccagattctttctccaggctgtgcctcttggggttagagtacgggtgttgtaggcaatgcaaaactcttcttcctatccccttcaatgcctttttctttgttgctatgttgaacctaggtatgtggtccttacctgcttatctggtttttatgaatgtgcttccttgcatggatagttgttgaatttgatgttcctgtgggcaacaatctctagagggttattttggtcagttcgttctaccttcctctgaaaagtagtttctgattatattcttagactggattattggtattggattaaatttttaaagacatgaatattcttttaattctcttgagagaaactttcactgctttaaatatccttgtttgtaatagtttaaaacaatagtttaatagttttaatagtttaaaaacaaggctattgatcttcttatctcatcatcagtatgtgtatacatatctcaccacagtatttatcatttcatttaaacacatttgtgagctaaattactttaaaatcagaaattctttgagtttttctttttttagttttttcacattgaataatttgatctgtatatatttttatttagagtaataatgaggatgaattttaattttttgataatgattcacttgtagcatatattgaattgtctttgctctcattactttttgtaatgttaaaattaacgtgtagaaaatctttatgtataccagggtctgtatacttcaaagtctgatccagatatgatctcacttcctccattttttgaggattaaagaggtaaactaaaaaaatgcattaggcatcacaaaggcctctagagaaaaatattaatatacacaccccataatttacctgaagttaatagtttaaaaacaaatctaattccttcaattagaaaaacttaaaaatttttttaaattaaaaattacctaaaaaaatatgtgatttactttttagaagacttattctccttttaggttgcaataacacatgatctctatttaaacattttgttcaatatagaaaaatagaagaagaatataaaagaacttataagtccaatacatatagattgttacaattataatcttggtttattttttatatttataatagagatcttgctttatttcatttttacatcctgcttttattgtctgaatttatatttaggacattttcttacagtattaaattttccttaaaccacagttttactgactgtacactattccgcctattacagtttgcttaaacattttcctctggattttcaaagggatgataaaagtttaaaaatctttctttactagttcctcattcataactatcattattttctgccacatagtatagttctatgtgttttcgttttcttctttaatctgtgtgttataatttatttcattattattttacttatttggggcatgcctaatcctacttactatttattattcaagatgtgagctggacctgaaaagatggattgctgaaggtgagagattgttcttaaggaaactggcactcttgttgaatttgaaggtttatgtgcattattataaacatattcaccattattagagctaccacttattaggtgtttactacgtagcatgccatgaattcaaagcacaagtgctgtatcacttagttttcaaacatcgctatggagaagttcagacagaatcatcttgacaaaattttctgtactcatggtctctgaattcagttcacagtttcttttgtaaagatactccaagcagcttcttttcaccatgacttcatcagaaatgcttttattaataccacttattgtttccatattgctaagtccaatgattctcaacctttattttacttgactgtcaataacatctgaaacagttcatcatccctgcctccttgtattgcttttgttacttgtcttagaggctgtcacaccctcctggttttctacctcactgacgacttcttcacaatatcctttgcaggttccctgtcttcaccttacctcctaaagttgaggtaggccaggaagcagaattagatttatctgttctttttctgtacttattcctttagtgatctctttgaatatattgttcatttatatgccttatcataaatttatcacttcaaactttacatagccatgttatactcctctcctaatttttagacatttgtgaccaaggcttacttgatatatctttttggattctaagaaacatctcaaacttaccatatccaaaactgaatttctcatctttcatcaaaagcttttctctttgccatcttttctgtgtcgatttttggcagtttcatcactccggctgcttaaaccccaaaatttcagatattctcaacttttccttttctctcccatttcacattagcacatcctgtttgcattattatatgcaaactttctttaaagtatatttagaattcagacttaagtcagatcatgccattcctctgctccaacatctttgctagctccccaatactcagagtagaaacaaaagttattatgatggcttactcaagttctgtgccttgagcactggagtcacattgactttaggtcttggtattctccccttattcattctgttccagtcacattggctttcttgctattcttgcaatgtggcaggtatatttctacctcagtacctttgtcttgctaactcttctgtatgtaatgttctttctccagtttacttcatgtcttaattttctacctcaccttattcaggcattatctcaaatgtcagtgactcagtatagcccacatggccacactatttgaaaaggtaaattgttccccatctctacactcgctgtccttcttctctgccttgtttttttaccactgtatttttcactgcatgacatattatgttttacttatttacattctttcttttctagtctccctctctgcccaataacaatcctgtaagtctattttactgctgtatctccagtgtctagaagcgcttgacacatcagatatgtgaatgagggaaggaatactgagtgaatatttgcttaatgctgtcatgatagaagaatctgcagagcaagaattcagcttttgttccaataataatttaccactagagagacttatttcaagaatttaactagaaatctatatacaacataaacagaatataagcatgcaaaatttatagagaaagcatgaagttttccaatataggttttccaacaactgaaagcttcacaaaatttgcttttatgatgtaattttatagtgctgataaaaatgcatgcattcttataacctgtaaatcttttcatattttatgcaaattgataaaatatatcataaccattataataggttgaatagtgtcccagaaaaaaaatcatgtcaacctggaccctcagaatgtaacattatttggaaataatgtcttctcagatgtaattagtcaaggattgagatgagatcatacacaattagagtaggctctaaatccaatgaccagtgtcctcataagaggagagaatgcaaagaagtacatagaagggagaaatttatgtgaaaatgaaggcagagagtatagttatgttgtcacataccaaggaatgcttggggtcatcaaagaagatgaacgagacaaggaaggagtttctcctactgcctctggagggagtgcagccctgctgacatcctgattttgcacttctagcctccagaactgtgtgagagaatatgtttctgttgtttttttgccaccaagtttgtggtaatttgttttggcagccctaggaaacaaatatagcaactaataacaatttttcaaatgttccacagtcatagaaatacaggaagagtcaaaacatggcttgtcccaaatcgcaaagtgattcagtccggatattgatgtgacactaagaactctttactcctggttcaagatgctaccacaaatatccttctccatctttttaactttaatattaggataaacaatttatagttctataaaaatataatacttttttatggaagtccccttattagaaaaacaataactacatattgagaatgtataacatttaccaacttatataagtaggctgctgcttatatttcataatttgcagtcattacttctaatgacaaaaatgctacagatgaattggggatgatgtcataatatgtgcatgtaactctatattaggtacttgctgtacctaatataaaatagtgtattcatattaatataaggaaatttattgcttcagcttgtgatgcagatacttccctcacctaacatagagttatatgcccatattatgacatatatgtcaaggtatttcttcctttaatgaagtggaacttactaatttaggtaattcaggataacctatgaagtggcctcactgatagaatttgtgttatgtaacactttagagttagtaatcctgtgacaaagaataaatgaaaagaatgatataaaggtagtcattgagttttagaactggtcacaatcttagaattcatgtaagctattttcaaacttctgaaaattctcaatgacatagaatacattttcaaataaaatctcatgtaaatacaatttattaattggtaaaatatttaattcttctatgtaaagaggggttagtcgttcatagccccttttttttcctaacaaggaaatagagatatgaggaaagtacatcaattatcaaagttagacaagtagtagaggccaagataaaactactgagagctttgaggattctgacctagagctctatttaaaaattacagtgatcgtgaaaagacctctataatttacaaccttgcttttgatctcattaattttatatctttttctgaaatgtgtcaacatcatcctatctgctgtgccaaatatcattaagagttactgatgtttacaaagaattaccacaaatcctttaatacactatttttgatgtactggtggaatatattttataactcagttactagcaactcactgaagatttctgcaatgccaaatttacagtaacccatttctcttctcaactcatatagtaccttatctaaacttctcccattataatctttttataaaaattataaaatttttagctatttatgtgcttttctttttttcttttttttgtgccttactgacagcagtttgagttcagaacctatgattgatctgtgatttaaggaaagcatctaacaaagtatctttcatatagcaggtacagaaccaacgtgaatgactaaactttgatgtagtttggacatcctttcctccttttactttttagacgttctttgaagatatttaagtaagttttttaggttattcacatgcgcacctagtggaattagatgaacatgaccatatacagatgatcttgtcttaccaagtgaaatacagtgtctggtagagtctgttgatgatggctatgaacattgcatgccctcaataaatatttcctgaatgatcatttgtaataggtccacatctcaagctgaagaacaatttgatgttaccaatgatttatagacttttactttgaactagttcctgaaattatcttgacattgtgctttttcctttgaaccttcttgctgccttgatgttcttcccctaccaatcttttctccacactgatggcagataaatcttcctgaaacactattttgtggctgttacttgcctgctcagtgtccttcaataatttccaactaacggcagctctaagtcataactccttactttggcaccagaaactgtctatggtctggctagacatagtcttagcttcaaatactttcctaaatatttgctgtatagtggttaacaatcgtacttttgtatgagacagatttgtattttaatcaatctgtcattacctgaaggtgtgaccttgttaaattcatttgctattgtgagcctcagttttttcatcttgaaaataagaataatgaccacatggatttttattccttccttcagtaaatatctattgagtgttttttatgtgctagtcacttctgtaggtattgggatgagtcaataaagaaagtaggcaaaattattttggagcttgcatgctagtggaggagataataaatataacaaataacctatagagtaggctaataagcaataaatgctatgtaaaaaaataagtggatatggggctattaggaatggaggaagagttctggagaagaggaaggatggaaatcagtctaagcataaatgagatattcttcctgccttgatttccagaagtcatggttaccagaagaattaagatttttagagatagactaattcaagcttcctattatttgttctgtcactaggtcctaggaaattggagtcatgtgtaaggaaaagaaagttggttttgacagtctccctatgtctttgtgatgtaaaatagtctagaggaaggaaatctgaatgttttttcttaagtgataagtgggaaactttcacaatcttgattagtgtattatatgggtagcatcattagaaagaatggaaattattttatacccattcctttatttgcatatgactgtctttgttgttttctttgtgtttgggtataaataagcaaattaggtaggaaatattaaaaagaatttcagcaaagcttttattcttaattcaaggaaatgtattttgacattaatgttttttaaccctcattattaaccctgtgatggcatctcttggccttcttatcatgccttcaaatgtgtgattattcattcctaacaatgattacatgtcacatttacctggaggatttgaaaacatgctttttcttagataccattcacccctgctccttttttactggtgctttaccaaatttctcagttgattctaatatgcatcctgacctgagaactactgacttacatggtctggcacatgcctctctctctaaccttatcacctcccattctctttatcacttgcctttctctgcactcaggccttcttttcatttgcccaaattgcaagttatgttcatatcagtccctttgcattttctactcttaactactcaaaatgcttttccacagagtcattcatttaacacttcaacacatatttgttaattaatcacctattcactctaccgtggatgaaactgaaaaaaaataacaattcttcttaatttggctgctttcttctcatcattaaatgattcaatagagagttgttggccaaaagaaccaaagtttcagttacacaggataagtggggagatgatgtatagcttggtggctacagttcagaaaactgtgttgcatacttgaaatttgctaagagagtaggtcttaaatcttctcacagcactacacacacaaaaaaacggtaactgtaaagtgatggatatgttaattagtttaattgtcataatgatttcacaacgtatacctataaaaacatcacattgcacgtcctaaatatatgcaatttttctttgtcatttatacttcaataaagctgggggaaaaagaaaaataaataaatatcacatcccaacatacctcacctgaccattccagctgacattgccacttcaaaattattttgtcttccttattttatgacagctcttatcttgttatatattttgattttgtcttacgtatgtatgtgttattgtgtttacaacctgtagaggatatgttctataaaagtgaaaatttgtatatcttattagccattttatcctcagtgcttagattagcattggctggaacataatgggtactcaataatcaatcaattaattaattaatcaatctgctttacaatgtaactaaatgtggtttctgtagttcctaaactgagtcttatctaccatgaagatactgaagtttaaggtttagcacccattttaatcatgaatcattttcaatcaattttatctttgtaaagcagtccttcaaaattcacaaatttcaagccttataataaaatctggatgtcttctgttcctaaattttcttccaagccaattaggtattagtttatcagaataacatttgttttatttcagttaaagtagtaaaataattttgctctaaagaacaagctatattggaatcatgggttgagtgaataaaacatttggaaccaataataaatggttgaggtaatagctcattttggaaaacaaaagccattcatttagcttttctcgtagaaatagatttttttgtcaatcgattatgttgggttacttataataagtaacatagtaaatacatttaattccatattactaagtgattaattcccacagcacatttgatatttttagaaaatttgcatatttttgtaacaattggcaaaaaattaatatggaaacatgaaaaattattgatatgggtatgcatttaaaataaacttgagcttagttaggaaataataattgaaataattccatctacacattttttaagcacttgcactatacctcctctaataatagagggcatactagtcataattgaactgataaatcattttatctttaagttatttttaatattgcttttgtcaataagggaatatttttctttgagaaagcaatgaaagcaagctttgtgcttgacataaaatctaggtgtagtaagctgtcattcaaaatcctttataatttgacttaaataaacctttccatcaactgcctctcaaggaaagggtactactgacttattcaaagcataaatgattcttttatgcctgtatacttgctcatattattttatgtctagcattaccatgctacttgtattagtatgttctcatgcagctaataaagacatacctgagactggacaatttataaaggaaagaggtttaattgactcacagttcctcaaggctggagaaacctcaggaaactttaaagcagaaagggaagcaaacacatccttcttcacatggcagcaggaaggggtggtgctcagcaaagggggaagccccttataaaaccatcagatcccgtgaaatcactaactcactatcagaagaacaggatgggggaaaccaccaccatgattcaattacctccacctggtccctcccacgacatgtggggattatgggaactacaattcaagaagagatttgggtggagacacagccaaaccatatcactatttgaagtgtagttctcaaaccagcatcatcatcattatctcagagcattttagagaaatgcaaaatctcaagtcccactcaaacccacttaattagaatctgtatattaacaatatatctgagttattcatatgaccattcaaattttaaaattaaggtccaaaatgcccttttcattaactttttaatttttgaaattctaacttcttctcaagactatactcatatccactacctattgaagtcttccttgaatattctagagaaatacgatctttcaatcctgggaattattgcattaaaaaaaacagtgccttcaattacagctgtttgtagataatcttcctctttgaggatgctattcatgcctcagctatcacctagaaaaatagatttaatagcttttccaaaaatgttgtttcattaattatagtcatgctttccaaaacattacaaatgaggtactgaatttaatgcaaggtaaatttctcagagataagaagatagaatattgtctgtttattccctaaactgctgctttcatgctaggattgcaggtcctcagggtcagaaactttctttctacttcctgaaagactaagatagtagcataaggacagaaaattgaagaggtttcctacattttcattatgactgaaaccttgaatcatcatctctacttgcattcagcctgggtatgaatttttgctttcctctttgttttgcgtgacctttgtcaagtatcatagttttctatgtctgatatggtttggctgtgtccccacccaaatctcaacttgaattgtatctccttgaattcccatgtgttgtgggagggaccctggggaggtaattgaatcatgggggctggtctttcccatgctattctcgtgatagtgaataagcctcatgagatctgatgggtttatcaggggtttctgcttttgcttctctctcatttttctcttgccaccaccatgtaagaagtgccttttacctcctgccatgattctgtggcttccccagtcatgtggaacttgaagtccaattaaacctctttttcttcccagttttgggtatgtctttatcagcagcatgaagatggactaataaaatatcttgtttctttatctattaaattgagctgggcatggtggctcacacaggcagtcccagctacttgggaggctggggtgggaggatcctttgcgcccaggagtttgaggctgcagtgagctctcattgcaccactgcactccagcctgggtgacagggcagctgagctagactctgtttcttaaaaaaataaacaataaggaaagataataacaatacagtaatatgctccttacgtcataggtttattactaggattaaattatgttacatctacagaaaattttgcatagttcttaatatataagaaacactctgaaaggttaataacaatagttattattattatttgattattttaaatctaggttacttttattgtagctatccaagaaaagctcacacacaatttcttaaaataaactatttaatttacatttacttataatgaattaccccaaatcaatagtgttgtactttgaggatggttgtttttcataaatcttagtgattcagctagccacacttatttaaataatatgctgggttgctgaggggcacaggatcaaaaattaatgtggcaataaaggcttccttgcttttgaacagatcaatatctgtaagtgaactagaggcacttacaactaaatatccaggaatgaattaaaaatagattctctgatgcttgatggagttaaggatctgagattatggtctttgagaaacttagtgacctgaatacatattcctcttctaccatcctccttttctgcaatactcatcaatttcaataggtattgatatgcctggttgcataaaaggacattgaagagttgagctctttattctaatagcttttaaaatacaaatgcgcatcataattattctctagtagaatctttgtatataacatcatatgcacaaataaaacatttataagtatgattataaacattcttcaacctcattacagatctaaggaagctgacaaagagtaaagaagggcagattcagcatctacgtgaggctgatatgtatgctttttgccgagacaaaaaagattaaaatgtttaagcctcgtcaaaagtctgtgagaaccaaatgaaaggtagattatattcttcctcatattccagattattatttactaattcaatggatagagactgatggaacactattcagtgcaagacattaagttatgtgctgtgatatgagagtaatccagagagttcagctaatattaaacttaaaagttaaagacagaattgcatgttgaattacaattgtgatatatatgatagcatgtaaatggataatatgatctcctttgtgccaaggccctaggcaaggaggaattaacagtattttggagacagggagaatgctaatactgctggagcataggtggaccaaggaggctagtgacatggtcaaatcattgtagacaatattaagagtttgtttttaattctaaaagcagtggagcaccactgaaggattataaacagggaaccttaaacactagggtcagatatgcactaaaaaggattactaattgctatgtgaaaaaatacgttagagagcatgaaaagtgggtgggaaggaagacccgttaggagatattagagtagcttggaaatgtacataatggtagcctaaataaagttagtgaaaaagagagggaataggaagagtagactgaatcaagaaagaaaggtttaggaggagtaataggcatagtttgggatgtttgtaaattgtttatgaggtgtcgcgtgggtgatcatgatctttgctaagaaaatgagtttagtcttggataggttgcacttgatgttccctttagagattcatgtaagagttttgagtcggcaattggatacatatttctgaatcttagagaactaaggggcaactttaaaaattgaaaattcttattttaagacagatgaatggaaaaacttctctactcatataaaccttttaaatttgtcttctcatgtttattgacatgtgagtatgaaatagaggtaggcttccaaataatttagtcatgcagtggtttgcaagctttgtttcttaaagccgtaaggtatcgtgaaggtggctcagaatacctcgtatattgaggagatacctgtgtataggaagccaggctcttccttttcaactaaaggagctttacttttatgtaagttgcaatctcaaatgatattttattcatttaaaaaattttaaaatatctttattcacgaatggaaactgtctgctacattattaaatagtgaggtatctcagttcacaccctaatatttgagaatgaagccatgaaaggcaactatcataattatctccaaaattatttctttaaagactaaatactagattggagctactgcttatttggtctcatgcaaaattgtgttcatccttgtgatattttagaaatatagtttttttattatactttaagttctagggtatatatatatgcacaatgtgcaggtttgttacatatgtatacatgtgccatgttggtgtgctgcacccattaactcgtcatttacgttaggtatatctcctgatgctatccctccccactctgcccaccccataacaggccctggtgtgtgatgttccccttcctgtgtccagatgttctcattgttcaattcccacctatgagtgagaacatgcggtgtttggtttttttgttcttgcgatagtttactgagaatgatggtttccagcttcatccatgtccctacaaaggacatgaactcatccttttttatggctgcatagtattccctgatgtatatatgccacattttcttaatccagtctatcattgatggacattcgggttgtttccaagtctttgctattgtgaatagtgctgcgatatagtttctagaaactataggcaaaagttgcttaaattcacagtttaacactttgaattttgctttgtcacctgagaccagcaattcattgagccaggttatctcctttggctttcagaattttttctagctcatggtatacagatctgttgtctatatccaacagtcctctctcagacatagaatagcctgatatgtatatttttcttgctagttatttttttctccattattattattaatttactatatatattatcatgtctattactataatgtcagttgtggcattagtgagtagtcttgtcctttttcttgctatgaagggcaaataattaccacacaaagaatgcccctctgctagaaactgaaaggtaatttcagctttctgatgctctttcaaactgacactcaactgtaacaaatgtgtgctaggagaaattaacattttttctctcatatttcactataatccacaagaacaaacacagtaccaacatttatcattttagttaagtgaaatgctaggaatcaaagtgacaggctctgagagaagttatactgtggaataaaactttatgatccatttgcaaggacggaaatgtacttggctcatcttagtaagtaaataatgctaaatgtatttaaatattgatctgttttcagtggaagggtgaaatgaatttcaaaatatagaggctataaatgtatacaaagcattttctactgtactaccaatattgtgctatgtcactttacgaatctgtgagtaagttgctgaaaactgcaaattttgttataagttgtagtagtcatctatcaccaagtttgtatgttgaagtcaatgtacctaagggaaaatagtgacagagacagattagtttctgcatagcatctgtcagtgtagatagctctcaccattttataggtgagaagcttaactatctttaacaggtaatataggttctattctaagatccactgtctgtttcctttaacaagcaccgtgatgaggctgtaacttctaccttgatgtttggagacatgttcaataatcttgagcaaacataatacttcatttttatttttcaaaagatttacaaattatcaaataaatttaattttatacaaaaataatcccaaatgacagacatatttaatctgtctggggaaaaaaaagaatatgcaataggaagttttggtattttctctgccgtggtgctgaggatatttaagttaccgggtatatttaaggtgctgagaatttttgttagaatttgaagagaaaaacacagaaggactaaattttcttaatgtattgaaacaagaactatttttatctggagataaattagacaataataacaattttataaagttaatttatcagaaaactaaaaagcgatattgaaataagtctattctgtttataaactaattctgtcttgcatagagtgaaatttgatgtgaacagcaagtagcaaaatttgctgtagtttcttcaatgtttgctgaatttttgagtaaatatgaatgttattttaatctttatgaattctaggctgagatagaattttcaaagaaatctgatgcagggtcttatagtagcttagaaaatataattacttacggtatgaaaatattatcaattcattcaatttttttattttaaaaaacgtatctcaatagtttctacctaaaagttgtgataaatggtaattaatattgatatttatttataaactctttaagtattagaaaccacaacttagattttgcatttaaaataatgtaatttaattctcttccacctcttctcttcctttaatttttgggttggttggagttatctggtaaagtgaatctatgacatacactgaaacgttaaatggatggttttatgtttgcagtaatgaaagatttaagctttaagtattctctcaaactctgatttccaaaaatgaaaaattaaaatgagattccatttgcataataaagtagtgacaaagaatttgagtgtaatttatttcattgcaaccctttatgtccttggcattctatctcattacataaacatgctgtttaacatgtggcagtgtgtattggtctaaatggtatgaacatatttcattctgtgccctttgtattgtgccatactggcattttcaataaaggtatcacttaccttcttccttctggagaaaatactgtgcttcttcctaaaggaaagcaaagataatgtgagaacaagacaggtaaatgtttaatggtatcacagaactgcaataaattttgctcgttagcttaaggaaagatctatcatattttattatacctgtcatctttaattttaaagtctctttctataataaaattcttcttaagtgaaatccattcagtgcttttttttttatttatagaagctacaactttagaagtttaatgaaatacccaattcttaaactacattgtcatcatggaggttgtacaataatataatctgtttttgagttcttgtgtcttaacatttatttggaatttgaaatgaaaaaatcataggttgggtttattgcaggcttaaattatttttataattgactagattattggcaatagttaacatcttcaacacagtcattatgtgtgcaatcttgtacttgtatttgaaagtgtatttaggggctatatagtaaaggatactagctccagaagactgtagtatactaaaggtatccagagaagttaacattcaaatacatcctaacagtgaaatttggagagaccaggtttctatcacttttaatattatttaaatattattggaattatataaattattttttatttttatgttagatcaaccatcttttaagccagattgtgagttatccatttggttattttttcctttaatcaattttattgaagtgtaatttacaaacaatcatattcaccaattttaagtgtgcattatgatgtgttttgacaaatgtatacagttatataagcaacatgatgccctcctctcaccccaagtccaggaatttactgatctatttttaataattatagcttattgttctacatattcctgatgcttctctttactatttgttttatatttcctctcttttttttcattttggatagttttcaacactatcaggttcactgatcttatcttctgcagtattaaatctgctgtgaattgtatccagttctttacttctattgtatttttcatctctacaaggagttctgtgataaaatatgcataatttttcgaatgactagggggtcaaatcctgttgctgatgttttcatttgaggaagttccttaattattcagtgccttgcaatcttttatctgaaaaatgggaaaacagttccatctgtgttgtaagatcaactacaactatctatatgtaacacttaaaagtaaaaagtaaactttctgtaagtaccaactattatttttattatcagttagtatttatgacttattaaatgcccattcttagaaaaactaaatatgcctattatttgtaattctcagctaagcgcatcacgttcctaagaaaaagacccttacatcctacttaactcgtcttccctccaaaatgtaaatgtccatttctcctgaagtccatttggctgcatcctgcccagactcttatcttcactgtaatacatagaacataccttttctattgttattgagttgtgtcaagaatttccttcctgttcagttgtattcctcttgtatatcaagctttccattctactttgataatttacatatggattccttttcataggactgtgagtgactggagagaatggattttcatatcatttgttctattttcagcaccaaactcagtacccggcataatagttacctcattctgaaagacaaaataaataaataaataattataggaaaacaaacacattatgacagttttagtggactccatcagcttaatacattaatgggcttgcttcttacctgtcttggccagctgtgaaaatgaagagctgaccccaaccactgcttgacatcacatgaaaacatgtcctgactgaaggtctcccagaagagttccaggcctatttgcctgatgaattttcctgtttcattatttattaaaatgctattcagtaggaagctgaatttgatgatagtttgcaatgttgcatttttattggaaatctttggctgtatttagtttccttggtgtaagttgttacgtgatctcagcataattgttcaggtcagagcacttttgtccttttgtggtagttctgaaactggcccttggccagatttataagtgtatctacaagaagtatgaaattgctagatagtattatcagtgatgaggtacggaaatatcgggcatgagactatctgactctggcagtaaaaagactgtaactctgtgactttgcctccttttcaaatcagtacctcgtatttactttatatgctaaagagctggcttcaaaccgtcaaatggtacatgcattaacatggagaaggtttattttggaagaatctcatgtagaaaaggcaacactttcttttaaaattttgacttctaaatcagaggaaaaatgtgtcatactcaaaaatatatatccctcatttaaaacaaaagagaaagacaggtattgttctaaatgagatattcctgggtaagtcagatatcacacagtaatcaataagtgctaggattacaacagtatacttggtcatataatacacatccgcaatattgatactgggatttgatagttatgcttttgaaaatcactacctggagtcatgattttggcagcagtttctcaattcgaatttatggacttcacaattgtaaagttgctttgagtagttattttttaatcccctgccctcaaatccttttagcccaagtttatcccgatcaccgtgacaagattttcatgtcacaatagaagactcttttctgtactagtgctttaactagcaaaacagcctttgtttgttgaaagcctctgaaagggctcagaatgcctacggaaatgagtcatattgggtgtaacaaagtggatgaaggggagaattataagagagaactatgaaaagctgggcaaaaggctgctcgtgcaggatcttctatgtcctggtaaaacttgtatttcatctgaagtacagtgggaagccactaaaaaatattaacgatagaggaagggaatgagaagaaataatataatcagatacacattttaaaatttttccttctggatgttgtttggcagttagtttggagggaaataagagaagcgtaagagccagtaaacagggtatcacagtagtccaaagagaagagaggaaggtggtttgaacttaggagcaagggattcgaatgcctagagttgatatccatttatacacacaataatatgtcttggtattagattggatctaaaggataaaggagtaggaagaatcaggatgagagccggatctctggcctaagcaaatgtttaaatgctgatttcatttaaataaaatcgggcaagtctgtgggaagaagaattggctgggagtaaaaagagatagggttcttgtgaaactcaagttcgttgttgtctgttggatttgagagcctcataattcatctaggtggttaaattctagtctgggcttaagggagaggggcctttactgcctctatcttggaaacaagacaactgttaagcaagaaggtacctctttagatacaaagtagataaatattattagactcaatcattgtattgaatgatctcacgcttcaatgggagagattaaatatgtatacacatgttaaatgttcccatagtaaagcctagtcttatgtttattgtaatgaatttgggcatattaacttatgaaagagcaagaagctagggattatattagtctaaggcgtctttggaggaatcatactacaaaattaggtgctgacaattgacctcaaagacttgaccacatagacaaaaaaaggaagatagtttgccctttaacttcctgggcatggcactagataggatgataactcaccctgagttgggagataattgacttcaagcatctttgcagagaaggatgctatgaaatcatttatttagttttctgaccaaaactattgcattatttgcaacagtactaaattaatagtattgatcaaataaaaatagttgcaatattaaaaggtctgaaactattcctacagttaggattaatcccataagtattcgggggagaagagcaccatagaacagaatgttttaaaaactatttttaaattaatattgttttgacaaataattgtatacatttgagggtaggaggtgacatatatatatatatatacacacacacacacacacacacacacatatacaatttagaatgattaaatcaagttaattaacatattcattgcctcttttacctatcatgttttatggtaaaacatttgtaatttactcacctggttatcttgcaatatactgtacgttgtcattgactatagtcatcctgctgtacaatagatctaaaacttattcttcttgtcagaaactttgtatcctttgctcaacaacttttcattccctctcacctgctgccacctgcccagccgctagtaaccaccattctactttctacttccatgagttcaccttttttggattctccatgtaagtgaaacaatgcagtctttgtctttttgtgcctcgcttatgtcacttaacataatgtcctccaggttaatccacattataaaaaatggtaaaatatcctttttttgaggctgaatagtattccattgtgtatatacactgcactttccttatccatttatcttttgatgggcacataggttgatcatggaccataagttttaaaatatgggcaacattggaataaagcattgacggtgattataagtagctgatgttatacagttgtcagaagcaagggcattggtagccctcttgagtaatatgcatctatctaaacccttggtgaaaatttaagaggatgatgaggatctaaatacgtaataaaagtgacatatttttaagtctttggagtatttatttatattaagttcaggtgactaaagtatgatttttttgcataactcaggaaataaattgagccaagtaaacagtaaatgccagagatggtagtaaaaatggagaattccttctctttttgaggttcatcatgttgaatttaaattgaaccttaaaagtgggataatttatgtcaaattttgttaatctcagccatgccacatgcttgtaataatagatagaggtgcaattaaggagtaaagttacatattactgttacatttttccagtgccttaagaatgcctgtatcctctcctagtcaaacatttcaaggacatttctaaagaattaatacaaaatgatataaaattgagtaaagcaatactttatgcagctagatttaatcttgttaaacatgcattaacttattttttggcctatataatctagaatcaacatacggtcatagatctgcattgtatatgtttcaaactcttaagtataaacctaaatctaaaatcatatccctctactgcttgaaaaggccacatcctttaaggccaaaaattaagagagagtggaaagttcttagtttgcctgattaattatctatattccctcctttaaggcaccaatcatgatatatatgtggtctaaatacgttgataaaagccaaccaatataattttcctcttttgggtttgtgtgcaaggaatcctggagattaaatgaagagtacttcgtctttgaagctaacttaaaggcagaatttagatatctgcaaaaatgtggaagagtactcttggcaaggtggattacgtaaggaaaggtatatgggtgtagcaaggcacagggcaattccagggagaaagtgaatatcacagataactgttgagcatttgccatatttatgcacactacaaaatactacagcagtcaaatatgcacgttccttttcctgctctcatatgtcagggatttagttggaaatgctaggaagtgaaagatattgattgaaatgatgttttaaggcatgttgatatgatctcagaatgcatggtgttttgggtatagaaaagtccagaggtaaataaatttgtcagaagacaatagaattaactccagtatgaaatggatgctatttaccttcagagataaaacaaaacaaaaaaggatcaacaacatatgacaatatgttggttgaaatagaacaacatatcgaagtaatttttcttatcccagaggagtcatagagtaacataagtagcatttattggaggcagcttatgaaaaatagttctatatagtattagtattctttcatttaatctttctgtagactggtgctttttttcatttctgttcatcagatgtgaaaaattaaggcctgaaaaaattaaataacttgctcaaaatcagacaattagtagatggtagtgttggcattctgagtcaggcagctatcattttaaaaatgatgaggaagagaaaaagatgtaagaaaggtgacaagttgtcgcagaagaccaacagagaagatatatttgccaatggtgtgttctttgtgttataatttgtatttagaagactttcccacacttaattatgtggattgccaatgttagcatcctgtgtctgtggtataaggtctacttgtaaaaaataagtgagtaactaatatgcactttcagttttttagaataaagtctttacacatttaatgcagaaatgaaaataagtcattggagaatgataaagtttagaaatccttgttacaagggaattacgctctttgagtcgtattttgagaatgtgtttcagagtctggcataacattcattacattgagtggggctctgtgactttgaaaataaaacaaaagagtaggtttgagaatatggaatgataaatatcccaaagcagtgttagcaacaagtctaaatgaatagtttaatgtgcactttcctagccatacagcttacaaagcaaaactaaaaactttcttctgcaaatgtgaactagttcagatgaatattttagaaaattggtgtacaaatggtgatagctgttgtttcaacatttgagaagcagattgaaacacaaaattagctattagcctacagcttaagtactctctaggaagaagaaaacaactgaagctagcaaattgactttcatttgggatgggtgcccatggttctgatgaaactctcatgcagtaacttccaaatctctggggacatatgttcaactgacctttgggaagtagagcaaagagaagctgggcagctttatacaaaatcacccttagcatttcactcagcaaaaccttctccaccagaacacagcattgcatagatttcaaagaaattgaagcctaactgggagaagaacataataattcactcataatgtttggaatactgtttaacacattccaataaagcactggctgggcagggctagattgtgatggagcaaaaaacgtgagaatgagctgacacctggtcaaatcgaaggattgaggattcagggacctgaagataagcctgaatagacagctggagtgagggacaaggaatctggaaattcagtccgagtcagatatattatgagatgtgaggctgcgctggagggtggaagcaagatttggaagagaaaagagtaaacactgtccagaggttccagtgaaggaggagtgtatgggcaggaggatatacaacatgtcttctttagggattaggccttgattcttaaaaatatataatgaaccatcattagaacactctttggccactttacaagaaaagaatgaacttagtgtaggtatggtagtgaggggcttattaactagtggtaaatatagacatccaagcaaataattacactgtattttgttaaacagggacaatagtatgaaatggttaaaggggataggcttgactatatttaattctcatttctgccattactggttgtgtcaccatcaagaaattgtttaatttttttaacatctatttatacttacttaaaagggggaaataatattatcagtgttactgggctgttgttttggatcagggtgttgaaggtcatcatcatctgatgatcactcctattttactaaggacaagcttgtacttaatgccaaagagagaaataaataatgtgaaaaggctgctgctggtgtcaacaatgtgtttgaaatcatgggagagtggatcatgaaaatgaaacattaatctgataattgttacccttttaaaggggaaataaacctttcagggaaataataatatctgataattttgtcctagggctttataatatagtgacttaccattgttatgtttttatgttatgttttcaatccgtaagttcttcaaataactagaaaaacagcaaccactatgttgatttaaatatttcagtattgtgaagtaaaagaattagaaatgcaatggtaattaatagttgtgtgttttaatgtatcatatgcatgtttataattagtgtgctaagattatatatgcttgttcatttaactaatttctaagggagaagttcagatacaaactgtgctttgatgaaaataaaataaaagtgaatgttaggaatctttaatgctatttataatgcatgttggcactttactgtataggaaacatatctggacctaaaatggaacaggaccgagtaatttaatgctaaatttttcattttacatataattcattgaaaaatacatgtatgaacaaagttcaacctgaacactgaatgatctgattgtataacttgcttctgggcatctagattcatgaagctgattccctaataaaggtaagtcattctggaataagtgtatccccttctagtaatttctaaacaacaaattgcatttgcaatatattgtcatgggttataactttagtctgtgaaaacaataccatgatactttttaaaaaaaaatttagaaaataaagtggaacaaaaaagcagaaaaccaatggcagcactaacagtgaaaaagtcgatctgctctaagtgctgcctcatcacccttgcctattaggcaaattatttttattgatgcttatagaagtaaactaatattcattttatttggacatcttatatctaatacccaattttctttcatcattaaaactttaaaatcctacaaatatttactttaatagaaaatatactgtgaaattagacatgatagactctggggaagcatttatttgattaggaaaggttagttcaagctgttctttatgaaggaatattaataaattcagaagatgatatatttacgactaatatattttatatttttaccaagtatgtgaagtcaatttataaatcacagaaaattatcaagattaacaccatttacaactattgtatatattaagtttttatgtgctatatttgacaactttagatatttactataaattaaatatcaagttcattctgaatagatgtgtacaaataaagtgattgtaaatttattgaataaagtggaataaagtagtagtagtatttagaataatatactgaattaaaaaatgatttcttccaacattcatagtagaaagcattattaatatgataaatttggccgggcacagtggctcacacctgtaatcccagcactttgggaagccgaggcgggcagatcacgaggtcaggagatcgagaccatcctggctaacatggtgaaaccctgtctgtactaaaaatacaaaaaaaattagccgggcatagtggcgggcgcctgtagtctcagctactcgggaggctgaggcaggagaatgtgtgaacttgggaggcgaagcttgcattgagccgagatcgtgccactgtacttcagcctgggcgacagagcaagactccatctcaaaaaaaaaaaaaaaaaagataaattaagctaaattcttcttgacatattagatgatttgcaaaaggatgccaaattttggtggtaatgacttttattcttttacttttcaaaaaatgtaggtaaaccccctgtgcaaccatgatcatgcttcaagtacttagatcgtttttcttttgaattaactcttgtatattcaacagaacacttaattgttttcttttttttgttattattatactttaagttctagagtacatgtgtacaacatgcaggtttgttacatatgtatacatatgccatgttggtgtgctgcacccattaactcatcatttccattaggtataactcctaatgctatctctccccactcaccccaccccatgacaggccccagtgtgtgatgttccccttcctgtgtccaagtgttctcattgttcaattctcacctatgagtgagaacatgcagtgtttggtttttttgtccttgcgatagtttgctgagaatgatggtttccagcttcatctaagtccctatgaaggatatgaactcatccttttttatgcctgcatagtattccatggcatatatgtgccacattttcttaatccagcctatcattgatggacatttgggttggttccaagtctttgctattgtgaatagtgctgcaataaacatacgtgtgcacatcttcttatagcagcacgatttataatcctttgggtgtatacccagtaatgggatggctgggtgaaatggtatttcttgttctagatccttgaggaatcgccacactgtcttccacaatggttgaactagtttacagtcccaccaaaagtgtaaaagtgttcctattcttccacatcctctccagcacctgttgtttcctgactttttaatgatcgccattctaactggtgtaagatggtatctcattgtggttttgatttgcatttctctgatggccagtgatgatgagcattttttgatgtgtctgttggctgcataaatgtcttcttttgagaagcgtctgttcatatccttcgcccacttgttgatggggttgttttgtttttttcttgtaaatttgtttgagttcttcatagattctggatactagctttttttcagatgagtagattgcaaaaattttctcccattctgtaggttgcctgttcactccgatggtagtttcttttgctgtgcagaagctttttagtttagttagatcctataactaaactattttagagttgatcaacaatttctgtatatgcaaataatttaagtgtctatactaatgtaagaatatccatgacaatattttttatcttattgagaaatatatatcaccattttattaaagatttaagctttcttagatgatttcatctaagaaataatacaactaagaaacaattaattagattagatctcatctaatatagtttagttataaacatttgcatatctatattaaatactttccgtgttttcagcttttttgtatttaatgtaaaacccacatattgataacttgtttaaaatgcataaaatcaacgcctttgatttgcctatttaataaataaaattgaactctcagttcattttaattaaaacatttattttatgtttaattttctacactcagtgctgtgttatacataaaaataaataccactgcctgttcattttggaaccaaagaagggttgtatgtaaattaataagaattagacattgtcatttctctcaggagctcaggggcaacttaaagatattctcagttatttcataactatcatttaaattttctttttaaaagtttttgtttatatttggcacataattttacatgtttatagggtacagtgtgttgtttcaatacatgtatacattgcatgatgatcaaatcagtgtagttttgatctatccctcaatgtctatccctcaatccttgatcatttctccgtggtggtaactttcaagattttttgtctagctaccttgaaatatgcaatacattgctattagctaaagttaccctattatgtgatagaacatcagaacttattcttcctctctaactgtaactttgataaaccaacctctaccctaccactcccaccttctcccttacctcttcagcctctacctaaacactattcaactctccacttctatgagatcaacttttagaaatttcatctattagtgaaatcttgcagtatttgcctttccgtacctggcttatttcacttgacattttatcctctagatttatctgtgttgccacaaatgacaggatttccttctggttttaatagccgaatagcattccagtgtgtaaataccacattttctttatccattcattggttgatggatgcttaaattgcttccatctcttgactgttgtgaccagtgctgcaataaacatgagaatgcagttatctcttcagcatactgatttcattttctttggataaatacccagtaatgaaattgctgaatcatatagtagttccatgtttaattttttgaggaacttctatactatttttctataatggatgtactattttatattctaactaacagtgtataagagttcttctttctccacacccttgccaacatttgttatcttttgtatttttgataatagctattctaactgggataaggtgatatcttattatggtttttatttgcatttcttttgatgatgagtgttgttaagcgtttttatcctatatctactggtcatttgcatgtcttcttttgataaatgtctattcatgccctttgcccatttttggatgggatttcttttttgctattgaattgtgtgagttcttcatatattctggatgttaaccccttgtcagatgcatagtttgcaaatattgtctctcattatgtaggctgtaacttcagtatgttgactgtttgctttgcagaagtttcttagttttacataatttcatctgcccatttttcttttattgcctgtgcttttcaggatctatctgaaaaattcttcttgaatcaattttgtgaagtgtttcccctatgcttttttgtaatagttttgtagttacaggtcttatatttgagtctttaatccattttgagttcatttttgtatatgtgagatagggtccaatttcattcttctacgtgtggatatctagttttcctgggaccaattttctttaattgaatggactgtcctttctccaatgtgtgttctcagcacctttgtaaaaagacagtttactgagatgcatggatttgtttctggcttctctattctgttctgttggtctttgtgtctgtttttatgtcagtaccatgctgttttggttactgtgggtttgtggtatattttgaaatcaggtaattggatacctccatccttgtttttttgctcaagattcctttgactattctgggtcttttgtggttccatacaactttaggattgctttttctattttttgaatgaatgccattggtgttttgataaagattgcattgaaattatatatcaccttggataatatggacattttaataatattaagtcttccaatctataaatatgtaatatctttttatttgtgtctgcttcattttttcattagcattttttcattactgttttatagtttttgttgtagtgatcctttacccccttgattgactttattcttagggggatatttttggctattataaatggggtaactttcttgatttcttttttacatagtttgctattgccttagaaaaaatgcttctagattttctgtgtttattttgtaccctgcaactttactgatttcacttactagttctaacagttttgtggtggtatttttagtattttctacacatataattatgtcatctgcaaacagggacaatttaagttcctttttaaaatttttttaaactatactttaagttctgggatacatatgcagaacgtgcagatttgtaacataggtatacatgtaccatggtgggttgctgcacccatcaacctgtcatctacattaggtgcttctcctaatgctatcccttccctagcccccgagcccccgacagaccctggtgtgtggtgttcccctccctgtgtccatgtgttctcattgttcaactcccacttatttgtgagaacatgtggtgtttggttttcttttcttgtgttagtttgctgagaatgatggtttccagcttcatccatgtccctgcaaagggcatgaactcatccttttttatgtctgcatagtattccatggtgtatatgtgccacattttctttatcaggtctatcattgatgggcatttgggttggttctaagtctttgctattgtgaacagtgtctcaataaacatatgtgtgcatgtgtctttatagtagaatgatttataatcttttgggtatatatctagtaatgggattgctgggtcaaatggtatttttggttccagatccttgaggaatcgccacactgtcttccacaatggttgaagtaatttacagtcccaccaatagtgtaaaagtgttcctatttctccacatcctttctagcatctgttgtttcctgacctttaatgatcaccattctaactggcatgagatggtatcttattgtggttttgatttgcatttctctgatgaccagtgataatgagctttttttcatatgtttgttgacagcataaaggtcttcttttgagaagtgtctgttcatatccttcgcccacttttttgatagaattgtttgttttattcttgtaaatttgtttaagatctttatagattatggagattagccctttgccagatggatagattgcaaaaatgtttacccattctgtaggttgcctgttcactctgttgatagtttcttttgctgtgtagaagctctttaattagatcccatttgtcaattttggcttttgttgccattgcttttggtgttttagtcatgaaatctttgcccatgcctatgtcctgaatggtattgcctagggtttcttctagggtttttatggttttaggtcttatgtttaagtctgtactccatcttgagttaattttttataaggtgtgagggaagggtccagtttcagttttctgcatatggttagccagttttcccaacaccatttattaaatagggaacccttaacacagacaaatggaaaatcattccatgctcatggataggaagaatcaatattgtgaaaatggccaaactgcccaaagtaatttatagaatcatgctatccccatcaagctaccattgactttcttcacggaattagaaaaaactactttaaatttcatgtggcaccaaaaaagagcccgcatagccaagacaatcctaagcaaaaagaacaaagctggaggcatcatgccacttgacttcaaactatactacaagtttacagtaagtaaaacagcatggcactggtaccaaaacagatatatagaccaatggaacagaacagaggcctcagaaataacatgacacatctacaaccatatgaacttcctttttttttttttttccaatttgaatgtcatttatttctttctctggccaaattgctgtggctaagactcccaatagtatgttaaccaaaagtggtgaaagtgggcacctttgtcttgttccagatcttagaggaaaaactataaacttttccctattcagtatgttattagctgtgggtttatcatataaggcccttatgttttgaagtatggtatttctatgcctaattcattgagaatttttattatgaggggatgttgaattttgatgtttgatttttctgaatgtattgtaacacatgtatgattcttctgtccttgattttgttaatgtgatttataaagtttatttctttgtgtatgatgaaccatcctttcatccctgggatgaatcccacttaatcgtggagtatattctttataatatattgtcgattctggtttgccagtattttgttgaggatttttgcatttatgtttattagtgatactggcctgtagtttgttttgttgttgtgttcttgtctggttttggtatcagggtagtgatgaccttgtagaatgagtttgaaaatattccctccttttaaagtttttgcgtgagtttgagaagaattggtattagttcttttttttaaatgtttgttagaattcaaacctgaagccattaggtcctgggcttgtctttgataggagagtctttcagactgccccaatcttgttatttgttattaattggctcagatcttccattacttcatgatttgatcttggtagcagttaggcaagagaaaggttgtatttgtccaggaatttacccatttcttctaaattttccaattcgttggtatatagttgttcataagtatctattataattatgtgtattggttatagtaccttctttttcatctctgattttatttagttgagtttttactctttgtttttagtctagctaaaattgtatctgttcgtattttcaaaaaataacactgttcatcggtctcttatacgtttttatttctatctcatttatttctgctctgatatttgttatttcttcccttctactaattttgggcgtactttgttctttttcctttgtcttgagctataacattaggttgtttatttgaaacctttcttcttttttgatgtagaattatgttgctctaaaattttctcatagaactatttttgctgtatctcataggttttggtatgttgtgtttccattttcattggtctcaaagaatttttacactaaaaataattcttcattgattcattcatgttgtcaaatgtctacgtattagagtttctaacattccttttgtcatttattcctggttttattctactgtcgtgagaaaatataatggatatgattttagctttttaaaaaaattgttaagacttgttctgtgacctaaagtatggtctatactggagaatgttccatgtgctgttaagaagaatgtatgttttatagctgatggattgaatattctgtaaatgtctgttaagtcaatttggaaaacagcacagtttaactgcagtgtttctttgttgattttctacctgaatgatctttacattgctgaaaatggggagttgacatctcctactattattatattgcaaccaatctctccctttaggtctatgtgtatttgctgtatatatttgggtgctctggtgtaggatgcatacatgtttacaattgctatattttcttgctgtatggatgcctttattattatataatggcttaagtttgatattgttgtcattcctctcttaaattttatctgaaacacatatagctacttacactctttttttagtttcagtttgtgtggaatatctttttgtgtcacttcagtttctatctttgtgcatctttaaaggtgaagtagatttcttgcaggcatcatttatttgcacctttttaaaaaatgttatatagtcactctgtcttttaattggacaatttaattcatttatattcaaagttattgttgataggtaagggtttattactgatatatttttactcattttctgttgttctttttttgatccttactatctttgtggttaaatgattatctttattagcacatcttgattctgtattatttttaatgcatctattataagtttttgctctgtggttatcatgaagcttacaaaaaaattatatagttataacaggtcattttaagctgataccatcttaactttaattgcaaagagaagaaactgaaacgcaatctacagttcaaacaccatccctccacacttttactttttgatgtttcaatttacataattttatattatatatctcttaaacaattatggtagctattataattaataatttttgttttagtcttcatactaatgatagtagtggtttacaggccacaattacagtattggtgtattcttaatttgtatgcttttaccacagagttttatactttcagatgttgttttgatacatgttagaatgttttcctttcaaatggaaggactccttttagcatttattcaaagacttgtctgttagttatgtatttccttagcttttgtttttctggtaaaatcattccccttcatgtttgaaggatagcttttctgggtataatattctttgttgaaaggtttttttgtgtgtgtgttttgttctagcacttctaaaatattatcccagtctttcttggaaggtagggtttctgctgaaaaatctgctggaagctctattggggctctgttgtatttggtatacttcttttctcttgctgctttcagtattctttgtcttcaatttttaataatttaattatgatgtgccttggtgaattcctctttggattgaatttaattgttgacttctgagctttctatacctggatgttgttgttattctccatatttggaaagttttcagccattattgtcttaaataatctttctaggctgtttttttcttttgtctccttcagtaatagaaaggtttattccctttatggtgtttcataatgcttgtaggcctttttcactctttcttggtctttcttttcctcttctcattggataaatttgtgtgttctgtcttcaagctcactgattctcttctcttttggtcaagtctgctgttgaagatttctggtgaggtttttaattcatttattgtatctataatataaaatttctattttttattgcttttgtcaaatttctgcttttattcctaggttgtttttcttaattttctatacatattttcttgtgattctctgcatttctttgagtattattctgaattctttgttagatatgttatagatctttaattcttctggctccattactggagctttgttaattcttttggtgaagtcatgttttcctgattttcccttgtgtcttcatattcattcctgtgcatttgctgaaatagccacctcttccatctattgcagttgttctttggtggttttagacttttaccaattgttaccagagtttaatcatgggcccgtttgttgcttcgaattctagggagaccttatagtgagcatcagaactaaaatatggcaccagaacttactcactgcccttctgctgtttcccatgctgaggatgacttattgcagtctgaagaaaacttaagcacacatcagaatttaattggtaaccttttaggttttgcaagttaggggattcttgacacaaatacttaggctttgtgaggaacccagccagggttttgggccttcacatatactaggctccctttagcaccaagataccaggcagcattctcagcatggcttcccaactgataggaaaacagagcagataccaagattttcatgcttgtcactgcaatcagtgtccccagtcttctttccaatttaccccacatcattgagccctgttggccctcccattgcttcctgtggaatgaaatcagtttggccccccatgaagattcccagactggtgaggagattaaacatccacctttatttcttcccaagaaactgtgagtctaaggaaattctctgagagtggtgttatgcctgcttgggagacgtgggcgtttaccagctgtggcttctgtcatttttgtggctcagggtatttttgtgcttcttttccaagttcttgtgaactcaaggtggcattcttgcctttgaatactttctaggtgtacttttgttgaggggagtaatgctgagggatcttctatcctgctctcttgctgatgtcactcctcttaattttcttttaagtattgttgaatacaaagtcttgttgcctactgatgtggtttgtctctgtgtccttacccaaatctcatgttcttgtaatccccaatgttggagattgggcctggtggcaggtgattggatcataggggaggtttctcatgaatggtttagcaatatctctcgatgctgttttcatgatagtgagtgggcgaattgtgagatctggttgtttaaaagtgtgtagcaccttccccctcctcttcctccttctgtgaccatgtaagatgtgcctgcttcctcttcaccttccaccattattgtaagtttcctgaggcctccccagaagcagaaaccactatacttcctgtacagcctgtagaaccctgagccaattaaacttttctttataaattacccagtctcagataattttttatagcaatgaaaaaacagactaatacatacctttaatttttctaattaaaggactaatactaatacctttcattagacctttaatgaattatagactaattctaattatagactaattctaatacatttaatttttctccatagaattattactaattgttattactttgctatagaatatccagataaagtgtttaatttcctttaatttttttttgttttttttgagacggagtcttgctctgtctccaggctggagtgcagtggtgtgatctcagctcactgcaacctccacctcccaggttcaagcgatcctcctgcctaaacctcccaagtagctgggactacaggcatgcatcgccacgcccagctaatttttgtatttttagtagagagggggtttcaccatgttagccaggatggtcttgttctcttgacctcatgatctgcctgcttcggcctcccaaagtgctgggattacagatgtgagccaccgcacccagccagtgctaaatttaatacattgaaggagagattcatttctgacagaacatggaacttaaaatgaatatgagtcagcctttcttactacatattgtagattgatctcttagtgttttgatcgacagctagtatctcagtcgtaccatagatcagttctcatttctgatgccactagtgtcacaaaaattgatttgccattactctgttacctctgatctttgaagtggtagggtattaaacttttctattggtgagaaacataattttggcacagttatgtttcaaatatatgttattgattgcaaagagaatgaatctttacacaatgctaaacaaacaaatacacataccaggtagatagtgactcagtgatatcagcattttacatactaaattattgcttgtagtctcagaaaatagtatttaatccctaaagtatacctttaaaattagaaaagatagtatggcaaatttagtaacttttaataagggctcaatataatctgttgctttagaattccatcactgtgcagaaaattgaccttattttgtgcatgtttcatttttcaaattgattttctgtattttacctctgtaattactacatatgtttcgaattttgtcttcagtcatttcagctaattgaatgtaaaatttatatgatggttatattgaaaatgatttaaaattattggttggtgaaattgctgttatattggtattgatatacaagcaataattaccttactttgtagagtaattacaaggatgatactcctctacttatagttgtgggagtttgattcatattatattttttatttgttgcgaattttattttcaggtttatgcatttattctgtgtgatttttggcatcctggaaacctgtgcccactatgatattttttaaataccttaaaaaattcttcactacataatctgcaagactgaagttctagtgtctttgatttattcttcagttgtttgcaatgtggttggaatttatggccccaaaccataatgtggaaatgagaaacaacactggaatctacattcaagcttgggccctttgctcttttctcagaggcttatccaagcacacagcgagtttattatcccttttcatcttgatgggacagcttaaattgactaattcccagatgcgtacaaatataagtaaggggaaaatgttacttaaatacttcgatttattttttttttgtggttaaaataaaaacaactgctgctatcaagagaagctaggtatatgtttctttaacttttgtgtgcataagaatcacctggagagatggttcgacacagatttctaagtataacagtcagagattttgattccgtacattgagcagttgggtgctttagaattttccttttggattagctacaagttgctgatgctacctgtacaaggaccatataatgagtagccctgtgatggatgataagcaatcagaggtatcttcctaatgtttaaaactttgaggaaaatgggtacattcattaagtaggcacacaaaatatcttccacatatttggatgttaatgataaagagaacttctagggtgcaaatctggtggtaactatgctgaacatatattttttcacagacattttacattagaataatcctgtgagattcttaattaccaaaactcattggacttcaaatggaagttgcatttattaatgattagttatcaagaaaattatgtgaattactgattgttttatagagaagattgttttaaaaagcatgtttgatgtatacattaaattttttgctaaatgtccttggggttgtggggtattgtaaatcaaatttacattaagtggatgattaaaattaaaagctgatttttaatctgttttctaataattcatcacaaatttaactaattaaaagaaaacttgctttcaatttgtaccagttgataactttttattgatgtactaaatcttgtaaattggttataactatttgtgaataaaatctcataacatatcagaaaaatggactgtgggttccaataacagtggattatccagttgcaaattagcgttttaatgagaactaccagaaaaactggttaatattttttaaataaaaataaattttacaacacaatgaccatggtagggagcacaggagaggcccagatgctggatttatcttgcaggtaattgtcaatttgcacgtgaaaattaccaggctaagaagccggaagaagttttagcagtcttcaaatactatgatgttcagagtataccaagtaggagcttaactacccaagctttcaattgataccactaaagtgttacatcttggaattgagattgtaatgggaagacttgtaagatggctcccagtgacccacattttttgtcattccctccctttgagtatgagaggacctatggatgtgatgggatattataactgtgactagattcaattttgtgaccaagatgaagagattctgcagatgtattaaggtcccaaatcagctggattttgagttaattagaaaggagattatcttaggtgcacctgatttaataaactcttcaaggagtgactgagacattgcttgtgagagagacgctcttactggccttgaagtagtaagctgccatatcataatagggccctgtggcgaggcactgtgagtggcctttagactttgtgagcagctgtcaactgacagccaacaagaaaacagggacttcattcctacacctgaaaggattgaatttgtcaccaatcgtgtgagctcaaaagataattctaaactccagaaaggagcaaggcctggccaacaccttgattttggttttgtgagcccctgagctgatggcattgataaactgcccaaatgccttacccatagaaactgtgggaaccttaaatgggaaaatgaaaggttgcgattattctgtatagttcctttcatttctaaacattatgttttcaagttgtgttagtattatattctgaattgagtttgttagaattgattccatatgaggaatatgttgtttattcatcaagaaggaatttatatacttaggaaaaggcctagaaatatgttcaccaaactctcaaaaattgatattatagttacattacatacctatgttagagtataggataaagaggcgatggttgggagatagagaagggaatgctaacattttgtttatgcacttctatactttagattttttgtatagaaggagcattgtttactctttactgtttttacacctgaatatcaactttaagacagcaatacaacacatcagggacaaaattgtttccatatatagtcttaggttgtctattaccaactatggcctaatctagacttgatgacacattaggaaatctatcttgtattcaacgcaaagatagaacccttcatatttccactcctattccatccctacccctccgtcagtgccccccaactattctcatggttatcaaattttagtatctggatgttcatcctcaacttgttatttgcttcattatgcttaattagaatctcattacagttggttgggtcaactaaaatttttctctcataagagacaggatcaactcccaaattccagtactattttgaataggagtggtgggagtgggcatccttttctggctctggttctcaaagggaatgcttccagcttttgcccattcaatatgatgttgactatggttttgccataggtggttcttattatttcgattcatatcttttcactcagttctcccttaggagtatttgggttatccattatcttggaatataattctatatcattttcctatctgaccttcgtatattaccacttgtgctaacaatttctctctggggttactttttattatattttattttttaaaatctttcattttaggtttaggggtatatgtacatgtttgttatataggtaaattgtgtgttatggagggttggtaatacagattatttaatcacccaggtaataagcatagtaccccatttgtagttttttgatccccaccttcctcccaccctccctgctcaactaggccctagtgtctatctttcccttctttgagtccatatgtacttaatgtttatctcccatttataagtgagaacctgtggtatttggttttctcttctgtgttagtttgcttaggataatggcctctagttccatccatgttgctgcaaaggacttgatctccttcttttttatggctacatagaattccatggtatatatatgtatctatatacctcattttatttatccagtctaccgtttatgggcatttaggttgattacatgtatttactattgtgaatagtgctgagatgaatatacgagtgtatgtgtttttatggtagaacaattattttgggggagtatatactcaacaatgggattgctaggttaaatggttgttctattttaagttctttgataaattgccaaactgatttcaagaatggctgaactaatttatattatgaccaactgtgtatatagtatagtgtaaggaaggggcccagtttcactcttctgcctgtggctagccagttatcccagcatcatttattgaatagaaagtcctttctccattgcttctttttttttcttttcaatttgtaaagaagagatggttataggtgtgcagctttatttctgggttctctatcctgttgcattggtctgtgtgtctgttttgttccagtaccatgctgttttggttactgtagccttgtagtatagtttgaagttgggttatgtgttgcctgctgcttttttctttttgcttaggatagctttggcaatttgatgtcttttttggttccatatgacttttaaaatactttttaaaaaaaattctgtgaagattgtccactggtagtttgctaggaatagcattgaatctataaattgctataaggtgttatggctttttttttttttgaggcggagtctcactctgttgcccaagtgcagtggcatgatctcggctgactgcaacccctgcctcctgggttcaaccagttatcctatctcaccctcccaagtagctgggactacatgtgccaccaccatgactgcctaatttttatagttttagtagagagggggtttcaccatattcatcaggctggtctcgaactcctgacctcaggtgatccacccgcctcggcctcccaaggtatgaccattttaacaatattgattctccctatctatgagcatggaatgcttttccttttgcttgcatcatctctgatttctttgagcagggttttgtaacgcttgtagaaatctttcacctccctggttagctgtattcctgtgtttttgtggttgttttgtggttattgtgaatgggattatgttcttgatttggcactcagtttggacattgctggtgtatagaaatgttactgagttttatacattgattttgtgtcctgaaattttgctaaagtgttttttaatcaaatttaggagctattgagcaggaattatggatttctcaaggtatgaaatcatatagttgtgaagagagatggctttacctcctcttttcttgtttggatgcctttatttctttctcttgcctgagtgcccttgctaagacgcttccatcttttgcccattcaatatgatgttgactatggttttctcatagatggctcttattattttgatgtatgttgcttcaatgcccagtttgttgagggtttttaacatgaaggaattttgaattttcttgaaaaccgtttccgtgtctattgagatgaacatgtgttttttgttttagttttgtttatgtgatgaatcacatttattaatttgcctatgttgaaccaaccttgcattcaagggtaaagcccacttgatcagggtggattagctttttgatgtgctgttatttggtttgctagtattttattgaggacttttgtgtctatgttcatcaaggttattggcctgaagtcttctctttttgttgtgtctcttccagcatttcatgttaagatgatgctagcctcttggaatgaattaggttagaattccttctcctcagttttttggaacaatttctgtaggaatggtaccagctgtggttcatatatctggtagaattcagttgtgagtcaatctggtccaggactttttctgcttgttaggctttttactactcatttatttttgatatttattattgatctcttcagggtttcagtttcttcctggttcaatcttgagaatatatttttcaatggaatattatatatttcttatatcttttttagtttgcatctatagaagtattcataatagtctctgagggtttttttgtgtgtgtgtgtgtatttctatggggtcagtgataatgtcccctatgtcatttctgattgtgtttatttggatcttctctgtttttttctttattcatatagctagtagtctagcaatcttatttattccacaaaaacaaacttttcgttatgtgaccttttgtattttttttctcaatttcattcaattcagatctgattttttaaaatttcttttcttttgctagtttttgggttggtttgctgttgtttttccagttcctcaagctgttaggttaggttgtcaatttgaggtctttctaactttgtgatgtagctttcttcttaatgctgctttagctgtggccctgagattctggtatgttttgtctttgttctcactgttttcaaagaaattcttgatttctgccttaatttcattgtttacccaaatgtcatttaggaacaggttgtttaattttcatgtaattgtatggttttgagtgatcttcatggctatttttatagcgctgtggtctgagagtgtggttggtatgatttcagcttttttgaatttgctgagaattgtttcatggctgattgtgtgtttgattttacagtacatttcatgtgcagatgagaagaatgtatattctgttgtttttggggtgaagagttctgtagattatctgttaggtccatttggtcaagtgttgtattcagttcctggatatttttgttagttttctcccttgatgatctaatattggcagtggggtgttgaagtctctgactgttattgtgtggttatctaagtcttttgtaggtctctaaaaacttgttttatgaatccgtatactcctgtgttgggtgcatatatatttaggatagttaggtcttcttgttgaattgaattatatgcaattatgtaatgtgcttgtctttttgatcattcttggtctaatgtttgttttgtcttaaattagaatagcaacttctgatatttttaattttacatttacttggtagatttttcttcatttctttactttgagcctctaggtctccttgcctgtgagataggtctctttaagacagtactgtatagttgggtgtttattttttatccaacttgctgccactttatgccttttaattggggcatttacccagtttgcattcaagattaatgttgataagtgggtatttgattctgtcatcatgttgttagcttagtattatgcagactggattgtgtaagtgctttatggtgtgagtggactatgtacttagttgtgtttttgtggtagccagtaacagtgttttatttccctatttaggactttcttaaagacctcatgtaaggcaggtctagtgctactgaattctcttagtacttgcttgtctgaaaagaattttatttctccttcatttatgaggcttagtgtggctggatctgaaatttttggttggaatttcttttctttaagaatgctgaatatgagtcccccatcttttctggtttgaagggtttctgctgaaagtttcattgttagcctgacggggtttcctttgtaggtgacctgccccttctctctagctgcctttattttttctttcattatgaccctggaaaatctgataagtatgtaccttggggatggttgtcttgcatagtatcgtgcaggggttctctgtattttttgaacatgaatattggcctctctggggacatgagagaaatttttgtggactgtatcctcaaatatgttttccaggttgcttgctctccctctctctttctgccatgtcagtgtgttatagatttggtttcttcacataatctcacatttctctgaggttttgttcattcttttttatttgtttatatgtctgattgagttaattttgagaactagtctttgagctctcagattgtttccccagcttggtctgttctgctgtttatactttgtgattatattatggaattattgtattgtttttcaattctatcagattcgtttgtatctatcttaaaacggccatttcttcattcagctcctgtatctttttattgtatttcctggattctttggcttgggttttgactttctccaggattttgatgatcttcattcctgtgtatattttgtattctatgtctgtcatttcagcctggtgcagaaccattgctggggatctagtatgggcatttggaggtaagaagacactggctttttgtgttaccaaagtttttatgctgtttgtttctcatctttctgggctgatgttctttaatctttgaagttgctgtcctttgaacgaagccttttgcttttatcttctttgaagccctttggtgtttgattgtggtatagggtgcctttagtcttctggctttgattatggaagattccagggggccgggaagccccagctgtgtcttctggccccttgaggttatgaccctgacggctagaagtgctgaagcgttcctcataagctggccccaaaactttaaggagaatgctggctgaagcgcttcgtagggttgttggcagtggtatcagtgctcacctgtgcttgccagtcactgtggccttgcagtggagtgcttttgtgtcagtggggtggtgcactagtatgggtgaggtgctgacaggggcgggcacaccggtgtacactgtgctcacttgcgccagagaagaagcggcacagcaggggtgggctgctggtggacacgaggttctggaatctgtgcacgcagttgcacccaccgctgtgcggtgggctgcccacacatcagcgagggcgcagtgctggcaggggtgggcaaggcagcagagtgtgctcatgacagcagcggtggggcagtggggtgcacactcacatgcctgctgtaggaagagggttggcgaggtcggtcggcccttgcgcacacactgccaaagcagtgaggggaggctgcagtgagaagaggctgtgggtgggctggttttgtcggcagagtccggtctgctggacttctctgatggttaggcatggactgccagcgaagaagctatcatgaaggcatcagggaagcaccctggttaggcatttgatgctgcattgcaagcgggagtgatcaggctggggctccaggagaagctggcagcaggagaggctgctcagatagaaatggctctgaaacatgggcaggaccgccctgttcccaatccgactgtcacccaaatgcaaaagccacttagaggagcttggtgagccttgggggatagacatccctggccatgctccactgcagccattcccccgacaaaccttctgagctatgcccaggttggagtcctggcactggcatctctcaaagcagctctcgctgccagatcaagtggtttgtgggggtcctgaggtctcctgcaactaggattacgggggtctgtggcaagggtgggccactcatcacctgttaaactcaccccttccccagtattcactgggggccaggagtgggtcacagggctcaacagccccatgcaggatttccagattcctcccgcttcagtccagtatcttcatcctccttccgtccactctcagtgccttccctctgaaggtctgcttgaagtgtgctagtattcccagtgcctggctgtgtcaggtcagccatcttggctctttcctctgtttttttttgttgttgttgttttgtttttcttactttttgtctttctgataattctcctttttttttttttttgagacggagtcttgtgctttctcccaggctggagtgcagtggcgcaatctcagctcactgcaagctccgcctcctgggttcacgccattctcctgcctcagcctccccagtagctgggactacaggcgcccaccaccactcccagctaatttttgtatttttagtagagacggggtttcactgtgttagccaggatggtctcgatctcctgacctcatgatctgcccgcctcagcctcccaaagtgctgggatttataggcgtgagccaccgcgcccagcctctgataattctctttatctacctcacccaaaatatacttgtagtgaaaatatacaatttcccttattgacatatacattgaatagaaaaataaaacaaaacatgcatattatcttctgaaaaatatgtatccattttctatagctagataaatatttaatggaagaaacaatgcctcatatgtgtgggcagaagttaaaaaaggaaaaataaaagatatggtacttcttttctaataccagagtttgaagtgcttccattcttattctactttgttttggttagcaacttaaaatatgaattattgccatcagaataaatctgatttagtgaatttattttaagttgtatttgaaaaaatagcaatatttgttaaaaatttaacaataaaaaattaaattagttacttcctggtctttgataagtcctaaagcatgacatcattgttgaacttagaaaatctctgtgctgatgtaggtacttccaatcattaggtgggattctgccactatatcaataagatgtgtctggtacactgatatttgttgacgtcactgattcctagttctctcaggagtctctctgtggctttccaacattcccctgggagaaaacgcagctatcagtggacaacttttcccattttattctgagtttttaaactattttctgtccacttgaaaatttatgttactcatcacattgccttctcctactttaattatactatgtttggaagaaatgaatgaaaacttaaatttaaatcacataataatatctataggaagcatcttactgtcacatattttgaatgttcctagttgcaattagttttcacccccaatatttagcttctcagtgtcatgattttgtactctcctgcctaaaaagaaaatctacgttctttctttaaattttaaaattatatttatcctaatattttacataactaagaacacatgactgtaatcacttgaaaggtattgtgaaaatacgaatgttttaggtacaaactcagaggtgccagacaaaatgaaattaatcagtatctacttgtgttgagcagttaccagcacagatggtaggaaattagcttattctttgtctcaatatattaatgatgcaaaattacatgtatttcactttggacaaatatctgacagactagcaagcaatattttagaaacatgaccccttgattgataatggagcgaagcatttaataccttaagtctaacttaaatttaatacattctatatcattttagatgcctccatctaagctttttaaattgggacattacacaaagtgatcaaaatagagtttcagtgactttgtggagtatagaattagaattttgaattcttcattcataaacacaggggtgatttttaaagattatgtttggcacttaagtcttgatggttgtctcctgagtagcctctaatctctattcagaagatttatattgtactagattgtgttttgtttgtttgtttgtttttgacagagtctcgctctgtcacccaggctggagtgcagtggtgcgatctcagctcactgcaacttccgcctccctggttcaagtgattctcctgcctcagcctccccagtaggtgggactacagtcatgcgccaccatgcctggctaacttctgaatttttagtagagacgaggtttcaccatattggccaggctggtcttgaactcctgacctcatgatccgcctgcctcagcctccaaaaatgctgggattacaggcatgagccactgcgcctggcctagattgttaaatcaacaaatcaagccaacaggatgatttgaggatttatataaaacaactagaaaactgaacaacaataataatttttattttttaatgaaatatatcaataattgaatgttaaaaggtgtgatgtaaatgatcattgttgaaaagaaagagtgatcggtcaagggatttttgttgttgttgctatgggcttaagaaatgaagaatgtggaattaatgagaagttgagaattttctgaggggctgggtaagaaactacaagagatatagagaaatacagtatgtgaacagaaagtagtctttttttcctctggaagattaacatatagacaaaagaaaaccaatgaggaacccacaatcttgggaagaacagataacagagtatccacagggagctgtatcccagaaagggcacgagatgagaaatgcagacttcattttttcatctataaaatgagaatttttcattctctttagtctgactaatatgactttcatggagatattttaaaattgtaaatgatatgaaatataataatagataatactggcattatattagttataaagtaaaatcatatccacatataacttttcacatccttgtatgagtaggaatgggcagtactagctttggagccataatgtcctcattatttgaaaaaactgtcaaaatccactctcttcctaaataattggttaatatgatattaaaatgtaaaatgaagactactctttgaaaattacacgataagtacaccactttagtacttacttaaaattttgttctttatagattactagggtgttattcataagtgcaacattgagaaatttacatattttcccaagaatttgggaagaatataatgaatgtttttttcttgcttaaaaacactcacaaattaatttgcaacttattattgactataaagttattcgtatcgctctggcaaatgagtaaacccagttcatatctgaaatataaaacttttctttctaaataaagaacaagttttactatttttgaaacatcctatttatggcttatcactacaagttaatatgcacattgtggagtttatttttgttattcgtagggagaattttaggtattgtagccaccttctaaagatctgaaatgagttttagttgtgacatgtattgtctttaggtcctatttatattttcagtttaggtggaaatagttctttttgacacgtccactgcttactttttgttattatcctttgcttacttttatgcctccaaaagtttgttgctttataattgatttgcctttaattcactgtaatcttcattgcaatagaatgaagtaagcttgtcaggtgtgattcctagctctttttatatttaggaattcaatggcagtagcaacttgagaactgtcttttcagaaatctcagtacattcgcaactgcaatctcatacactcagtaaatatatgaacggaaacattttttacatttccatttgttttgttactattccaattgctatttattgtcagggtttattccgtcctgtaaactgccactcccaaccataggagaaggagccacgtttgcaaaatgcaattaaagtagccacttcctccagctacctggacacagtaattgtccacaccttgtccaagctggaccaataagattctctcagaatttggaattgggtctcatagatatcagtctctgcggtcacttgaattaagttattgtaaactcaagatgaaagagttcaaccttttttattagcttgtgtgtataggaaaaaaaacagagaatgccaaaccagcgagaagataagaggatgggggatagggagagggaatgatgcaaaaggtgaggggataagagagagggagagagaatgatgaagagggtgaggggctgagggagatgcagagagaatgatgaagagggtgaggggctgagggagatggtgagagaatggtggaacgggtgaggggatgaggcagagagaatgatgaagagggcgagggaatgagggagaaagagaatgagagagaaggagaagagaagagggagagggacggggatgaaggagagtgagatggaagatggtagaaaggatgagagaggaggaggaggagagacaagaagaggggagaggaaagagaggaagaaggaagcctggaaaaaggagaagaaaggaacaggagagatgaagggagggaatagagagaaataacagggagtagggaggaagaaagataaacgagagagagagattgactgtagtaaagagatgtatgaagagcagaatcaagacattaggtgtcttcagagaaacagaaagaagctgaagcttcatgcctctttttattccttgatgctagtgccagaatcttgacttcactctctgctcttggtttccttgagttccacccatattgtttatttattttgcatcactcattcaaccctaagaaacttaaccaagatataaattaaatcaaagcttactaataccataatttaaaaatcaaatggattgtttaggtttttgaacatttaaagccatttaatatcttgttttgctatagaaatcattaattctttagcatatttgaaaaatacatacatggccaggcacagtggctcacacttgtaatcccagcactttgggaggccaaggcaggtgaatcatgaggtcaagagatcaagaccatcctggccaacatggtgaaaccccatttctactaaaaatgcaaaaaattagctgggtgtggtgacgcacacctgaggcaggaggatcgcttgaacttgggaggcagaggttgcaatgagccaagactgcgccactgcactccagcctggccacagagtaagactccacacacacacacacacacacacacacacacacacacacacacacacacacaaaagcaagaaaaatgcacatgtttaaatgattttttgttttttttgtttttttcattttattatactttaagttttagagtacatgtgcacaacgtacaggtttgttacatatgtatacatgtgccatgttggtgtgctgcacccattaactcgttatctagcattaggtatatctcctaatgctatccctcccccctacccccaccccacaacagtccccagagtgtgatgttccccttcctgtgtccatgtgttctcattgttcagttcccacctatgagtgagaacatgtggtgtttggttttttgtccttgcaatagtttgctgagaatgatggtttccattttcatccatgtctctacaaaggacatgaactcatcattttttatggctgcatagtattccatggtatatatgtgccacattttcttactagtctgtcgttgttgcacatttaggttggttccaagtctttgctattgtgaatagtgccgcaataaacatatgtgtgcatgtgtctttatagcagcatgatttataatcctttgggtatatacccagtaatgggatggctgggtcaaatggtatttctagttctagatccctgaggaatcgccacaccgacttccacaatggttgaactagtttacagtctcaccaacagtgtaaaagtgttcctatttctccacatcctctccagcacctgttgtttcctgactttttaatgatcaccattctaactggtgtgagatggtatctcattgtggttttgatttgcatttttctgatggccagtgatgatgagcattttttcatgtgttttttggctgcataaatgtcttcttttgagaagtgtctgttcatatctttcgcccactttttgatggggttgtttgtttttttcttgtaaatttgtttgagttcattgtagattctggatatcagccctttgtcagatgagtaggttgtgaaaattttctcccattttgtaggttgcctgttcactctgatggtagtttcttttgctgtgcagaagctctttagtttaattagatcccatttgtcaattttggcttttattgccattgcttttggtgttttagacatgaagtccttgcccatgcctatgtcctgaatggtattgcctaggttttcttctagggtttttatggttttaagtctaacatttaagtctttaatccatcttgaattaatttttgtataaggtgtaaggaagagatccagtttcagctttctacatatggctagccagttttcccagcaccatttattaaatagggaatcctttccccattgcttgtttttgtgaggtttgtcaaagatccgacagttgtagatatgcggcattatttctgacgcctctgttctgctccattggtctatatctctgttttcgtaccagtaccatgctgttttggttactgtagccttgtagtatagtttgaagtcaggtagcgtgatgcctccagctttgttcttttggcttaggattgacttggcgatgcgggctcttttttggttccatatgaactttaaattagttttttccaattctgtgaagaaagtcattggtagcttgatggggatggcattgaatctataaattaccttgggcagtatggccattttcacagtattgattcttcctacccatgagcatggaatgttcttccatttctttgtgtcctcttgtatttccttgagcagtggtttgtagttctccttgaagaggtccttcacatcccttgtaagttggattcctaagtattttattctctttgaaacaattgtgaatgggaattcactcatgatttggctctctgtttgtctgttattggtgtataagaatgcttgtgatttttgtatattgattttgtatcctgagactttgctgaagttgcttatcagcttgaggagattttgggctgagacattggggttttctagatatacaatcatgtcatctgcaaacagggacaatttgactttctcttttcctaattgaataccctttatttccttctcctgcctgattgccctggccagaacttccaacactatgttgaataggagtggtgagagagggcatccctgtcttgtgcccgttttcaaagggaatgcttccagtttttgcccattcagtatgatattggctgtggatttgtcatagatagctcttattattttgagatacatcccatcaatacctaatttattgagagtttttagcatgaagggttgttgaattttgtcaaaggccttttctgcatctattgagataatcatgtggtttttgttctttggttctgtttatatgctggattacatttattgatttgcgtatgttgaaccagccttgcatcccagggatgaagcccacttgatcatggtgaataagctttttgatgtgctgctggattcggtttgccagtattttattgaggatttttgcatcgatgttcatcaaggatattggtctaaaattctctttattgattgtgtctctgcccagctttggtatcaggatgatgctggcctcataaaatgagttagggaggattctctctttttctattgattggagtagtttcagaaggaatggtaccagctcttctttttatctctggtagaattcggctgtgaatccatctggtcctgggctttttttggttggtaagctattgattattgccacaatttcagatcctgttattggtctattcagagattcacttcttagtcttgggaggatgtatgtgtcgaggaatttatccatttcttctagattttctagtttatttttaatggaggtgtttatagtattctctgacggtagtttgtatttctgtgggatcagtggtgatatcccctttatcattttttattgcgtctatctgattcttctctcttttcttctttattagtcttgctagcggtctatcaattttgttgatctgttcaaaaaaccagctcctggattcattaattttttggagggctttttgtgtctctatttccttcagttctgctctgatcttagttatttcttgccttctcctagcttctgaatgtgtttgctcttgcttttctagttcttttaattgtgatgttagggtgtcaatttgggatctttcctgctttctcttgtgggcatttagtgctataaatttccctctacacactgctttgaatgtgtcctggagattctggtgtgttgtgtctttgttctcattggtttcaaagaacatctttatttctgccttcatttcattatttacccagttgtcattcaggagcaggtcgttcagattctatgtagttgagcggttttgagtgagtttcttaatcttgagttctaattagattgcactgtggtctgagagactgttataatttctgttcttttacatttgctgaggagtgctttacttccaactatgtggccagttttggagtaggtgttgtgtagtgctgaaaagaatgtatattctgttgatttggggtggagagttctgtagatgtctattaggtccacttggtgcagagctgagttcaattcctgggtatccttgttaactttctgtctcgtttatctgtctaatgttgacagtggggtgttaaagtctccgattattattgtgtgggagtataagtctctttgtaggtcactaaggacttgctttatgaatctgggtgctcctgtattgggtatatgtatatatttaggatagttagctcttcttgttgaattgatccctttaccattatgtgatggccttctttgtctcttttgatctttgttggtttaaagtctgttttatgagagactaggattgcaacccctgcctttttttgttttccatttgcttggtagatcttcctccatccttttattttgagcctatgtgtgtctctgcccgtgagatgggcttcctgaatacagcacactgatgggtcttgactctttatccagtttgccagtctgtgtcttttaattggagcatttagcccatttagatttaaagttaatgttgttatgtatgaatttgatcctgtcattatgatgttagctggttattttgctcgttagttgatgcagtttcttcctagccttgatggtctttacaatttggcatgtttttgcagtggctggtaccagttgttcctttccatgtttagtgcttctttcaggagctcttttaggtcaggcctggtggtgacaaaatctctcagcatttgcttgtctgtaaagtattttatttctccttcacttatgaagcttagtttggctggatatgagattctgggttgaaaattcttttctttaagaatgttgaatattggtccccactctcttctggcttgtagagtttctgccgagagatcagctgttagtctgatgggcttccctttgtgggtaacccgacctttctctctggctgcccttaacattttttccttcatttcaactttggtgaatctgacagttatgtgtcttggagttgctcttctcgaggagtatctttgtggcattctctgtatttcctgaatctgaatgttggcctgccttgctagattggggaagttctcctggataatatcctgcagagtgttttccaacttggttgcatttctccccgtcactttcaggtacaccaatcagacatagatttggtcttttcacatagtcccatatttcttggaggctttgttcatttcttttcttttttctctaaacttcccttctcgcttcatttcatttatttcgtcttccatcactgataccctttcttccagttcattgcatcggctcctgaggcgtctgcattcgtcacgtagctctcgtgccttggttttcagatccatcaggtcctttaaggacttctctgcgttggttattctagttatccatttgtctaatttttttttcaaagcttttaacttctttgccattggtttgaatttcctcctgtagctcggagtagtttgatcgtctgaagccttcttctctcagcttgtcaaactcattctccatccagctttgttccgttgctggtgaggagctgcattcctttggaggaggagaggcactctgatttttagagtttccagtttttctgctctgtttttttcccatctttgtggttttatctacctttggtctttgatgatggtgacatactgatgggtttttggtgtggatgtcctttctgtttgttagttttccttctaacagacaggaccctcagctgcaggtctgttggagtttgctagaggtccactccagaccctgattgcctaggtaacagcagcggtggctgcagaacagcagatatgggtgaaccacagatgctgctgcctgatcgttcctctggaagttttggctcagaggagtacccagccgtgtaagttgtcagtccgcccctactggggggtgcctcccagttaggctactcgggggtcatggacccacttgaggaggcagtctgcccattctcagatctcaagctgcatgctgggagaactactactttcttccaagctcagttggaaatgcagaaatcacccgtcttctgcgtcactcacgctgggtgctgtagactggagctgttcctatttggccatcttggctcctccccccatgtttaaatgtttatcaaaaaataaataaagtttacctctgatctcaccatctggaagtagctttcactaatgttttagtacattttcttttactcttctgtgcatgccagtacatacacacacacacagacacataacacattcattctttatggacgctaatcaacagtatgtacagttttacattgtgttatttttatgtaacaaaatgaagtttcgaaggcatggttttattcagtattatcccacttaattaaccgttgttctatttataatcattctggatttttaatttacacagtgttaattgtagcttcattagtgctatgattttttatttcttcatttagtcaacaaatctttattaattactcactctgtaccaaacattttgacacaactaaccaggaagatgtgtgtcttgaggagattacagctttacagtgagaaagactagtaagcaatactttcattcaattcaggtcactcaattctttgagggaaagggggtaagcaactacttcctagggggtaactgggtcttgaactgagtctcaatatatgaataaatgagaggaggatacatgtgaagtagcaggaaataaattagaaaggcaggcaggactcagatcatggggagggagagagagaaggggagtgaaggcttacttgccattatataaggaatgggtatcactgaacattgcaaatgtgcatggtgttggggggaggggagtaagaacatagtagatttgcattttttaaatgattatataacagtagaagatttatttctcaggcataaaacttaaagtgggaaagttacttgaagtgagaaatctactggaagagtccacacaggaaatgagatctaatattacactactagaggagagagattaacttatggctatattgagaagatagtttatgatatttgacaactagttggctgtcagaaggtgaagggtaaggagagactcaaattgctctcagtcttctggcttgctattattttatgaggtgtagaatataagaggaggggcaagttcagtagaaagtgtggatttgggtgtgtttggcttgtgttccctgttgatcatccaggtagaggtgaccagttgtcagctagtgctgccatcacagaatatcacagactgggtggtataaacaacagaaatttattttctccattttaggatctggaagtctgagattagggtgccagcatgggcaggttctggtcagagtctttttcctgacttgcagtggtcactttttctctgtgttctcacatgcaggagagagtgcaagttatcattctacctttctcttcttataaggtaacagtcctgttggattagggccccactcttatgacctcatttaaccttaattatctcctacaaaccctagctccaaatacattcaaaatgtttagagcttcaacctatgaatgaatttgggagagtagggatatttcagtccataacagctagacatcagtcttgaacttagtgacacctaagaattggaagtatagttgggtatgcctcatcatgagaatggataggtacacccaatcgagcatccggagaaggaatggaaaagggtcaagaactgaagcatttatgttgttctcaggagaagagaagatagcaaaaaagactgaaaaggtagggtgaaggagctggaggacaagcaggaagcaggatgcctctgcatgtaaggaagcagataattttatctagagtggaagattcaaaagtattaaatgatatgtagaatatcatattctttttacctatctaaacaactattttacctatctaaacaagtcagatcccaatcttttgctcttgacagcatatggtattgggaatattcactcattcctcacctcttccttgttcctagtttctttttagctattccatctgccttgtttatcactgttctgtgttacattgcttgtagtgaacaatgtcagtaacgtaacattggactacttaacaatatagaaacattgctttgtgtctgcttttccatattcagtagattgatatttttaatgtttgatcatttttaaaaaatgatccctgactagagatagcatgagattagcagggcaaactgtcgaatggacaacatatacctaattaatgaaaatatgttatagatgagtcacacttcagacattaatccataatgggtctctatttggagttgtttgaatgacatgtgagatatataatccaaaagaaataagcttagaactgtttaagcatgacctttcctaggagaaataaaaaataagttaaaaagttattttcagaaggaaatatattaaagtcattcctagagttaagaaaagaatgttaggaaaatatttacaaaataaattgtataatatctataaatatcatgggggataaataaataggaactgggaatatatctccaggtattttcacagaacagcttaatgacaaagacatttcctaaggcttaaatgtagcattattttgaattgtaaaaagacaacaaattaaacagtatttgttgtaaaaatgtatctcatatattattacatattgcacatcaagaatatttttaaataaagtgaatattatatactcgcttttttggtaaatattgcctaagtaaaacatacaattttggcttttgctctcaaaaacaagccttgatgtgcacacagttagagctgcgactgtagagcactattgccaaaggaggatggtaaacttttcagtaatgctgaacctactagcgtgtgagggcatttagcatactgatagtgatatgaactaaaggaaatgttgacactgtcctaaataatattctttttatttttaaagttacttccttgaaggcaaaatcataacctgcataagctcatagtacattaaggcttattattttgcctttgctatattgctaagaaaataaatttggttatcctgataaatttattcttcacaaggccatgaatattattttttcccaatagcttataattttattatagcttgcaagttgattgttttcttttgttattggcttcagtatttccccaagcataaaattttagataagtattccacttgggggattattgtgccatcctcttctttctacttaaagatgcactttttaaaacggcaatgtatttgtccttctcttcttccaaatctcaaaaatactcagtgaattctaataaataatagattaagttttctgtgattattttagccagttcattagggaattggggtcttgcagaagtatataaattttttaattgtttaacttgactcacatttttattagaatttgtttatattttaatcaaggcttttcattctgctgcattttgtggggcataattatgttttcataaggacatatatgatacaacatatgaattaataactaaacaggagacttagacttacttccaaatcctttttgaggataaaaaaataatgggaaagagcatcacttctagctgtagaacagcaagcaaaaaaactagaaagtttgcagattcacaacttttcatggagtcatcagagaactaaggtcgtagggcaaccagctaacctgaaacttaggaggagacatgagcacttgttttcctggagcagatactgccagatagcagtaagaatttagctgaatttttaagtcgaattggtaaagccagttgtgcactagaaagataatatagcaaccctattgactgcagatatgaggggaatttgcactgcagtcttttctccatagacttcaatgtatactcaatatctataatatttatagatattatacaatttattttgtaaatcaaaaaaaaaaaaaaaagatcgtctacagccctctgaaagcatctcttctgatacaggcatagcataagaagtacaggaatcactccgagaaaggcaggaatcatcacctggatccttctccccttccccctacagaagaaaagccttaaactgctaagtgtaggacagctattgtctgaaaaacagtgtaaaaggaagacctaaagttgagagtggagcagatactgagaaaagaaatggctatccatgtattacccatcctcaacacaagagaatactagaggaatttgaagcctgtgatgccaggtaactttggtaacaacaaatcccaaacctagcttaactcctgagtagaatgattcaaaccgcagatctagcagaaggacagtcattctcatttaaagacataaacactatttactcattctttaatgtcctacgcaagatatttagttttaaacaaaatgtacaagacgtgtacaatggcaagaaaaaaatgggcacactgccaaaataaaaagaattttataaaagcaaagatatgacttacataataaaactgtgagacagaaaagttttaattactgtcattaatattttaaagactcaaatggaaaaagtgaacaatatacacatcacataggtaattttagcaggcagctggaaagcataagaaagagtcagatggaaatactagaactgaaaaacatagcaacaaaagtgaagaatgcatttgataggctcatcaatatggttggtacacctgaggacagaattattatacttgaaaacgggtaaattgagagctgaggtagaatagtgtatttgcaatcttctgggaagtagtcttaaatatgtgtacttgtaatcccagatggagaaacagagaacaggaccaaagaaatatttaaggaaataatggcaaataattctctgaaattaatgacaaagaaattaaggaggatttaatgagaaaaaaatcaatgagagacaccaaaacaaattgaagaagctcagagaacgatacacacataaacacatgtataaaaaggaacccatattcaaattgctaaacaccgaagttaaaaagaaaatttggaagacatcccaagaaaaagacatattatgtacagtggacttgttatcagaaacaaggcaagtcagaagacaaaagggtgacatcttgaaagtgatgaaagaaaacaactctcaactccgaattttataaccactgaaagttatcatgatgaaggagaaatgaagatgttgtttgacatataaaaatggggagaatttattgtcagcagagcttctatataagaaatattaaaggaggttctttagggatatggaatgtaataccagagttaaacttggttattgatatggtttggttctgtgtccccaccgaaatctcacatcaaattgtaattgccacatgtcaggggagggacctggttggcagttattggatcatgggtgcagatttcccccttgctgttctcatgatggtgagtgagttctcatgacatctggcttttaaaatttgtagcactcccaccttcacttgccctctctcctgctcttctgtggaaagatgtaccttgtttccccttcaccttctgccatgattataagtttcctgaggcctcctagtcatgcttcctgtcaagcctgtggaactgtgtgtcaattaaccctcttttcttcataaattacccagtctcagttagttctttacagcagtgtgaaaacagactagtatagctatacagaaagaagtgaagggcgctgaaaataaaatgaatgaaggtaaaaataaaacatgtttctcatatttttagttgctctagaagataactgaccacttattaaaaagtaatagcaatgcgatatttatttatcttacatgtaaaaataaaatatgtgacaaaatactacagatgttgtgtaggagaagtattgggatatagtgttacaacattcttataatacatattaaacaatataacatttgggagttgactaaagatatgtaacttaaactagggtaagtattagacacattttgaaaaattatgtattgtaagtgaataccagaggtaatatggtatcataaaatatatttaatcaaaaaaagagaagaagaggaaaaaaataaacaacatatggaacaagtagagaacagacagaaagatggtagatttttaatttaacagtgttaataattacattaaatgaaaatagtctaaacacattaatttaaaaactgaatgacagattgggtaacaagagcaagatccaaatatatactgtgtacaagaaacccacttaatgtgtatggatatatatagaaaagtaaaagaatagagaaagacagattatggaagcatcaaccaaaaaaactagaattgctatattaatatcattagactttaaataacatatattaacaaggttaaacatgaacattaaataatgacaaagaaatcaattttccaagaagacaccttcagtcccaaaaaactatttaaatatatatgtacttaacaacataaattcaaaatatataaggtgaaaatgaatagacttgaaaggataaatagataaatccataattatattggaaggctgtaacagtcctttctcactaattaataaaacaaccaaataggaaatgagtaagtataaagaagacctgagcaacacaataagcacgatcagccaatttgatctaatttatatttatataacagtctaagcaacaatgcagctaaagcaactcttcaaggaaaactttatagatttgatgcttatataatatcagaacagaaaaaaactaaaattcatgatctaatctaccatcctaagatactataaaagtaagtgcaaattaaatccaggacaagcagaaggaaaaactaataaatatagaagcagcaatcaaataaattggaaacagactaatcaagagaatgaatgaaattaaaagctggtatttgaaaaaaggcattaaaatataataaacctatttttgaaagatatacaacacgaactttcactaaaaatataggttatgtgagtagtcctgtttgtatttaaaaatcacttaatgaagaagcctgtaggctcagatagattaactagtgaagtctattaaccttttaagaaaaaaataatataaattctacccagtcacttcccgaaaggagaagtagcactttcgatttatctaatactgaaaccagccacagacatcaccaagaaaagaaattgccaaccaacacaccaatacctctcatgaatatagatacaagaatcttcaataaaattttaagaaaaatcatctagtagcatattaaaaggatattatattatgagaaaattgtatttatccagaaaatccaaaattgatttaacattagaaaatcaatgtaattaatcatattaataaagaagaaaattcatatgatgatctcataaatgcagaaaaagcatttgacaaaattcaacatctattcctgttaaacttctcaaaatactaaaaaataggaagataattcgttaaccttaaataagacacttattatagaaataactggcatcatatttattagtggaaagctcagtgcttttccactaagatcagaaacaaggtatatgaacctacatttcctttttttttttttttttttttacattgtccttgtggcatgcaaccttactaaaatcacgtatttgttttaggatttgttttatagattgttggggattttctacatagaaaccattactgtatgtaaatagatattgggtgcgaaagatacagtcacagaacaaacctataccattattattaattaattttcttaaaaaggtgcagaaaattcaatagagaaatgtattttcaatgaattgtgcagaaagcaattagagatctatatctaaaaaatgaacatagacccatgattcacaccttatataaaggttaaatcaaaatgtattataagtctgaatgtaaagcaacatgtaaaacttttgaagaaatacaatatttgtaacttggagttcaacaaattcttagatatgataccaaagtcatcatccataaaagaaaatataaatatatttaactttaagaatataaatttttgctcttgagaagacattattaagacaatgggaagcaaaccacagactgggagaacatattttcaagtcaattaattgacaaaggatttatattcagaatatataaagaactcatacaactcaataataattaaaaactatctaattaaaacaaatgaataaaaaattaacaggtacttcaccaaaaaaagacatatgaatggcaaataagcacatgaaaatatgctcaacctcattatctgttaggaaatggaaatttaaaacaaaatgagataccactacacacctattattataactttataaaaactgaaaggggccgagcgtggtggcttacgcctgtaatcccagcactttgggatgctgaggcggttggatcatgaggtcaggagttggagaccagcctggccaatatagtgaaaccccatctctactaaaaatacaaaaaattagccaggcatggtggcaggtgcctgtaatcccagctactcgggaggctgaggcaagagaatctcttgaacccggggggtggaggttgcagtgagctgagattgtgccattgcactccagctctggcgacagagcaggactccatctcaaaaaaacaagcaaacaaacaaacaaaaaaaaccctgagtgctggggagaacctggagtgactggagccctcagacattgctggagagaatgcaaatggctgtcatgacactttgggaaacggtttggtagtttcttataaagttaaacttactttatgactcagccatcacactacaaggtatatactcaagagaaatgaaaacttaggttcacacaaaatcttatacgtaaatattatagcagctttatttataatcaccaaaaattggaagcaattaacatgcattcaaccagtgaatgcataaacaaatggtggtataaccttaaaatggacactcagccctaaaaactaaatgaactattgatatacacacacagggtaacaaactacatttttccatttatatgacatattggaaaatatcatgtaaataaaatgttttgaacaaaattagagtcagtaggtgcagttttggtttcacttggctttctatttattattatttgtataaatttaaggcatacaagagcaattttgttacatggatatattgcataatggtaaagtctgagcttttagtataaccatcacttgaatagtgtacgtcgtactcattaaataatttctcatccttcactaccctgtcacactcccatcctttcaagcttttccactgtccattatccacactctgtgtccatttattaatgtacacattgtttagttccgacttataagtgagaaaatgtggtatttggctttctgtttctgagttatttcacttaagataatggcttctagttcatctgtgttgatacaaaagatatgatttcagtctttttatggctgaatagtagtccattgaaaaaatgctcaacaccgctaatcacagataactgcaagttaaaaccgtcgtgaggtatcatcttacaccagtcaaaatggctattattaaaaagtcaaaaaataacagaagttagcaaagataaggaggaaatggaatacttatacacgtttagtgggaatgtaaattagtacaatgtctatggaaaaaaatatgatgctgtctcagagaactaaaaatagaactaccatttgatcaagaaacccactactgggtatattcacttgtatatttatcacagcactattcacaatagtaaagatatggagtcaactaagtgtttatcaatgaatgattggataaagtaaatgtgaagtatatatacacacacacatagacacacttggatttcttattgctcatctcgtctcttatggtatgtgcgtttgtatgtttgtgtgatgcttttattagtaagcattttacattaaaatattatttgccatataaatgaatgcgaataacctgtagcttaattatttttatgtggtataagtatttattagaaatcaaatggacgttgaaatttagtatcatatagaactttaaattaaccccggaagtaagttatatttcctccacactcgttaatgtcactgcaagttgtttctccatcacagaatataaatgggagtatatagcaaatgtctagcatgctatgtacaataaataatgtatgattaattagtcattttttaagtggaaaattattttaaagtagtttgaactatgatttaatttttaaatacacttaaacagtatgttagattagcaaaggcagaaatattttcatcactttgttatttattgatgcctagaccaatgtttggaacatagtagacctctgattaatatttgttgaattatttattgaatacatttggaataataatacatcataactaaatataacaaaaccatttttctaaggtatactttaggaaaatctagaataaatatgaattttggggttgtagcattgttatattatgaatatggattgaacactcattaataggagagagaggaataaagaataaataatctttgagatgaagatatttccatgtctaatattgtaggtaacaaaaatgatagacttatatcttttagaaagagttacctggctttctattatgtactgcttttctgatgatttcattgctttagtatttttaacttgtttctaataagagctgattggttatttctccccttagtatatataaatgtagctattctaaataatcatttattaacacaaattaaatttttatttcatttattgatacagtttgccagcgattagtgtccgagttaagaaatactgttatagcaacagcaatttccctagaggacttcttaaatcataaagtgagagtatttcaaattatatttgcttcacttaaatgtatctgttctgaaaatggcaacattgatcccatgatatacctgatatattctaattgcctagaacgtaaaccacaaattctgcattgcagatactatcacagtaaatgctgcttaacttatgcaaaatttatagaatgatgacaaaacaaaagcttctgagaggataagtgtttcaccacaagcggtttctgtatctgactccatttctaaactgtaaatcagccttaaattatcattgagtcctatgatagacactagtaatggtaagaaaatatgccattttaagctatattcttattgacctgtatgtttatatgagtgtgaatatgtgtgtacctgtgtgtacatgtttatgtatgcacaccttttttacacgttattttttaactaaaatattttttctttactttactttactttacaccatcatgcattgttactttgacctctacaacctaacaaatatctgccctctaatccaatgggaaggaacaaaatcctgtaagagtgtaggaaacctgaggatggtctacaaggttggctgcccattggaaacacttgtggaattttaaagagatatcgatatctttgttccacccaaggaattctgattaaaaatttattgtatgtacattggatatctgtatttaaaaaaaatctccccaagtgatcctaatatgcagtaaaatctgaaaatccttcctctagaaaacaaaaataaaagtgcctaataaacaatgattactgtgtattctgaaaccagaaacaaccattttcttaaccttttatggtttaaaaaagtatggtaggaaagttattttaaaaggaattaaaggtgattttatgtgacatatgtttatttttttaatgcaatcttcattataatggttttgaattaaggtataacctgtttttcttgtggagtgtatgcaatagaaaatcacccaacttaagagtcagaaaacatgagtgtgtgtggtggttctgccacttcttaaatatattgccttggctgggttctcctataagacttactttcttattgcccatggtagtacaattgttatagcatttcaaaaattaaatggtgtgtttataataaaggctatatataacaaacccaaagctaacatgggtttcccatactgaacaggcaaaagttgaaagcattccctctaaacactggaactagacaaggatgcctcctttcaccattcttactcaacatagcactggaagtcctagccagagcacttaggcaacagaaagaaataaaggtatccaaactgggaaagaggaagtcaaattgtacctttttgcacatgacatgatattagatacagaaaaacataaagactcaaccaagaaactcttggaactgataaatgaattcagtaaagttgtaggatacaaaatcaacatataaaaatcattatcattcatatatatcaacaatgaattagctggaaaagaagtcaagaaagtaatcttttttataaaagccacagcaaaaaattacatacctaagattacattttaccaaggaggtgaaagatctctacaattaaaagtataaaacactggtgaaagaggacataaaaatattgtaagatgactaggcacagtggctcatgcctgtaacctcagcactttgggaagctgatgcaggaagactgcttgagcctgggagttcaagacccacaacatagcaagggacaactctacaaattttttttaaaattagtcaggcctggtgtcatgcacctgtagtctcagccactgaggtggcaggattgcttgaacccgggaggttgatactgcagtgagccatatttgtgccacctcactacagcctgataataagaaaagaaagaaaaaatagtaagacaacccacgctcatggattgaaagaattaatattgttacaatgaccatactacccaaagcaatctcaggttcagtgcaatccctattaaaatttcaatgacatttttcacagaattagaaaaaatattaacatttgaattgaaccacaaaacactttgaatggccaatgccaagcaaaaataacaaagtcagagatatcacattacctgaattcaaaatatatgacaaagggataagtaaccaagcagcatgatattggtataaaaacagacacatagaccaatagaacagaatagaaaactcagatataaattcatgcatttatagccaactgaattacaagaaaggtgccaagaatgtgcgctggggaatgggtacccttttcaataaaagctaggaaaactggatatatgcatgcaagacaacgtaagtagactcctgccacttgtcaaatacaaatatcaactcaaaatgtattaaatatttaaatgtaaggcctgaaaatataaaatcactagaagaaaacataggagtaatgcttcaagacatgagtccaggcaaagattttatgggtaggactatgaaagcataggcatcaaaacaaaaatcagcaaaagggacattataagctaaaaaccttctgtacagcaaaggaaaaaaccgagtcaagacacaacctgcagaataggagaaaatatttgcaaattattagtccaagaagggattaatatccagaatatataaggaactcaaacaactcaatatttcccaaacaaatgattctattaaaaatggacaaaaaaatctgagtagacatttctcaatagaagacatacagatggccaataggcatatgaataaatgttcagcatcactcatcatcaaggaaatgcaaatcaaaaccacaatgaggtatcacctaacctcagttagaatagctattctcaaaaagacaaataataacaaaggctgctgaggatgcagagaaaaatgaagttttatactccattggtgggaacatcaattagtacagccattatggaaaacagtatggaagttcctcaaaaaaactaaaaatagaactaccatatgatccagtaatcccactaatggatatttatccaaatgaaaataaatcagtagatcaaagagttatctttacctccatgcttattgcagcactattcacaatagtcaagatatagaatcaacgtaagtactcctcaacagataaatggatcaagaaaaatgtggtatgtatacacaatggaatattattcagccattaaaagaaggaaatcaggtcgtctgcagctacatgagtgaacctggaagaccttatgttaaattaaatgaatcaggcacaaaaagataagtactgcatgttctcactcaagtggaagctaaaaaaacaaaaatgagtttatagaaatagagagtagaattacagttgttagaagctgggatgggtagcagggaggagaggagagggagaagttacctaatggatgcagaattacaactagatgggaggaaaaagttctagtgttctgtagcactgtagggtgaatatacctaacaataatttattgtatatgttaaaaatactagaagagaggattttaaatgcctcctacaaaaagaaatgagaaatatttgaggtgatggatatgctaattaccctaatttggtcattacacattgtatacatgtatagggatattgtatgctccatatatatgtacaattattatgtgtcaactaaaaacaaaagaaaaaagtgtctataattattcaggtataattttacactgttatctgtagcttactctggcctcttatgttgacaaactgtgttttttaagttcactttactgaatgacatatttactgttaactcatttcatgtagtttttattaaataattattcaatgcctactacatatctgtcagacacttgataagtgttgaatgcacagtgtcacgtgagacatggttcctgtctccagtgagttattgtccaatgcagaagaaagatacacacacacatgcacatgtgtattttggaggatagggtgaactaaaagtccaggattgcataagtaaaatgtgaaaatgctcaaatcaagaaggtcattgtgagttctttaaagcccaaaccaaatgtgttcaaatctaagtcatctttctgatgtatcttaggcattgaagttttggtgcactgagtagaatacatcgtgattatgaaatgttttcattgggacgtagtataaattaattgataatggtaaagactttgaaatcatattgtcttggttcaattttttcccctcaacacatcagctgtatgattatggataggtttttaacctttgggtttcactgtcctcatatgtaaagtaagcaaatagtgctaatacttcttggacttgttatgagaatgaataggtaatacctacaaaatgttttgagtgttgtccttacacatagggattagacaatatccactattattttaaagttactttaatgatattgcttatttgggaagcagattttttttgccttttctatatcagaatggttagttgaaaatattttacttttaaaataattattgaactgggaaaatgatttcatcagcaagatacagaaaaaagttggcaaaggtaaaaatacttttatttttcatcaaaatattaatatattatttttctgatttatggctcagacctattcattattattccttagatgctcgaatcctccatacaatgtggtacttttaaagagaacatctgtttttgtacaaagtgttgctatgaaacttcagtaggaaaacatagcaaacacatatacaaagtttagtactgcagctaaggcatgggattatattggtttggtttgttcattaaaaaaaggaaacaattattagctaaaccacacatttcagatgaataaggataagaaattcagggattatattgttctttggtaaaaaatctttgttttatagatttcagtgccttgaaggctcataggaaatgtagcttcttttatgtctaaatgtgttttgttatagaaattactcaagctatcttaaatgaagacctcaattgaagtttttagactatattattttgcttgtattccacaataactgtgttattacttccaatctttgattctgagaaatctggcctttattttttagagagagaaaatctcttgagagttttgagattagtgtagaaatatgcaattttttattccttctaaatttcacgcttttatattagaagatgttctgtgaggtttttttctggacagatattaagacagaatcaatcaaaaccaacgtaaacacactgttaaattcacacacaagaaaagaggtgtgtcatcaattaatttacataaattatctagctggctttgaaacctattgacatgtgagaagttcagagttccttcagcatagggcattctgttaagaatatacatgtttaaacagacaaaagaatttatatagataccatagacattttctgtaatgatatgaagtataatttgtatttactttcttcaaatatgggaatctctaatgtctttcaaaattaccatgatgttgaagacaatgtttatagtgatctcatatacaagtatagattttactgctctagtgatatcatttacaagtatagattttactgctctttcttctttgtttctgtgcaatctgttacaccaaccaaaaataagattgaaccgagatatgatttttagtaaacttggtgcttagtaaatttatttagatacttagtaaattaactaaaattaatttaggtgtttagtatatttattgaatgaaatctagcctaatatttataactggaatgttttataattgatttataaaaatcacaagtgatgttctttttatacagtatctatgtctttatcaagtcatagagattatatacttagtataaagagcaacatcaagattttgatggctggaaagaacactagaggaggacccctgaatatccattttcacttaacttatctgagtctgttaccttgagcataaaacggaaacgatgacattaccccagtaattatagttttgtgtttttccccagtcaccttagaaatatgtgctaagtacctcattatgtgctgctcataattttaaatactgtactgaggatttgctccctactttcaaagaaataccttatagtcagtgggggaaaaaaaactagcagacttttactacaaggtaatatgttatgacattataatttggttttatttgttggtcgcagcttaaatatcacctcttcagaggaatttcctgatcacccagtctaaagcagccttccagacaatatcataatcttttttaaagtgcacagcactatctaaattttctttcttatttgttcattatttttctgtctcccctcaaataaaatgtcagtcttatggctgcagatactatgttattcttttcacttctttaccctagtccttatcattatgcatatatatatatatatatatatatatattaggttttcattaatatttattgaataaatgaatgaaaggaaacttaaaaatacttgtgccatggcagcatagataaagagactttattaatttaaataattttttttctactatgttccagagacatactgtttgccccggggaatactttgttaatcttagtctggcgggaaggcattgatcagctttataattgcaaacaattgtaagtgctatggagaaatagtgaagggtggcatatgactatgttgaagaataaggtatttccctaatatgggagattagaagccttttgaggaagtttcacttgagctgaaatttgaactgtttgaactaaccaagtaaaagcaatgagaacatcatatgcaaaggccctgtgatgatgacagcagtagtctttgaagaaagtgaaagaaaaccagtatggattaactgtaatgggtgagcacttggtagagtgggagagatataactgaaatgctggacacagaacttgtaagtcactgtgctggtccatattagtagttgatatcggaaagcaaaatgtatacaggagaaacagtgtaaataaagcaaaagagtaaaaaaaagttagggatgcatacagtgtttgtcctttgacataactgggttactctgaaatatcaacattttcaaaatctcttctgtcaacactactataaggacttttatatatatatatatatatatatatatatatatatatatatacacacatgtatacataaaaacatgtattgcaaatagaaataaggtctctatttaaaaatctaacagttatttgctaatcacttatttttatacatataggcattagagaaaaaataaatattcatcaaagtgaattaaaaacaagtttacagtataatcagtagagaataggtcacattaaatacaaaatgtataattaagtcaaaatattcattgaatgtctgacttgcataggaagagacacaaggtctagtactattttcaaaaaatcagctgagacataaaacatacatgtgacaagcatcataacaaacatgtgacctacacaaatataaaaggaaatagctgagtaagagctaggcttggccaggtgcagtggcttatgcctataaccccagcacattaagaggcccaggttggtagacgggggcaaaacccagtctctacaaaaaattcaaaaattagctgggtgtggtggtggtggcatgtgcctgtagtcccagctactcacaaggctgaggcagaatatcacttgaacccagaaggcagaggttgcagtgagcagagatggcaccactgcactccagcctgggtgacagagttagactctgtctcaaaaaaataaaaaataaaaaataaaaaaatataagatttgggcttagtaaatatagaaggctttgtaggggatcaagtttgaattgcattttgagaaaagaagatgatgaatattaataaacacgtgaagtgaatgggagagaggctagtaatcaaaggcatgaagcccaagccatagaagtaagaactaatgaaatgtgtgaaattaacagatattaattttatggaaagataaagctcaagagtagaaaccttgattaaaaagatacctcgtcaattatctgaaggataagggaagaaagagcatttcagatggaggcactccctgtgtgaaagcttggatcattcagtgtcagtcatgtagcaagatgatgttagcttggagatgtagctatggtagaggctgaccactactaaaggagctaggtcattataggcctggtcatcttgctatagagctgtagtctggtgcattgaaaaagtactgagtgaaacagaagggagctaggacatgattacagagggctgggagggagatgatgaatataaaggaaaagggaagtgaggagagaaactagatgttagaggtatttagtcaattcagtaggatttaatgatttattgcagacagaatgaaggggaaggagaatgaaggataattcttatgtctgtttagctaattgaacacttaaggggaaccctgggccaacaaggtttttctttttttaatttttatttttttagaagagatagtgaattaaatgttatttgcatttaatcctaggtaattgagatacacaggatgagatatctagagggtagatagtcaggtccagccttggtgttacccatttggaagccatagcatcgtaatggattagattttagctgggcctaggaggatgaggtgtgttattggtcagtaccagggaaaaacagagggcttctgagctgcatggtgacatgtccatggagtaaggagaagacaggtatcactgaactcagcatgtgctggaataatatgtgataaggatgaatcatggatcagtaaggtgaggcaaatttatagatggaagtaacagaataagaggtgctacactttttaattgaagcaacttttagaaaaggaagatgaaattacacaatgaatgaactgcttaaggatgaataattgggtagacattggaagacaggactttatttcagtcaagtcatgtgaattgtggttactgtggttggaagatataggagaggtacataatagctgtcatataagagacaaagaataagagtaacatggaaatgtatgctcaaatgagacagatcaataattgtattcatgatttactgacacgaaatgctctttattgcctgtatcccaggtcttaccttgtttccagttagctgtgatttcaaagaagatactcctttgtgacccttgcttcagtcatctttccatttctttcttttctctttgtttctgctaacctgctgaggaggctgacagctctggacgcaagtgtttttgcttcaggagtagatgggagaaaagcatgtcctgtagttataatgctgctttttcctaggcagggagaagcagcccctaaattctagagaaaaatactgccttagttcaatgtagcagttctgatattcctgtgagtttaagaaaaaacaaacaaacccttcctccgctcaccaaacgaagcaataacaaaccaacaaaccagaaaccttaaagcagaggaaatccagattgtacttactcttcttctcactcacaaagaaaaggattcaccacatttttactgtcatggcattattgccgttaaagtctttttctttctctgtctagtaagtcttttttttcctgttcaatacagtttttttttgcttgttcattttttttccgatctagtggagagaacattgcaggattatgaataagaccctgagctggatgtcgtggctcatgcctgtaattccagtgttttgggaggatgaggcaggaggatcacttgagaccaggagttggagaccagcctgggcaaaatagtgagaccccatctctaccaaaaataaaaaaataaaaataaaaaaagaagaagatgggcatggtcatacatgcctgtagtcctagctacttgggaggctgaagcaggaggattgctgtagccaaagagtttgaggtttcagggagccctgatcatgccaccgagtacagtctagatgacagagcaagactttaaaaaattaaaattgaaaaaaggaccctgataaccatttgtagatacaaacacatttcaagttgggtctggtgggccgttttcctttagggttcaccacttgtggtgccatgttgcaaagacacagtgctatttatcatgtagctatcttacagatcttttgtctaatacctaacaaaccactcttttagtcctccaggaaaaagttctgggcactttaagccccatgccttgttcagaattatccttgctatatgctgtggtctaaactgtgattctccaaaattcatttcatgaagccccaaagcatagtagcttagaatgtaaccatatttggatataagactttaaagatgtgactgctttactatgagctcaacagggtggggccctaattcaatgcgactggtgttcttataagaggaaaagacactgtggagaaaagaaagaagaaaaggaagattaaaagccatctgaggatacaggaagaaggtggccttctgcaagccaatgagagaggcctgagaagaaaccaaacctgctgacacctggatcttgaccttctagcttccaaaactgtgacaaaatatatttctgttgtttaggccacttagtctgtgggtttttttttttatgtctgtcatagaaaacgtaatatacagtactttctggtgagtaagtttttattttccctgagtgaatttttagtagcacatatcttttctgtgctgaaaatgtgagacctctgatgatttgatgagcccttctcttaccctaacttgcttttacacttgtaatattataccaaaactaagtgctttctattcttattttcttgttagtgtgatgtttcacttagttgcattattcattttgctagaaattttgaatacatttgctaaagctggaatgaaaatctcaataaatgaataaataatgatttagtgacatctgccgtgtgcttgttcactcgttgatctttaagagtgaaattttccaaaagagactgatcattaggggtttctgtagatcttaagtatgatgctttttaaaaccttttatcagaaacacgcttctttgattaacatgaatataatatagtgatgtagttaagagtatatggtctggagttaatgtgctatggtttaaatcctggctcagcctcttggaagctgggtaacaatgagtgagataatcaattaaattagagcctcattttcctcatctgtagaacaagagtaataatagttgtgttcaactcatagtactgtgatgaagattgaataagttaataaatacaacagcacctggttcatcgtaaatgctccctacatttgggctattgttatttttctaaattctattgcttgcttgtctgaacatcatcttgggttaatattgttactactggaactttattgtgatattaacttaaagcagatttctcacctttggctctattgacatttggggctggataattctttgttgtgagtgctctcctgtgtatgtagcatgtttagcatctgtggagtttaacagcgtctataaagtctacctaccagaccccggtagcacactgcctcctcacccaagttgtgacaactgaaagtgtctctagatgtattcatccattttcacattgctataaagaaatgctagaggctgggtaatttataaagaaaagaggtttaattggctcatgattcagcaggctgttcagggagcatagtagcttctacttctaggaaggcctcaggaaagttttaaccatggcagaaggcgaagggggagcaaacacttcacatggctagagcagcaggaagagagagattggagagttgctacacaattttaaaaaactagatctcatgctaactcactatcacaagaacagcactaggggatggtgttaaaacattggacctccatgatccagtcacctcccacggggtttaggtgggggcccacctccaacactgggtattacaattctgtatgagacttggtggggactctgaacaaaaccatatcaccagacattgccaaatgtactctgggggtaaaactacccccagttgagaatccctaaaaaactttgattaacaaataaaatactgtttgggaaaatatatctaaaatctgcttcttacatgagctcgatttattttgactgatagtcttgggattttgtaaggtagcttttctttaaaaatattattaaaggaggtcatctacagtgtaactcataatttctctcactgtgtcataaggccagaatatcttgatatgtctaattctctaaattagaatgtatagccatgaaaaacataattgacttaaaaactgatcaaatatgttttcatgaaaacatctagtagctgaaataaattatacctgccacttattagagataactcagatgttatcacaaatggaattgtaattacttacttatatttctcatggtgctatagagatttgtctaaattagaattgggagtaggagggagaaatttaaatattcatgaaagtgtgatgtcatatttcatgattaaaggtatggaaagattaagtatatggataatttttaaagtaccatagaggtatttttctagagaaatgagacacatcacagtcaagtacatgtggatgtatattatctttataaattaagatattacgtggaacttactatggttcaagaactcagtaagaattttttaaaaaaataagtatgcttgcataaattccaaagtataatgacatcttgtctctgtcatccctttgtagtccatcaaaatgattaatgcctgtcagttgccattcattactcttttgctgactggaagttgcagtgcctcatctgatacactgatacactgatcaatgtggaataggctgaaagtacattttgcgggtctgtggaatttgtcttaatacttactctaaagtatttaaatacttaaatagttaatatttattttattttacaataaatactgttttataattatatgtgtgtgtatgtatatatgatatataatttaaagaatatatatcactatataatgatatataaagatatatgaatatatggatataatggtatatatactattcattgtgatatatatatataatggtatatatatatttcactgtgatatgaaatatatataaatatattttaaatattatatatatatatatatgtatcactacagtgttaaagtcaagaagcatgggaagcaaacagatccagaattcagggaatacaccacatataataaatgatatctagctctctttctccactaaaaaatacgattattgtagtttaatagcctaatgggattttccacatacttaatagttaccacatcatgttttcatgctaaggacaggttttctataatcctttactggcaaggtgacaagctggaaaagaatgggttgtctattactgattatgtagtctctaagaaatctttttcttttgttgacaatttgaatgccatgtcttacagtttttgtcagtgtgagaattttttaaattacttattttatttttattttgttggatgctttttctgtttgaccaataccagcaagtccttccaaaatcacaatatagctaaacatatcttcctttctcaattgtattaaatgtttattatattattaattgggtgaatttttgtattaatatgttatttaaaatacaccatttaaaattagattcaatatttatgtcagttttactttctttctctttgtcctgattgttttatatagtcaacattgaaactgagaatagagagaaagagaaacaagggattttaaaggataatagtaataagcctttgtataatttttttcatacatgactttttaaaatttcataatagtgaggtgatgtggatgtaccttctaacatcatcacattttgacagtgaggaaagtgagactatgcatgggaaaaagtgaggcttagtaagtgaagcaataaagtggaaatggtactttgtctagcccctctgaccccagaccctgtgctctcatgctacatcacagtgtctgtggaataaacttttatcacttttgttgttgagaaaatgaacttgaggtttcttattatgatgtataatttcccctgggaaaatcgttgatagcttgataaagacagccaagagttttggagaatgattaaataccactcttcactttttttttcttttaacaaggctttgaggatctcttcttctgatgctgaaaaacagcagccaactcaaggggggaataatatgaaaatataaatacatattttaacatatttaagtatcagatgttgtggagtactcaaagagtgtttttgcccggttttaacatatgcacatctgtatttttctttataaaacaaatgtagtgaaatagtttaatgctgaatattttattacctttttctacacactcaccatcttcaaaatcaatcaaccttcacttcaggcatactgtatgtggtcttatactagaaaatacataaatatattgtttaaaggattaaaagaaattaaccacatgccatttgtttcacgaaccaaagctgagtagtttatgtctgttttatagcgcatacacaatacttgacctccccctcccaggacttagaacaatatgaactctgaaatagaaagtcttctcggaaactttgggaacattgtgtcagacggagagatagtgctcagataagagccagtggtagttgtaactctcagtaataatatccatcatatcatctcgtggatcagtggttgtcttagtggaaatcagaagataatgccaaagagacattaaatgttcagaatgtcctgcactgtagagtataacttgttaaatttcacttctgtttaaatctcaattactggaagaagcaggtggtgataattatcttactccttcttttttttttttttttttttttgagacggagtctcgctctgtcgcccaggccggactgcggactgcagtggcgcaatctcggctccctgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccatcttactccttcttgaagtttaagctatttaacaattaattattaatcagggttagaatcaagttaaataatctacttcatttagatttttccttctaaaccgagtataaattcccattagtactactgttattaaatggaacaatgacattatgatctatagatactttcctttctagataaacatattgtaaattcactccagcatgtgagctatatgttctaagtaaacaatgtgattctcctatttagcaaaatatttcattcagtgtattgtcttatcctaactctgagctttccaatgtatatttagaaatgatattcctttgtgaaagactgtatttctcagtgtgcatacctgttagaaaaatcaaacatagggtgcaagaaaaagtggtgaatttttttttttacttgttcctgcagttatactcatactcctctgctcatgtaaacatttcagctccccaaattcaacctgactgcttgaaaatctttactaataatcattacctcttgaataaaatccagattcctaatccttcagactaacctccatgagagcagacactttgtggttgtgcttgtggctaatatcatcagtgcttgctattgtgcctgtcctacagtaggtaatcaggaaatatttgtgaaagaaaaaaatatcataaccaaggtactatgctatctgacttaagtgtactttcctgaggtcatcttacataactcatctccatacattctatgttttaatccaatgagactatttttcttgcaccttcaaatgaccccattatctccatgcatgaaacaccagttcaagtgtactctcttcctaaagtttttcttatcacctcatttagatttttttcttctcaaactgtcttagaattttgtgtttcttttactattttttttcatttttcattgaatcacagttactaaatgtatcctttttcaactccttgaggtgagtgagtataagagagaggagagtatcttaactcttctttcttcaacagtgctcagcataggaccctcaagtgtactggtgtccaatacatgttggtgtgctgtgttggtgttcaatatatgattgttgactgaatggacacttctttgttcactttactacagaattgacttttttttttttttttttttgagacggagtctcgctgtcttgcccaggctggagtgcagtggcacgatcttggctcactgcaagctccgcctcccgggttctcgccattcttctgcctcagcctccctagtagctgggactacaggcgcccgccaccatgcccggctaatttttttgtatttttagtagagagggggtttcaccatgttagccaggatggtcttgatctcctgacctcgtgatccacgaggccgcctcggtctcccaaagtgctgggatataggcatgagccaccgtgcctggccagaattgactattttttggttatcactttttcctttagataaatcttaaaaaacttcccacagctgatgtaatttgatagaaattcagttgaacttagttcttaaagatatctgacaaacaacttttgacttgaaatataataagaaagaacactgaacttggaggaagaatcttgagttccaaaactggatttctgtgaactggttgagtaaatttgacatcaaaatcaattcttcgcattaacatcgtatgcaaaagaatttaatatggtacatggcgatagctatacctcaataaagcctcctttcatccttttcctattattatttcccttcacttaacttttttttttctttttccttttccttcttgccctctcctttaaaaatcataaatttattgaatgacttttaacattttatgacctaaaacttttctggcctggattttatattaaatcagttcagcctgctttattagtttatttgatttcccatatacaaaaattgaaaaaaaaattctatttgctttttattgaaaaacaaaagactaactaaacaatagtgccttaagctcctatgatgaaatatatagagtatttttaaaaacatcattggttagcaatatctaggtatgttgctagcatctaccttccaaatccactttggaatggctttgttgcttagattttaaagaaacaaaatttaaagaaacttatagtttgaatctgggctgacagtgggtgaaaggccaggactgagcatcttttgtaaggtgagtcaatcttcttaattgtgaaatgccccttttatgcagatttttctttttctttcaagtgcatctgttctgtgttttaggtggtgtttaaacacttttaacagaatggatagattttcctattattttatctacaaataaacacctggttcttgatacttctctttctccttttatcaccttttgcctaaggaaatctaatttattcattttgcctgtattttatactcacaatattttcttttttgcttttaccttctgcatataacaaaacattattcttgcacagagctctttttttcttgcaaacacatttactcttaatattttatcttttgagtctatattatgctgatgggaagtttttcatataggattgtttcatttttatgatacaggttcacttctttctcttcattgccttgtttgtagttttttttccctgcagaatgttttgtatgctacctttctctttactttttccagaatactttctaaacaagcagattgtgaatttcaaataattcatttttatttttatgttatgaactgacattcttttcctctgctattattcagatgaggaagaaagataaaagtgataaaaggaacataaattctgccatagaagttaccgccaagtgaatacatattctagtatataggagttttactcatgaaatattttgcctttacttaagaaacctaagttaaataggaaaatgattattttcattttaaaaaaattaaggtataaattgtgtgtgcaagtatatgcacagtctccccaaattatatttttctgtgtaaatatttacaaaattgaatatccttcttttttaatgactcctatgcagacaggagggagggtacttcataattttggttcataacatcccttaaggaattcattctagtggccaaaagagcaacacctttgtaggagggaaacaggatcaatcaagttaacaaaattattgttataagtttcttcacaggaagctttatgaaataaaaattatattcataataaaataagaaattatgaattatgaactcatcttaaaatggtctttaaatgttctgtatgatgtcagtgggccacacaacttgttcagtgtctaattatgttgataaaataagatatgggactttttttttaggtgaaataatttccattgtaactttttgcatatgtatgacaaattattctctttacgcaaagttaattggaggtttgatcaagaatctaggctctgtctggttcaataaatcctacataattatttattcatattatttccctcataagtaggaatttttgtcctatcattgttattttgctatgttgcctgtgtagatacagctatcagtttgaagcagcagttctgtctatgagaagataaaataatatctttgatgggtttctccatgtcagggttccttcaccttcaggcatgttttccaacatgtagttcttttttttcttcttaattgaatcagtattgctcataaattacaattgagtgcagattgaaggaaatgcaatgtcttcttaggagagtgtgtcacctagtatttataatgtaatcacaatgttcatagaaatttaaacgtattctttcccctacaacatttacactttaacagagacaaaacaaatatataatcattaaaactgttaaaggtaagcaggtaattataagattgcactgaatttcagctataagaatgggagtgactaattggagaaagtatcctacagctataattttaggggagaaagccctgtggatagagaagagatgctgttctaggtaaataaaatggtctgagtagagccaaggaggttcactcttaaaagtataaggagctagtacagataaatttcaaaggcaagccagtatccagattcaaaaacatcttcttaaattatatggttttctcgccacagatttagattcattctcattagaaatattgcatttttaagtatggcttttagaggcttgtggcttaaccagagcaaaggcagtagggtatgatctaaaggtcattctgcaattttagcagagtataactgtctcctgggtcaagatttggctattctctcaagaaaaggaggttaaatgacatctaaatggtattgttaagtaaaccaataagaagttttatctttgtagttataattctgtgacaggcttttcttcatgtcagaattactgatccctcataaagacaaaagcttaggtaagaaaatgttttcatctgatttagttttattgcttagagctgtgcaatttttatatgcctatttaaaaagaaaaaaaggaaaaaactcagaaagttatttttttctgggtaaaagataattggaaagcatttcaaccaaaagtcaatataagtctgttgagtttgtcattctccagatatgccctcagtttatttttaaaaaatcttaagttgacaatgcattttatttggctataataatttaagtaatattagacatctagacttatcatattcatcatagaaaaattttggtagcatctttatatttttaatctaaagcaaaatattgatcagcctgtcctaggatgtagttaatacattagctgatcaatttaaatgccatgataacttcagactcatagatcaagtgctttttatagtactttggaaacccttgagtttttttattctttcttggacttgaattaattttcagtctttcttcttactgtacttaaagtttttgacagtagagccatcattaaatgaatgggagtttgacctaaacttatagctgatattgataacaactgcttaaattttagtgaaacagtgaaatgtgtcattgataaaaacatcatgacctaggttccctgagtatgttagtaactccaatttgttagagtttatatgtatcatggtgttccatgggtgatagagtgccaaaacaatacaaacatttacatatttatggacattttggaaacagtcaattacctacttgtaataaaatatttaatattagaaaaattgaagaataatataaattaatttattttagttttaggttgagtttctttgactcaagaatttctacttatgtttttcatttctcttactacctaaaactaaagaaaacattaagaaaaaggcaggaaaggaacctaattctttttttaaactttttatttttattttattttattttattttttgagatggagtcttgctctgtcgcccaggctggagtacagtggcgcaatcttggctcactgcaacttccgtctcctgggttcaagcgattctcctgcctcagcttcctgagtagctgggactacaggagtgtgccaccacacctggctaattttttgtatttttagtagagacggggtttcaccatgttagccaggatggtcttgatctactgaccttgttatctgcctgcctcggccccccaaagtggtgggcttataggtgcgagccaccacgcccggccctaaaccttttattttaaaacaattttagattggcaatatgagtataaccattcaaagaagcaaaaacaaaatgtactgtgagattcaaggcactgtcttattccctttttctcttctttttattcattaaatatttatgtagtactgactttaagtgctggggaaactaaggtgaatataatagccgttgccctggaaaatttcataatcgattgtggaatagagacacattaacagataacccaaatcaactgtattaaatgcaatagcggaacaaagagaagtaggatcacataatccagctctgcagcagaggtgagggtggagagcagcaacaaaagagagcaatggcaagggaattctttatatttttgcacatgtgaaatgtctgtatagaaatatttgactaagatttactcagcaattagaaattgttttttgtttgtgcctatgtaattgtatcattacgatttcagtatcatttagactttatggataatctacacactaaatgtttattagggaaggaaaagtacttttagaatatgcaacaattctggtgacactcaatacatttttgttaaatatattaatttatccgtttattcaactaatatttattgaacagctgcatagtgctagtcattgcacttgagtcccaggaagatattgttatggactgaatgtttatgaccttccaaaattctatgtaggctcctgcccccaatgttatagtatttggagataggacctttatgaaggtagttaatgttaaatgagattataagtgtgtggtcttgatctaataggagtggtgtgcttataagaagagacaccagagagctcatactctctctcaaccatgtgaggacataagaagttggctttctgtaagtcagaaagagagctcttaccagaacccaatcatactgccattctgatctcctccagactccagatctgtggcaaaacaaatttctgttgtaaaagccaccaagtctgtggtattttgttgtaacaacctgagctgattaaaacagccataaataataagtgtaatacataaataaggttaatataacaattgcattattaacataaagtgtaatacaggtagaatattataaggcaacgacttgtggaacacaggaaaagtgggaaagagatagggaataggaagtggtgtgatgaagggaatcttacaacattaagtaggaggtctgggtaggcctaattgaaaatatgacatttgagcaaacacatgaagtttgtcctgtggatatttgggaagttcgcattctaggcagtgagaacagccagggtcctggccctagggtggcatcatgtctgctgtgtttgaagagttgcaaggggccagtttggctggaggagagggatactggaaattaattagcaggcaataagtttggagatctaataggagtgaggtacctcagggccttttaagctattatagattttaggttttactttgagtgaagagaggaaccattgtagggttttaaggagaagggtaatgtagtgaagggatttgactgactactgtattatgaatagatgttaggaggggccagacaaaagcaataataccaattaaaaggctattatagtaatccaggcaagagaagatggtggttctgactagggtggaacagtagaggtgattagtgattaaattctgtattttgaaataaaaaccaagtgtatttactgatggttaagatttgaggtatgagacaaatataggaatcaaggatgactccaggatttggaacctaagcaactgaaaaactgcggttaccgcaaactgaatgaaggaaaatatttgtctccgttcgcctaacctgctgttattcatcactggtagaattcaggtggctttggttgtagaatataaacagaatattttgagaaaaatgaaaggaagataaaaataactagggaaaataaccatgttatggtatttaagttgcttttagctattttaatcttcatttctcttgaatgaaccttaaggtcttcaccatggctgcaaggagcgtgataaaattcaagtgataataatttacaatataaaggcttgatcagaaatagcatggacttcattttgtttttaaggctgtgcttcctgtatctacatataaatatttaattcctaccaaattgtatatgcaccattatgttaagctattctgtaaaatcttttgagaaaatgtgtgatgctatcttaacacaattaaattagtttcatccatttttcatctgcaaaacagcccatggaggtatttcaaaatgattaatttttcatacttattcacaaagcagttctactaatagttggatttttgtaatatatagttttaaaaatatttccagtatgttaaatacattatatttttcatagtgttttccttcttattagcattatgtaccagacaagatgcctgcgggaaagagatgacacactcaaaaagagtgactaaggaaggtttaataaaggtaatatttaccaaggtgtgggcacggttaagagaagtcagcaagggatggtgaagcttggggagctggtagggactgaatttttgtgtcctccaaaattcatatgttgaaatcctaatccctactgtgatggtatttggagatgggggttttggaaggtaattacttttagatgaaataataaaggtagggcccctgtagtgggattagtgttcttataacaagaggaagaaaaaccagagctcccttgctgccctccacctatatgagtgaacatttgcaaaccaggaagatggctgccactaggaattgaatttctagctccttgatcgtggattttccagcctccagaacttcggaaaataaatgttgtttaagccacccaggctatgctactttgttgtaatagcttgagctgactaagatagtgagtaggctcacaagaccaagattgctgtcttggtttttcaggtacctggagatagagttatatctttattttttatatttatttttatgtttttaagacagagtttcgctctgttgcccaggctggagtgcagtggcgtgatctcatctcgttgcaacctccacctcccagattcaaacgattctcctgccttagcctcctgagtagctgggactaagggcacatgccactatgcctggctaatttttgtgtttttaatagagacagagtttcaccatgttgttcaggctggtctcgaactcttgagtgcaagtgatttccccggcctagggctcccaaagtgctgggaccacaggcgtgagccaccgcacctaaggccagttatacctttaagtgtagctgtatctgtattagaagaccattgaaaagaagcagtaaacttgggtagaggaacaaatcctggaacagagcttgacctaatggggctcacacatgctgattctgcttgcatttttaattgactaaacacaagaaagtatattaggaaagggaacccaattaatatagttcctacaggtcagcctccagggggacacagcaagctatagagacctgaagagtagatttggagagacacacagaaaaatctagccgacgtgaaattattatttataaagggaaaattgatttacatcaagatcaacaaatatatcaagcattatgagtcaacacccctaattgtgctaagtagtcttcttagcttatatatataaagtttttattagaaaatatgttcaaacttacaaaaaagtggccaaataagaatattacaaagaatatccctatcccctttaaccagattcacctattgttagcattttactccatatactttattatatgctctgtgtctctttttatcttagtaatatattttatgttatttttctattataaaagcattgtcagttgaggcgttgggctgagtccttgactgcagctcagtaattgcaatgcgttggctgtaaataccaagtctagtgtggggatggtagctttccgccatgtgacctgacaggtaaaagcctttgtaattgcctgtagttaggcctcaaagatctcacacaggattttgggtcagagctggactcctcaatcctttgtcagaaattataattttattcagattaatttttattcatcattcttcctctgttttagctttaattctaaaaataaacatggaatgctcaacatcagtccttttttaaagttttttcactcctcccttggttggatgaagctcccaccaggtctgtcccccaacggaattacaatttgacatgagatttgaatggggacacagagccaaaccatatcaacatttctagcgtagttttgatacttctaattcaaagtgtttttaatgaccccaaatgtttcaggatgtttaattcaacatggaatttttttatttccattttttggctttatgtttgtttttaggagagttttcattaggagaaattgctttcgtcataattttagcagtcatttagcatcgatgtgatctgctttttctaacattatttatattgtaagtaggttcctcactaagagtatatgtgtacaatatccctgggcctttgtacgttcaaatctgctttttatagacttgatatatgaaacacagtttgactgaatgtatctttggctcatactttcattttttttaactttcttgaaaatatcactgtacttgtaccttgctttgtatgttgtttttcagagaagtttgatgaaattcaaattattttgcatttgtaagatattttctctctttgcctaacagtgctgaggatggtatcttcaaactctaatagttttgccagacatgtgccagagtttagtgttctgagtcaatagaaatgatgtgtcattcctatgggtggaatccagtcttactttattttgggaatgtttttcattatagatgtaataaatttttatgtgattctattttctcttggtaatattttccttttatctttatttctgatatgagttattctttttctatttctttctgaagtccattacattctcttatcttttcttcttatttgaccatttgtattagtctgttctcactctgctaaaaagaactacctgagactggataattgactcacagttctgcagcctctacaggaagcatggctgggaggcctctagaaacttacaatcatgtggaaggcaaaggggaagtaaatacctctcaccatgcaggaaacagagagagaaggaagtgggaagtgctacacactttgaaacagccagatctcatgagagctcactcactatcatgagaacagcaaggggaaaatctgctcccatgatctaatcacctcccaccaggtctgtctcccagcggaattacaattcgacatgagatttgaatggggacacagagccaaaccatatcaacatttctagtgtagttttgatacttctaattcagagtgtttttaatgaccccaaatgtttcaggatatttaattcaacatggaatgttttttttttcattttttggctttatgtttgttttaggagagttttcattaggaggaattgctttcgtcataattttaacagtcatttagcatcgatgtgatctgctttttctaacattatttatatagtgaacaggattcctaattcaagagtattcttttttgttattgttgctgttttcttttttcttatttatttctttattttttacagaagggtgttggggagaggaaagagttgatgtgtttttgtcaccctttttgtttctgcagcaaatatgtatttccttatttttcttcactgcctcatttcaatcccttatatatatcacattctcttaaggaagcagtggtcttagaaggctgccactttgatcctgcataccatcaagggtcttctgtatagccagtgttataaccaaacaaatgctgacccatgtttagtattttagcatttaatgatgcagtttgtcttttagggactgatttggtctatgtttcattgataacctctactgtcctcatgtttttcatgacatctcttatgccttctcttttgcaaattccatacccacagatttgtaatactaggtgacttggtagaaattctgctggaattttcttcttcccttttctaaaggtcatatttttcttggtctcctagttaaattgaagtcctgggttatgcttggattattttgctattattgattttataatttatttggaagggtgtggaggagattcagaatcaatggccccatcattattatccaacaccagaggttgccacttatctgtattttgaactagagcaatcaaaaattaatttaaagctattttgtttaaataatcatacaattttactctcataaatgatgaatattaaatgagaggtctagtttcaaaagcaagaggttttttgcagtaaaatatgaaaaataacaacttttatgggaaacagagcaacatggctgcacagaagcctccactgattttccttcctgcagggacaccaaatttaacaactatctacacaaaaaagcagcaccttcataagaaccaccagtcaggtaagccatgatagtacctgatattaacttcatgccattgaaagaggcacagaagagggtaggaaagaaagtcttgaattgtggacatcactctacccctatctgctggcagcagcccagtggcagggagaatctgtgtgcttgcaggatggagaggccagtgattataggacattgcattagaacccagcacttccctgtcacaacagaaagcaaaaacttgtagaacttagccgacactgatggaaggagcatgtacaccagccctagacagagaagaatcatccatcccagtggttggaacttgagtttggcaagcctcactactgtggtctaaggtgctcttgagtcctaaataagcatgaaaagcagtctaggcaacaagaactgcaattcctaggcaagttctagttctgttctgggccgagagcaagtggaactggggagcatgtgatctaatgagacactagccagggtggcctagggaatgcttgcaccactcctttcataactccaggcagcacagctcacagctctgacggcttatttcttctgcttaaggagaggagagggaagagtaaagagtactttgtcttggaacttggataccagctcagccagagtaggctacagcactgggcagagtcatgatggtcccattttaggccctagcacccagtgatatttctagacacaccatgggccagaagattacccactgcctataaaggaaggacccagtcctggtaggatccatcacttgctgaccaaagaaccgtgggaccctgaaaatcaccagtggtagccacgtaatacacccagtgggccttgggtaagactgagacatgctggcttcagatgtgatccagcaattcccagcagtggtgactatgaggaaagattccttctgcttgagaaatgcagagtgaagagtaaaggggactttgttttgcatcttaggtacccgctcagctgcactggggtgaaacaccaatcaggatcttgtagtcctcaattctaggctttggctcttggatggcatttctggatgtgccttgagccacaggggagcccactgccatgaagggtgagtcctaagcctggcattcaacacaagctgactgaagatcccttgggctttcagtgaacattgctggtagcctggcacaactctttgtgggtctgtggcagtggggaccacagggagagactactttgcttgttgaaaggacagggaagagtggaaggactttgtcttgtggtttgggtgccagctcagctgcagtagaatacagcaccacatagatttctatggtcctgactccagaccctggtttctggatggcatttctggacctactcagggcctggggaactctccatcctggagggaaggacacaagcctggctggctttgctgtctgctgattatagatcctttggaccttgagcaaacataggtggtaaccaggtagttgttacagtggagcttgactgagatccagtgctgtcctgacttcaagtctgacccaatacattgccagtggtggtacctgccacccctcacccagctccaggcagcttagcacagagaaagattccatttgcttggtagaaagtaatggaagagaacaagcatctctgcctggtaatccagagaattcttttggatcttatgcagtatcaccaacgcggtacctctgtgagtccacaagagccatagcattactgggtttggggtccccctaatgcagatatggctgcagtgaccaaaacttagatcataacacacaagtccattcaaaatcataggaagtcttccctaaaaggacaggtatgaacaagcccagactgtgaaggctacaattaattctgaattctgtaatgcccagacactgacaaatatccacaagaatcaagaccatccaggaaaacattaccttctcaaatgaactaagtaagtcaccagtgaccaatcccagagagatagaaatatgtgatttttcagacagagaatttaaaagagcttttttgaggaaacacaattcaagataacaaagagaaagaatttaaaatcctatgagataaatttaacaaggagattgaaataattaaaaagaatcaagtataaaatctggagttgaataatgtaattgacatgctgaagaattcatcagcgtctcttaatagaattgatcaaacagcagaaacaattagcttgaaggcaggctatttgaaaatacacaatcacagcagacgaaagaaaagaagaatagaaaagattgaagcacacctacaggatctagaaaatagcctcagaagggcaaatctaacagttattggcattaaagagaaagtagagagagagatagaagtagaaagagtttttaaaagcataataacggagaacttccaaaacatggaaaaagatatcagtattcaagtacaaaaaggttatagaacaccaagtagatttagccccaaaaagactacctcaagacatttaataatcaaactctcaaaggtgaaagataaaaaaaaggatcctaaatgcagcaagagaaaagagacaaataacatacaatggagttccaagtctggcagcagacttttcagtggaaaccctacaggccaggagagaatgaaatgacatatttaaagtgctgaaggaaaaagcattttgccctagaatggtatatccagcaaaaaatattcttccaacatgaaggagaaataaaaatttttcagtaaaaacaaaagttgagggatttcatcaacaccagacctgtcctacaagaaatacgaaagggagttatttaatttgaaagaaaaggatgttaatgatcaagaaaaaaatcatctgaagatataaaactcactggtaatagtaagcacacagaaaaacacagactattgtaacactttaattgtggtatatcaacaatgtatatcttaagtagaaagataaaaaataaatcggtcaaaagtaataacaacaactttccaagacatagccagtataataagatataaagagaaataataaaaagttaaaaaggttggagacaaagttaaagtacagtgtttttattagttattgcttttcctgtttgtttgcttgtttttgttaatgtaataagtgtcaagttgtcatcagtttaaaataatgggttataagatattacttgcaagcctaatggtaaccttaaatctataaacatgcaacagatacataaaaagaaagaaattaaacataccaccagagaaaatcatcttcactaataaggaaggaaggaaagaaagaagaccacaaaaccactataaaagaaatggcaaaatggtgggattacatccttacttatcaatggtaacattaaatgtaaatggactaaactctccaatcaaaaggcatagagtggctgaatggattttaaaaaatgacccaacaatctgttgcctacaagaaacagacttcacctataaagacacatagactgaaaataaacagataaaaaaatgacattccatgcaaagtaaaactaaaaaagagcaggagtagctatacttacatcagacaaaggagatttcaagacaaaactataagaagagacaaagaagtttattatttaatgataaatgggtcaatttagccagaggatataacatttgtaaatatgtatgcaaccaacactggcacagccagatatataaaggaaatattagagctaaaaagagacaaagaaacattggacttaatctgcattatgtctcaccatatacaaaagtcaactcaaagtggattaaatacttaaagctaagacttgaaactatgaaattactaaaagaaaaatttagggaaactctccaagatgttggtctgagctaagatttcttgagtaatataccacaagtacatgcaaccaaagcaaaaatggacaagtgggatgtgtcaagttaaaatcttctgcacagcaaagaagataatcaacaaagtgggaagacaacccacagaatggaagtatttccaaactgttcatctgacaagggattataaaccagagtatataaggagcacaaacaactacataggaaaaaatctaataatccatttaaaaaatgggccaaagatctgaattgatatttctgaaaagaagacatacaaatggcaaacaagtacatgaaaagctggaaaacatcactgatcatcagataaatacaaatcacaatagcaatgagatgtcatctcatctcagttaaaattacttctatctaaaagacaggcaatagtaaattctggggaggatgaggacaaaagggagccctcataccctgttggtcagaatgtaaattaatacaagtactatggagaacactttgaagattcttcaaaatactaaaaatggatctgccatatgatcctgcaatcccacttctaggtatatacccagaagaaaggaaatcagtatgtctaagatatagacatactcccatgtttattgcaacactattcacaacagccagggagtggaagcaacctaagtgctcacaaacagatgaatggataaagaaaatgtggtatatatacacaaaggagtaatattcatccataaaaaaaagagtgagatcctttcatttgcaaatgaggttattatgcaaatgaattggagatcattatgttaagtgaaataagccaggcactgaaagaaaagcttcccatattctcacttatttgtgagagctaaaaattacaacaatcgaactcagagagagagtggaatgatgattaccagcagctgggaagggtagtggggctggtgggaagtggagatgattaatgagtacaaaaatatagttagatagaatgaataatctctagtatttgataacacaacagggtgactacagtcaacaataatttattgtacatttttaaataacttttagttatttagtatccagtattttagttatttaatataatcagattgtaatacaaagaaaagataaatgcttgaggtgctggataccccatttaccctgttgtgatgattatgcattgtgtgcctatatcaaaatatttcatgtgccccataaatatatactcctactaaatactcagaaaaatatttaaaaagtaaaaagcaaaaacaatgaaattacgtctttagagggccaaaaggaagaaaaagtcaatgtagaattctatactggataaaaatattcttcaaaaataaatattatttagacaaaactgaatgcatttatagcaatcttcattacaagaaacaccaagaaagttcttcggcttgaaggaaaatatttgtaaatggaagcacatagtatacagaaagaagagaagagttccagaatgttcaaccatagatacaaagtcaatattaaaaaaaataactgtactgttagagactagcagcaaatgattacataaataaacccttaaaaatgctatttataatagcataaaatcatgaaacaccaagagagattttaatagatgtttgagacctctattttgaaaatattaaaatactgcttagagaatttaatgaacagagaaataaatggagatcatctataaatttattatgattctaatctatatttaagcatgtttcttttcttttggtggacattaaataattttaatatttatatgaaattcaaaagacatagctagaataatgtttaagaagaagaatgcatattaccagtttttaggattcattataaaattagaatagttaaatgactatgggatttgcacaaggatcacatcaagaggtgggataaactagagtatagaatagaccaacacctatacattgaggaaaggataatgtttacatgaaaatagtaatttattctttccatatatacaaattaacttgaaatttacaaaatacatgtctgtagtagcattcatgtttgtccccaagtaactagcacatttcaaggcacatgatggatattggataaagagttgatgaaacagtgacaacataaacttcattactgagaaagttttattagaatgcactactaaaataaaagaaaaattaaatttaaagaatgcactattaataacagcaataagactgatcctgcaagttttcttcttgaggattgaagaaatataaatgaatgctcatcctactgatggttgatatgtggccctagatttaaatttaaggggatttacaactgacctccagtctaggaattcatagtcactcatttattgagcctatcacaaagtagagttctttatttggtgttgaaggggccagggaaagaaagaaatggaaaagtggtgttccatgttgcttccttattactaaacatgagaaactgcattatgtaaagtgatttctaaaatttctatagttccacatattatcagtatcaacatatcatactgtcatatggttccatgtattgataataccattcaaaatagttgacttgagaagttttaatctaaattagcgtaaaaagcaaacatggaaaaaacacatatggatgaaatattatggagctggtgtcttttagtgaagaacagaagagatcatgaaaaaagaaataaacaaaatatgttaaaattcaccaaaaagaaaaataataaaatgatctactatcttctcctcttttatattgtgataaacagagattcaagtttttaaaaagaaaaattgggccaggtgcagtggctcacacctttaatcccagcactttgggaggccgaggcaggcagatcacttgaggtcaggagttcaagaccagcctggacaacatggtgaaaccccatctctactgacagtacaaaattagctgggtgtggtggtaggggcctataatcccagctccttgggaggctgaggcaggagaattgcttgaacccaggagacaggttgcagtgagccgagattgcaccgctgagctccagcctagttgacagagtgagactctgtttcaaaagaaaaaaaaaaagaaaaaaggaaaaagaaaagttggatcacttagctatatataaggagacaataaaatacttatggatggtttaaaatggataccaataaggtttttctataagttggatttctgtatttggttgtcttttctaaaactcctggaactaatcaatcagggccatactaatttgctaaaaatgaattttcaaaataatattgaaagtttcaaaaatcttttctgattcatgacttatttcttgcaagttagtgctttctctttattaattcaagcatcatggcttctttgccaatattttattcaatcctgaaaactagcataactgacatctatttattttcatgagactgatatagggggttgacgccatttagatgaagagctcagaattaaaattttctagaatttctgggtctttgtgttacagcatgtgtaacaactactttaatatccttaatcctaatatagggtcacatgaccttaaatgtaggaaatttgtaaatgagtgcttttattgcagacagaaaaaacatacatgcaatttcatctttttgttgtggattatatttttataattctaaatatgtttgaactttaaatactatgttagcacagttagtcctcattatttatggatttcatatttgtgaattttactactcactatgaaatatgttgataatccccaggccaatactcatggtgtgtttgctgtaattcacggacatgtacagaacattgaaaaatgtgaattgttcaaaccacatattccagtcatgtgagaagaaggcaaaacagcagtctgccttcttgtttcagctctcatgttataaacgagtgtcctttttgcagcctagttagtgccaagagctttgaattttcatccttttacttggtgattttacttttaagatggtctaaccatcttaacccaaccagtggtgaagtgctgtttatgatgaaatagacaagaagcacaagaagactatgatgtgccttacaatgagaaaatatgagtgttagacaagctttgtttagcgtgaattatagtgcttttggctgtgagttcaatgttaatgaatcaacaatacgaatatccagaaaaaggaagaggaaatttgctgagctgtatatgaagttgcttcgtaaagtgcaaaactaacatctgtaccacatgataaaactatggaaaacatggaaaagtggctaaatctgtggattcatgaaatgacaggcaagcgtagagaatagcattattttgatgcggatagccaaagaaatttatgctcatgttattcaggattttaaagatgctatgctaaatccttctggactagtgctacatggcccacatgtttcaaagagtgatagcatgaacatgataaacttgcaggtgaggcatattctgcggataggaggctgtgaaaaacatttttaaaagaattctgaattctttataattatgtttatgatggaacacatttatgtttagcttatagtttgtttttttatgatcaaagagactggagctaattgcatcttactctcttttcattatagtgtatataagatttggctcaaaacatcaatgtaaccctctagctcataactattactggttttccagactccagactaatacctccctgtttcatgctgtctcctttacagtgtgtcacccaaaagattacaaaatgttttgaaaaacccctaggacattgctgcctggttatatgtagtagagtactgatggtacctatctgtctactccttacagcaactggtggtagggctgcaactacaagaattagataaaattgattaatgatactgtgatctgctaccaagtttgctattggaaaatagttcactgattgtaaggaacacaaagaattaaatgaagacaggagaaatttcttctaaaagaataaaatgaagtgtaataatttcctgcatacctcagggagatagggatatgaaaacattttcatgacttcaggatattaatgtggcctatgtcagcgattctcaaattgtgatgtatcccttaaaccctttctgaaggtctaataggtcaaaactttttaaaaataataatagtatgatggttttgtcttgttcactttgttgacatgtgcactgattgagacaggaagtagtggttaaaatttctgatgtctacatttgaaggaagacagtgactacacatcatttataatgaaatgcaaagtaagtgtaaacaatactggcttcatcctcatgtgtgatgaatgtgtagagtaaaagcacttgtgcgactgtttgagttgcaaaataaagtagctagtttttcgtagaacatcatttttaactgaaagaattactatgggtaatttaactgaaagagaatctatggatgttaaaacttgggtattttgcagacattttctgtgaaaatataggaagtgagtcattcgaataaaacaagtaactatttattgccaatggtaagtcaaactttcaagtgacaatttgaattttagaaaacttgtatccatgttcactgtgaccctgatagttttccaataaagattattctgagaaaagttataaacaaacgtattttcatattgcatttgaaatgtgtaaaaatttgctaaatctgcatagcccaaataaccagtattttccaaatgactaatgcagaatgttacaaaatcatgaagaaatttaaaaattcattcaaaatgcaagataaatcaatatatttaaccaattagagtatgaaatattcattgtcagggcttttattttcacattgcaagtaaactgtaaggaactattacttgctgagttttgatgtagtatcaaagcaggatatctcaattatctgaaaaatctgccagaatactattccaatttctaacggaatatatgtgtgaaacaaaataacataacaaaaacaacatactatagcaaattgaattcaaaggcagatttgagaatctggctagtttctaataaggcagatactaatttttttaaatgaacaaaatgccatttttcttactggttttttgataataaaagtatttgatatttaaatattttatgtatattaatgttttaggtttattgtttttacattcaaaattcagaaatgtttttaaattatactgttaaatttaatacaataaagtgtttatagatgtagcccaaacaaatgctcttataggccttaatcatttttaagagggtaaaagtgtcctaagataaaaaattttgagagctgctataccacattttgaaaatcatagtataaggtttcattattatcttaaataagttatgcttaaaagtgaaatggtagttaaaaaggataatcaaaaggaagatctcagaacttgcttgagatttggagagccagtcgactggtataacatgatacaaggactcattttcaagtgtgaattacaatggtaacatttattgaggacaattaggtttttacatacataattttgttttcttttcacacaacttgttgaggtagatactattaccataattttgtagatttgaagaacatagcccactgaattttggtaactttactgcacacagaaggagagatttgagaataagataagggacacctccctgactaattcattctatgaggccagcattctcttgataccaaaatctggtagagatacaacaaaaacagaaaacttcaggccaatatccttgatgaacataaatgtaaaaatcctcagtgaactactggcaaattgaatacagcagcacatctaaaagctaatccaccttgattaagttggctttatccctaggatgtaaggttagttcaatatatgcaaatcaataaatgtaattcaccacataatagatgcagaaaagtcctttgataaaattcaacatcacttcatattaaaaatcctcaacatactagccactgaaggaacatacctcaaataataagagccatctatgacaaatccacggccaacatcatactgaatgggcaaaagctgaaaacgttccccttgagacctggagagagacaagatgctcactctcaccacttctattcaacatagtactggagatcctagccacaacaatcaggcaagagaaagaactaaagtgtaaacaaataggaagagaggaagacaagctatctctcttcatggatgaaatgagaggtgagaggatcaaaaaactaccttttgggtactatgcttattacttgagtgacaaaataatctgtactgaacccatgtgacatgcaatttacctatattagaaaccttgacatgtacctctcaacctaaaataagagtttaaaaaaagatactgtcaaaacaacacagttctttctatttctgttgtaccactttgtaatatcaaagggtcctttcttttcctctttaggtttcgagataacatccataccatacataaaaccaagtatagttgatttttatactactttttcattataaaattaatgcatgtaaaaaagtatcattaaatattcctctataacagttttagttactaagtagaatttaactgtatggctataccataagttatttaattcctgtcattgttgatcaaatatattttcaacattttgttatcgtaaatgatgtagcaatgtacactcttcaattataattttgaatatatccgtaattccttcacaacacgattaaaactagaactattaaaatgtacctctagattgtactgcagaaatattgttgctgttaatattaatctagtctaatatttattgtcagttccctactggggtaaatacttttgttttatttttgtttgtttttatctctagtatcactaactaactttgcattgtttcatgtgatcataggctatttgctttgtaaaagttattcactattgaaatggtatgtgtcagtcattgctctaagtgttttatatatatacacattacatatatatacatatacatttatattgacacatttatttctgaaaacaaccctttgaaataatgtaccggtcagattaggtgaagatatgctgatataatgagcaacactaaaatctcagaggcatgcaacaacaaaattttgttgttgctcacattacatatttattgtgggccaacagcagctctgctctccctcttcttcattatagtacccaatctgaaagattaattcctattggaatttttaaaatcttacggcaaatggaaaagggagggggcttaaccacaagatgactcttaacatttctgtgtgtaagtggttcccatcattttagtgcacattgctttgaccaaaagaattcaaatagttaaacacatcttaatgggattatgatttttagttcctccatatggagaaggatcagaaatcgcagtcatgatatcaatgagcaacagaaagtattcttgcacaaagagggtggcaaatatttgagaacaaagacataatccacattttgtagatgagaaaactgagatacagagagtttgagtaacttacccatactgagagatttaataaatggtgcagctgggatgcaagcctgagcactctggtttcaaggagtgtgctctggtccaatgatagaagataaaatttatccagaaaaagttacctagcacctcatagtattttacaaatatgacaaccctagaaattattgtccaaagttggaccctttttcttggataaatgctaaactgggtgggatatattaactagttttaacctgggattgtcccaattaaaccaagatgtgaggtaaatcttgaggcaaattttataaaacattatactattgggtagtaattaagggttttggcaagcttgtttaagaagtaccaaccaaggaaacacttattatagaggcttcactgcaaaatacgttatataataccctccaatgcacactaagtttctgagttggttttgcttctttgctatattctgtaagtgaaacttattaacgtttgcagcatttcctaaggtggtctctaaaatctgctctattttagcacttttaaactaccatttgaagtaacaaatatttctaaaggaggccaaataatagttgtaaagtttgaataaagcaggataaataacaaaacacactaggaatttattagtataacagtgaaaagaagcaaaacttctagacttgagcttatatgcttattgttttgtgtgcttagtggaggaatgtataaatgcggctgagtatacaaactataaaatctctaattttaacattgcttgtttatatattaggaacttttaggggagttttgatttgcaagtttttataggtttaccagactcattaattgcctgggaagaactttacaggatttcctttggtttatgtctaatctttgaaattggaaaacttaaaagtgaaatataaattcctcatggagaagtgatcatgaggtctgaatagaatcaggtaattcccaagagacatgcaagataataataaagacacaaaaaattattccatatcatttgtgcccttatttgtgagtaaaggggtggaaaataaaataagatgtcattttcatctattgaattggcaaagattttaaaatataatattgaatggttgtaagggattggtcaaatgagcattctcttatatggctggtgagaatttaaatagacacaaattttgtggcaagtagtttaaaatgaaaaacacacaagaatttatacatgttcttagtcattgacatcaaggaatgtatgctttggaaatacccacagattttaatgacatatttatcttctagaattatttttagtgttgaaaaactagaggcaataatgaaaggttaagtaaattatgtctgtccacatgggggaaggttacacagcatttttttaaaatcatgctttcaaataatatatcttaggaaattttaattattcaatcttgaatgaaaatagcagtctgcaaaattgttaaacagagaatggtcacaatttttaaaaacagaaggaaatataatcatgtatcagattaacagcagttgtaaaccgtgttgtagaaaaatgagtaatgtttgcctttcaaaactatggatattttccaaatactctgcagttttctaattataatcagaaaacagttattaaacaaagtgaaagaaattaaagtttaaatttaccagtataagttgcttctttggagggtatattttaacttattgactaccatcagatttactaaatatcatagcacgtaatttcatttaaattcaccacacattacttttctatgtagttcatttaccacaggtataatattgccatttgtattactagtagaaattatacttaatacattgaatttatgccataggaaaaagaaaattaaaattatgttcttattgtatatgcacatattttcttcttgataaaggatttgtctcaaacagattgtaatgacagatgatagctatagatagatagatagagtaaacatgtaagctactacaaggatccaattagagtgaatttaggttggaagaaggttctttcttcatctttctttatctctgaataatttcaaagttgacagaccatggttgctgacatctttattgagaaaacaagagttttgcccacgcttatttaaatgtacttatattttcctgtttgctttacatattacatatgatgaacttttgaggatgggggtcataatttcctttttttctatctttctgaactaaaatatatatgtaaaaactcaataaatgatagagaattaattactgaacatatgtttgtattcacacagaaaggtggtaaatatagaagttgataggcagcttctagagccagatcacttgtgtttaaatcccagcattgctatgtggcttcaagaaagttactcaatttctctgtgcctcagtgacttcaattcaagtataacatgaagaaaataatgctactcatctttggagtggtgaagtgacttaatgcttaccaaacacttagaatatgctggcatatggcacatttagctattatcatttcaagataatttccttgctaagtgactataatgattacaactcataactgtagctttgaggaatacgtacacatattcaaagctgggaattgtttgttggcagctctactggtatatggagggatacagaagaaaatcatcatatgtacagctaatcaccaagagatttatggatataaagaaatacatggtaacaagaatgtttattgatgaatttataattagtgagataaaatttacaaatggtatgggatatcattaaaaagcttttagaaaaggaaattcttatggggtacacaaaacaatatgaagataaatatttgtgaactggaaaaagctggcctttcaatctagacaggatatattatgcaagtagtcacttaattgagcctttcctttttctgacttagataattgataaaaaatatatatatttttatttcagagcaggatggaagtttatttaacagctttataacaggaaacaaaggaaagtactcttggaagagaccacacaggcaccttggaggtcaagtgacctgtttaaccttgcacctcaaattttatatgctggactacttctttcatcttgtacccctttccctttattcgtccctcatgatgagtcacccacatgcatggtgccctccttatgctccagagatgagcatgcagagtgtgattacgaagttgcttgcatacttacctcaggcttttttccatgatacaaaggatatttttgaaatacaaaaaataaccttttaagtaatttgccaatgtaaggcattatgattactacttttcttattaataatcatcatcgaacatagaaaattaaagcaaagtaaaattaaattactttgcccctccattggagaaggaatattaaggaaaatttacattacattttattcttttgtttattttttatatagttcttgggattgcattttttgaagttgagtatatttgggtataatgtgctttaatacattgaacttcttccacccctttgttttctaaagggcttttttgttgaattttaaaggaagtttagatttttaaaaacccaacattgttgttaatagagttgaagatacgtgcgtgtgttatttcaacaaaggctgctgggtggaatgtgtactgtgggaacctttatttaagcaattttgctgctttagttgcatcctttattcattctgcaaaaaattcactagccatgagctggagtacggctactcttttcccattcccccactgttgatcaaataaagctatggaaaaagaaggagagggagaagtaaaaggaaagagaagaaagaagaaggattaagtattaccttcaggaccaaagagtggaagtattttctttaacatttaatgaagtaaataaagggagtacaaagtcaagtagcaataagaaaaacttgaaatgcacgagggcaggaaattgctctgtaaatatgattaaattctagacccaacattcagtggaaacaagttttagaatttttccattagagatcattaaaaacattatttctctcaaacaaggtgacaagtggaagagcgtgcacttgatttctaaattgccaccctccttagattcttctgacatactagcagtggccaaattccaatatacattcatagttcaatgcaccttttcatactgtggaggcacctgcatatccactttctccctaatcctttgactattcaaataatattatcaatgcacaattatgtcagtgatttttcttcatgaattgtaaccctgtgctagctaaagtatgtcaccatcatatcagtgctagtaaatattgtggttccttgggtgaaactcaaagacttgtattcaggatccttaaacatgttatccatctagtttctaagagggaggacaggaaatgtttagttttaaagtttagttttttgtgtttttcatggcctgtagcataagtccccatgttgcatagtcacactgaaacttgatattatattttgtggttgctgtgcatccaagattcctttatactcctcacatataaactgagttttatgtccttactgcctgaattttccttagaagtcctgtaatccaaatgattttagcatcaactccacagagaagtcatgaagcctgtagaccatactctatgtaaatctctggttcatttctcgttgctaatctccaccctcgtacccttcccttgactttgtcacttgtatttttcttttaaaccctttccatatttaaaacaccacaatattgacatgtgagccatcttctcgagagagaatcaggtattctcttagccttctaccttctgttgccgttccaaggctattactgtttagagcttaacttcttgtaataacttgcatcactccccttgtgtcctcttaacaaacaatcacatcactgctcactcatcatttccctcaatgtgacagtatgaagaattcaatttaatccttgctatatgggagtgacagtagaaaactgggccatgatggatcaagcattatcaattccacagatgctcttacccaaaactcaggtcataaatactgtgaacgtgccctgaaaatactttctacttgtatcctcacccaaattatacgcatttataccatagcgcaatatattcccccatactactgaggaaattcctatatctatgaatgctacaagagatccaaatgtagtttgctttgaaggtagaccattgtcaaatgaccgttgattaatcttatttatgctttgataatatgtataatgtttaacagcttgaagtagcctcaatctttaatggacatttgtggtgaaaccacaataaaacagtgcttgagccttgggttttcatagtctctaggctctaattcaagcaatttcctatccatacaaccaatagattcttcaaatatcttgtgaatatgacaaatttcttctaaaatagcatagctttctagttcctagcttctgtttaaaatctagaaaccaatttattattccctatccaaatagattccctaggtacataaccctatatccaaaggttacagtgtaaatataaagagaactttatcaatggttttatgatgtgtatttttaaaggaattttctcctttgttttttaaaacaatgtaacctatatgaattttgttttcatcttaaaccaaatgaaactgaagtaatatatcttacctagggtcagaaaacaaagatacaatggagttgagatttggcttggtggtgttgtcttcacattagggattttcctctgtcttatgtgccagagcagttgagaattctatatgacattaaaaatctcttaatttttagttcataaatattgaaaattaatttgattattgattctgttgattaaggttgttgcacataaacgtgcctaaaattccttagtgctcctactttctgagttagctggaatgcttgtgctttgggcataccttatgtgcaactctattgtgatgaatattatgaaatgtaactgtttcttcactgaaaggaacaaatgataaatatttcatcgaatgaatacgtactattgttgttgagctttctgagttggagaaagagcagactttcttgaggaagtggtttcgaatcagaactagaaagatgagaaagacatcttccttccattttccatggccacctctgcttcagactcaccttttttctgttcatatcctttgcccactttttgatgggtttgtttgtttgtttcttgaaaatttgtttaagttctttgtagattctggatactagccctttgttagatggatagattgcaaaaatttcctcctattctgtaggttgcctgttcactctggtgatagtttcttttgctgtgcagaagctctttagtttaattagatcccatttgtcagttgtggcttttgttgccattgcttttagtgttttagtcatgaagtctttgcacatgcctttgtccggaatggtattacctaggttttcttctaaggtttttgtggttttaggtcttacatttaggcctttaatccatcctgagttaatttttgtataaggtgtaaggaaggggtccagtttcagttttctgcatatggctagccagttttcccaacaccatttattaaatagggaatccttttcccattgcttgtttttgtcaggtttgtcgaggatcagatggttgtagatgtgtagcattatttctgaggcctcttgtctattccactcgtctatatatctgttttggtaccagtaccatgctgttttggtgactgtaggcttgtagtatagtttgaagtcaggtagcatggtgcctccagctttgttctttttgcttaggattgtcttggctgtatgggctcttttttggtgccatgtgaaatttaaagtagtttttcctaattgtgtgaagaaagacaatggtggcttgatgcggatggcattgaatctataaattactttgggcagcatggccattttcatgctattgattcttcctatccatgagcatggaatgttttttcatttgtttgggtcctctattatttccttgagcagtggtttgcagttctccttgaagaggtccttcacatcccttgtaaggtgtattcctaggtagtttattttctttgtggcaactcacctttttatgacttgcaccacggataattaagtgatgtctttgtgtcttctcaccagacaaccatgtccctgcctgacctttccttttatgtgacagtagcagcagttgtattttagttcctgctgaagtgaagaaagtgaagttttaaagaaagtaatggtttgtgaattgggatgatatgacagactttagtaataagagtagtttgcctgtgttggagaatcctagaaaatgagtaacaactgtcatgaagaatgattcaaacgtgatgttttcattgataggaagagagaatgatcatatctgcaacctaaggactaaaagagctgatgtcttgggctccgtatccacataggctacctctggaatactaaaacaaatgtacttctcaatttttactggagaagagatgcagtttaaacgctgccacagagttagtatttttagtgtcccaaacaataatggtccagatgtgttatttcaactataaatttcactttttattgtaaaaggttaaagaactttacaaaataatttttattaagtttcttacatttgtttttctggccattctctctatagttttctaattataaattaatgatgggaaatttattaccaaactggttcacaagattctttgtttacatagtttctactataccagtttgacttgaattataaaaattaggttgatatatctcgagtatgaaaggaccctttaaaattcaattgtgagctgtgaaacaatattacaactctaaggtaagcctactaaattttaggaaattgattttaagtagagtataatgtaatccctaaattatttaagtctacttggaaacatattttatactgtaaaactgcttactacaatactaatgctttcacttgcctctattacaaatgctgaaaaactcatattaaaacaaatctatctttcatgccaactataatacagatattgtgtcttagttaaaataatagggaagcgtgttagtgcccaggtaagatttcatgctaacagtgctgcctaagaataactttatataaaggtttccttcttctttctgaaagttattttttaattgctcaacataggccaatccttagtgacattgtatttgaaattgtttaagaatctatttatattttgagtaacttatcatgattaacaagtttgaacatttgccttaaatttgttaagaaggaaatttctatattctctttcactgtttacttttttcttcctcagtaaggcaatttaattgctttcaagtaatttcaaggtcatccttagtttttggtcttgtgcatgttcccaagaacttaattatagaagtttttctgtaatgaatatgacagagaacccaactctacacaactgatctatatttatgttcctactgaggcatggtagtcctccttccccacacttgcctgcccatgaaatcgaaatatttggcaggattaattctcaaaagataaaaacactctaattgaagaaaagtatcaattcaaatcatatcttttaagaagaaatatattctttactttcctgcttaaatttgaaatagtagcagttgaaaattgtggattggaactaattactgattaaaacaaagtacacctatgagttttaatagaagcagtaagagtaatgtgtaaatgacttttctttgttcatggaaaccattgtggttttcaggtgcagcttaccttcacaaaagctaattgtagagataattacatccaaatgcacaaattggggaaaacacagagaagcttcattcagaattcactgacactatgaaagacaggatggtataaaagagttagtgtgctctgaaaaaggaagttcttaaaaactttggaactccagagtcttgggtttgatttctgcttccatcatttaattgaatttcaggcaggttatctaaactctgcctcagtttgctcattgttcatgcaacagagtttctatgcagactacacatagtaatatattttaagctttagacataaatagagttcattcctcactgaccgattttcttttaataaataaatcattcttaaaatttcttttcttgaagtacgttataggtcagatacaatagctcacttctgtcccagcaatttgggaggccaaggtgggaagatggcttaaggccagtttttcaggaccttcttggacaacagagtggggctccatctctacagaaaaaattaaaataaaaaataaacgtaaaaaaataaagtatgttgtaatttggcctgtttaatttgacaatgccattagtagtatacactggaaagctgttatactatggttgttgcccattgtcagtaggcaacatttcaatgagctgtaatgttaaactgaaaataccctttttcttgagcaattatgtgctatttatatataatatatattatgtgattatatatcatataataaagtatatattatatagaatacatataatacatttacatataatatgtataacattttctataatgaatacgccagagaacccaattctacacaactgatctatatttatgttcctactgagtcatggtagtcctccttccccacacttacctgcccatgatatcgaaatatataattatatgttatacatattatatagcaattataggcatcacacaattttctttatatatcaccaattctatttatattatatttacattatgtaaatatatagagtatatttatatgtaaatatatagaatatatgtaaatatattatttatataaatcttaagatataggtatgggcaattttgattttacaaacttcttcagggttctgtatatccatttgcataaagttttgattgtatgcatttttatatgggacactgacttatttttcatccaataaatggtaaatttctatccattagaggatttacctttgatttcattttggtgatactttaaatcataggtcagctattagaaaaccaattacaaattacaacgtggtaactaaatgatatttactaaagcaaagcatatcaattgatatttttaagttatatgttagcatacgcgcacacacacacacacgcgcacgcgataggatccagattgatgccctaataaagtaacaagttagttaaagatgaagtgaatttataaacataccgttatataaaactgtctagatagaacaaacaaatatcacttgtgatgaaatacttgaaatttagttcaccacatgcactgttgccatcatttttttttatgagaggattcagctattgtatcgagtgtttgcaagcgtgaattcagaatcttggtaggaaaaaggtaaaagacaaattgctatcttctgaaaggaggtgtgaattgttcatatgtgcagattttacattaacgagaaaccttaactttctcaaaagaagaaaggcatttctaacaatgttacgtataacatatttttgttcttctgaaaacttgtgtttcattttcttttaggaaaaaaaaaagatcagactcttaggccaatttttcagactcttctgtagattacttgagcagatatgaaatcaataagaccttaggtaaacagtatggtacatattttttttaagtctctgatacattgagtctcaaaatatgttgcacattaaccgaagacatgtttgtagaattcatagcacttattatatcttgattatactgaaacatttttaactttgacaattataaatccatcttgcagtttctccaaattcattttattttaattagctatgatttgacatcatagtccattatacacttacttgactaagtctatgctatcagtttttctacaaccaccacttcctatcagtaaataattgaaaggctttattcttataaagcacaattatgtttgcttgatcagtagtcttcaactatatctgctcatgtgtcccctaaaataattgagaaaaatagtataaaatcaataacttttgaattcaatacattcaagcaatgatgtcattatatatgtggttcatcttcctgacacacgggagatgtttctcttagacctcagtgccagaacagtataatttcagagcaacaatactattttcttggaatataagtgggaagctcacaactattcatatttctctctttgtcaagaaaagttataaggtttaacacaattatgaaagccagaaaacaaatgtatttttgtagcacttttgtagaaactcctggctttatgttactgtctctcactttccaataatgctttttttaaataatggaatttgttatgtgtttctgcaaattgcatgatatcctttgtgaatgaagtagatactaattaactatttctaaacagaccgctacaatacagtgtgaaaagttttaccataactgaaaatgtgttaataaagaagtggctacaggctgtgtctcatacactgtaattcttttcagtagccttgcatctctaattgattttgcagtactaaggccttcatttcttctgttacattccaatattcttttctcttgttttatctttagcattaatagatatgaagaaaaaaactatcctgtactttaactagattcagacgctatttccttttgttcattaatcctacttaaactctctatagtgtgtattttaaaaaatgtttgtacatgctttttggaaaagtgctatatatccagctaatcatttctatatacagttaaaaagtagaggtaacagtgcttatttctttatttatatatttagaggcggagttttgctcttgttgcctaggctggagtgcaatggcacgatcttggctcactgcaacctccgcctcccaggttcaagggattctcccacctcagcctcccaagtagttgggattacaggtgcctgccaccacacccagtttattttttgtatttttagtagagatggggtttccccacattggccatgctggtctcgaactcctgacgtcaggcgattcacccaccttggcctcccaaagtgctgggattacaggtgtaagccaccatgtccagtcagtgcttattttaaaatgaaacatcaggaacattttgaaaaacatttttgcataaagtatcagggctatgtttttgttcttgataccaattgccagctgattgcattattgtgtttaaaattatcctggggcataaatttatccagagtctgatctaattaatttcaggctcctttgcagatagttttagggaccaatcatctctgagattttttgtgaacacaggagggctcttcttgattttctctttacctgattatctatggtgaatgaatagctgacccacagtttagcttgatactctcatggagctactatcctctcttaatctcacttccaaaatctctattattattcagagtgccttcaagtttaaccttccccacactttattccaaacaagtgagttcctttcaggagagctttggagctctgttcttatggactgcctactccatgggcaaaattcctgtgtctccctgctctgtagttggctcctggacagtggtctacttctctcagagtgatactttggctttacgggcagggtactcggtggagtgataacatctggtcttcctcttatagcttgaaactttcctcttatagcatgaaacttttgccctttgagtgagtagaggcaagggtgatcggggcccgcccattcgttttcttggcttgccatacctggagtagagctttcaccatagaagtggggggtcagacaaaggaataaagcctagacctctcagccattgttgcctggaagagattctgaaacagagatttgggaatgggggctgagaaacactggtgctctgcccttgaagagaagataccacctctcttgactaggaatggacggatagggagccctattgttcttggctgcacccatctggagtggcgcttctctcatgctcagctgtgggtgagctgtgggtgtttgtggctcaaattccacagactcttgctgctcttgctaagatttagcagaatttctaaaataaatgtttcttcctttactgtctgctcttaggacaatttccagatattaccctttttttttttttttggtataaccttcaccacttatggttgttttgctgtggagaaggtccacagattctagattctgccatcattctagaaaccatctctttgctgcctacattattaacatcatttattgtatcttgtttaaatgaatacatatatttatgtgtcagtaattgggccagatactaagaggaaaaagatgactttgtcatgagtgtgccttgcgagaagcacaagtttaaactggaaaaatgtaaacaatattatcatttgtgtaaaatacaaaatgatgtgagtacataatatcattgtgaaagatatctatgcataacaagataaacactgggtgataactttagtgtggaatactcctttgaagaaatcaaaatatggggatatttatgtttattggaaataaggtgaaataactttactaatatgttattttctggaaataggtgaaagtctacatcattctatggttcccttattttaacctgtaatgtcagctcaatttctattttatgaaatgcagatatgaattaatcagcttttattttataatagtaagaaaatatatagattttaaacattgttctaatagaaattgctatttttaacaacttaaaatttatttcataaatgtaagcccaaaatatcagcacaaaagaaatgtcaaacttgatttacccattccattctttggaaaacctagattttctatcctacagaatgtaccttcagcacttttctcagtctgttttaaaataacctctgtgactgagcttctaccacagtctcaggaacctgttccataattcatttattgttcagagtcaggaaatcgcttcagatattcaactcaaatttccgttaccattatgaaaataactttcctctattaggatattttatatttatcctattcactgcctctaagtttttcccatgccacacaaacatgtatgtcacaaatatttatatatttgtgtgatttaagatattaaaaatctaaaatacaacatttaaaaaaccgaatctacagtattgggtaatatttttggttatagaaagcaatcacagaattttcacattggactcttttgcatgaggatttagggttcttaatttgataagccagacaaattattatcaatattatttacaaagatgaaaaaaaaacctcaggaaggcccaattgtttgcagtagctataaaaatggcctaaattatcttaaactgcataaacaggttataatattgtgataatatgcagtaactgactctttgtgtattttactactagggctatatttgaagtctagtgctcagatatttgatgaaggctcttacaatattcttgttgagaagatctccatttgggagtgcagacaatgcagtataagctggattatgttatgttgtaaaattttatttttaatgtgtataaatttatgtacttgtatagccatataaggaaattttatttatatttaatttttaacgttctgttcttactactgacttgaatgaagacaaagagcatttttattatgtgtgtaaaacatggtccattttgaaaggatattgattatgatggctaaaaactcaagactcaaaataatttttacaagctaaagaaaataaccttaccaatataaataatttgtattaaacattacaaaatatactaaattaaaaggatgagttattaccttttattatttttataacatacatcatactttctgaatatatttcattcttaaatgtatgcctttgttagttctaaacactagaaatgaaggtatttatcaaattgtttatgtcattttcagtgtcttctgtaatatgggattattgtattaaatcacttatttaattcatttataaaaatgttagtaaactgcttattcagaatcagtcatttctgttagaagataaaagtaatggttaaactgaaaggccttttatttttttccactatattgaggtaattttaactattcattgagataagagatattaactaatgactttgatgaaatgaaacaaatgactagttaaggtagactctatagtcaaaaactaaatagatcatttaaattacagaactgctttaaactaatcggatattttattgtaccctgagagtttattataaaaatttagataggcaaaagccccatctggcaaccgtgttactacaagctaagtacagagaatcttgctgccagcagaggcatttcatgcttcatgtctggaaaaaaaaaaaaaaaaaaaaaaaaaagctataatttagttgtgtacgcttgttcagatgatttcaagttggtgcttttgatagtgcaagttccagctgctcaggcctatgagtcctcttgtgaaaaattatgaaatcccagccaagttaactgcagtcgtttgatagatctcatgtatattggtaggaattgctgtacgttgctgtctttagagctaatgttgttttaaaataagaactatttaaaatcattaagaagaaaatctgaggcaaatatttgacattttgtatgcattaaatggctctgtcatttttgaaggtattttgctagactaaatgagatgtgcaaaatgcctgttataatatggatcttttggaatttaaaagcatctacccaatttgaaatgtgtactccatgtaggctatagctcctttaatgctgaaaatatcttccccaattaacttaattaactggaaactgtcactgttggcactgcactggcatagccaaatacttaaaaatgtgaaattattcttgctagaataagaagtggcttgaagggtaaccaggaatgtacttaggggctagttaacagtatcaagcctaagagaaatttacatttacagagaaacatcatttactccatcatcatcatgaacagtggtaactgatgtgagatcaggtgaaggagcacgttatttgcaataggaaacatatattgagtgttcttgtgaagtaagaggcatgaagtacgactacagggaatattgtggggtgcaggcagctgagggtaattctttgctttaaaggatttcatgcagagaaaaatgactctagattctgtgccatgcccaaggaagaagctggatttcatcccagtgcttgttcaaaaaataaatgtaaaacgcacaacacgtctactttgaaagcactaaatagaaaaaatttaaaatataaatttaagtacttgaagtgaaatactcaaaagatttcatgtaccattaaatgaaaataatgtagccctacttatgtctcaatagaatctcaattgtaggagaaataaaattatatgagtaaagaaaatgagatgtgaaataggtagtaaatggtgaatattcattttaaactgtatctttttataaattatttgattataggggattctcttttactttcttcttctatgattactttttgtaatatctataactagaatgccaatgattgctgagtgttaaaagaaattcaaacatatgattaatgtttggagtaaagagtaattaatgcccataagcattttttcaattttaaattttagctaagtacagttcaacaatatttatgtagcatctctaatgtacctgcactacactctaccttcacaaaaatgaatcgagcatagttgtggtgtgtggtgagtgtccagcatactgtggcaccacaaagaaggaaaacagttcaaactgacagtttagaggaaacttcctgcaacagctgccacattaaagatgaaatagatgaataaaaaataaataagttaaatgattaattaaatgacctaaaacgtttaaagcattttgccacacattatttcttttttttttttttcatcggactcttatgggaattccagatgcttcacaggatatttttctcattttgcaaatgagaaaattgatagtaatgcagtgaacactcttgtctaatgttcatataatccagtgtacaactagtgtattaaagagcataactcaaagccaggtaataatcttgctctaagtatattctccctccttcccatcccccatcaatctgcttgttaaactcgataaaagctgtcatgtaataggcagtaagtcagctgcctattgacttgtcatacaggtaagatcttttggtatgatggttttggtgcatatttcctatctgtggagactgtcactgtttagagtttggcatttaattttcacaagatactgcatagttatctcagagtttataaagtacctttaaaacatggtttatgcagataagttgttattactgtttttcccaggccgatttcttatgtttaatactcagtgtagttgggcagctcattaaagccaactggacaaggtcctatgaaactaggccactaggcagtttccagggtagcaaagtatagttcctttccaatgagtaaagcaataggtgcagatcgtgaaaggaaatatctgggccatgtcctgttcacctctcaggttgcttgctcagctgtaagctttggtgcaatgctatacagattcaacatatattctcgtctatcctttattactccaaactcttatggttactaaggcactcattttataacacaatgggatataaaataaataagaattatttgccagaagtaattcctgccttaaattggacaactcagatgaattctaaatgcttatttttgtgagaaaatagtatttgtccaaataaaaaattaagatttaccatttaattaatgtatattcaatattctaattaatcaatcctcctctttttctatttttgtctccttccaaacaaatttttatatttaatttagcactgagtagtcatacataatatttaattggcagactacctttatttttaaaggcaaatattattcatttaacacattctctttgtttaaatgtcaactactcatctcccagttagttatcttgcttaccttcatcttgaatatttccattttcagatttcttaatcttatgcaacttacttcataaagtcctaattcatgtgttggattaaggagaaaacatgaataaattaatttttgaacataaataatatgtatattattatttttgtcaccacataatgccttctattgattaagttcccaatacctatatttttgtattgaatccaggtccagtttaaaaaactgaactcttttattttcaatagagaaaatacttacatatggaagatattctgtctttatcagctctgcttgatacataattgactaatgttagaaatgttttcaaaggaagaattcctactgcaaatatccatggcttaataaatctggcatgtattgttcatatacagccggttaattggtgtcctgacacatagcttctgcataattccttcaggtgttagttcattgtccagatgatttaatatctttgagtatcattcggtctcatccctactttaaaataactggaattattagatctgctactagatgatgctataggagatatttacatagaataatatatgttactgtatcacaaatttgtgttttaaaaatgtttgtgataactgtagttcaatgtaattgggtgttttttgcaaccctacacattttcactggaatgcccaagggatctatggaacaaagaaaggtcaagaacccctattttaaaattgccaataacaagctaacgttcacacatcacccccaattcattcttatccttaactatttttttaattatgcttaatgcctatggtttccctacagaagagaaacagaaaacaacagtttttttcttaatatgtgaatagaatgtacttctatatttattcagtctttacttccaaatatgctaattactaagcttaataagtaattgcatagttttatctgaatgaattttagggcattaaataattcacacattttaaaatatactggctttaatatttaaatcttgaatacactggttttgattttgtcctatgttaaagatgtcagtattgataatgaactcctgaaagttcaatattgtgattttcaaagtgtgctcatcagctcctataaaccacaaaatacatagattaaagtaatctctggataccacatctataaaacatggtcttgtggtcttattagcaaagtgctagacaaagtagcgatatgaagtttctttcgactctgagaacaggtattatattctatataatgccaacatatatgtatgtataataaggatgaatatttatatttattcttaatatatcacttttagtatgatacatatttttacacaaacaaattgaaattgaatttgaagtcttccagtggaacgtacctaacatattcaaataaagtaaaatctcaagtcctggtaagtgtttcttcatccccatcaccaactccattactggtatttggtattaggtacatatccactcctcttctggcttctggctctgggacatacccagctggcataattggtagtgtggagaagggagacaaatagtcttcctacaaaccagaagaggttcttaagaggcattccacctttccaaccactgtgacattgagatggcttacagtaatctcatgctcagttaaaaatgacaaaaatatttctcaacactaaaatgattctcaaagccttctcatttcttgtatatacaaagactcagagacttgcatacacagataaatttatcatctcttacagaatcttctcaactgatattcttgctttttgatttctatcagaaacaaccatttcccttgctattattgattagttataaaatgccatcctttcaccatatagtccagatactattaataacttcttgttggctccaggacaaattcaacattagtagcatagttatcaaatccttggtagtaatgactatgaagagcaccaataaatagcatgcttcttccctatacaggttctaaaaaattaaaatatctgaaaaggtcttaataaaatgtgacttttattaatgataaagatgaagttggaagatacagcttattaagagggcaaaattgccctgttaattgaatcagagaatcaggcagatttagccaatatgacacagggtatttttgtcctttgggagaaaaaattccacatcatcaaaataaactagtaagtgaataagaaaataagtaagtaagtaagtaaataaataaatattttaaagccttaaaagacataacatcacattctgaatttactgccaattttaagaagtctttatttttatagaggatttgccataaatacatacaatttttcctttaaattaatgctaaactattgtttcaatgaagtgttatcgagtgcttactatgttcaaagcattagcctaggttttaatggagaaacaaagaccaggaacatctctgtcctcgcttaattcataatctagtgggtaagatgaacacataaataaaacccacaataacccaaaacctcttgaattatgctaaatatcagaaatgctattacaggttaatgatgtgctacaccaataggtgggaagaaaagttaattttctgttcagcaacagatcctgcttaaaagaaatatgttaaaataaattataattaagatgaagcctgtttctgtacttatcttgataaacctaacataaagataatatacactgtttattaaaacaaacaaaattattaaaacatatctccagaaatattttgcaacttaaaactttggtaatgatttaattatgacacttcatccgataatgcagtactcataatttttattaaatatacatgatccaataaccattagactctgaaagctcctttgaaactagaccttggctcagaaaaaaaaatacatattaggaatttaacaaaatgttttctgaaaaataacttttcacttctccttaagaaacgtccattactagaatgtgaaagacaaaacaaatattttcattttacagcataagaaagagcaataaccccagtaaattttttcatttccctcagtttcttcattagcagtttctttaccatgtgtaatttaaaaataggaaggtaacctaaggataacaactaatttaatcctgcatttttaaagctgagaaatctggtgctcagagggagtcacagctagtcagtggcagactggagacgtgaccaaactctggagtctcccttgagttcccttcctaggaggcagtggtgctctagggctcagtgtgtttctctgcttgtctttcttttttttttttttttgtcagcagttttaaatttgaatcttaatgtatctggaatgtggtcaaacattattaaatattttgaacggcactgacctgccattaccatatgatgatgttaccagctgagtgataattcagatttggcacatggttatgaggttaacatctcaagatacgacatgtaaactaaggtgtgttttatcccctgattatctccctcctccttctattataaaaccttttgaatggattatttttttttcttcgtactcttttcttaccttttaagttgactttattcaacttctagaacttgtttaagccctcttatttttcaatgaaaatggttttgtttacttatttttagtattattttatatttgggggtacatgtgcatgtttattacatggatatattatgtaatggtgagatttgagcttctagtgtacccatctacaatagtgagcattgtacccaataggtaatttttcaacccttataggtacttttcagtacctattatttctgtctttatgtttatgtgtacccattgtttagcttcacttataggtgagatcatgtggtatttgattttgcgtttgagatattccacttaggataatgactttcatttccatccatgttgctgcaaaggacatgattttcttttttatttctgtgtagtgttccatggggtatatataccacattttcttcatccagtaatcccttgaaggacaggttgattccatgactttggtgttgtgagtagcgctgtgataaacaaattagtgcaggtgtctttatgtatataatgattttttttttcctttgggtagatacacagtagtggagttgctgagtcaaatggaagttctctttttagttctttgagaaatctccatgccgtttcccatagaggttatgccaatttacattcccacctacaatgaaaagtatcccattttctctgcattcataccaacatctgttgctttttgactttttaataatagctgttctgactggtgtaatatgtattttattgtggttttaatttgcatttgtctaacaattagtgatgttgagcattttctcatttttattggctgcttgcatgtcttactttgagaaatgttggtttatgttctttgcctacttgttaacgggattatttgttttttcttgttgagttattttagttgcttggaaattctggatattactctttagtcagaggcataatttgcaaatattttctcctattctgtagattgtcagtttactctgctgattatttcttttgctgtgcagaagcattttagtttacttaagtcccatctgtctatttctgcttttgttgcttgtgctatcaaggtcttcatcgtaaattatttacctagtccaacacccagaagagtttttcctaggctttcttctaagatttttagtttcaggtcttaccattaagcccttaatccatcttggttaatttttgtgtatggtgagtaacaggggtcaacttttgttcttctgcatatggctagccaattttcccagcaccggtcaggcacggaggctcatacctgtaataccagcactttgggaagccaaagcaagaggattgcttgagcccaaaagttcaagaccagctcaggaaacacagtgaaaccctctctctacaaaaaattttaagaaattaggcaagcatgatgattcatgcctgtggtcccagctgcaaggggagctgagactagagaatcacttgagcctggtaggttgaggctgcagtgagctgtgttttccactgcactccagcctgggcaacagagtgagaccttcaaaaaaattccagcaccattaattgagaagggagtttttgccccattgtttatttttgttgactttgttgaagagcagttagctatagttatgtggctttatttctgggttctttattccatttcattgatctctgtctctttttgtaccaataccatgcagttttggtaactatagccttgaaatataattttaactcaaggaattatatgcctctagcttttttcttttttcttaaaatttctttggccatttgggcacatttttggttccatatgaattttaggattgttttcccaacttctgtgaaaaatggcattggtaattggatatgaatttaattgaatctgtagatttctttgggcagtgtggtcattttaatattgattcttgaaatctttgaggatgggatgtttatccatttgtttatatcatctatgatttctttcagcagtacttcgtagttctccttgtagagattattcacttccttggttaaatatattcctaggtattttattttattgtcagctattgtaaatgagattgagttttgaatttggttggtagcttgaatgttattagtgtacagaaatgctgctgatttttgtatgttgattttgtaccctgaaactttactgtagtcgtttatctagtcaggagtcctttggaggagtcttttgggtttctaggtataagttcatgttgtaagtgaagagagataatttcacttgccgttttccaatatgaatgccttttatttctttctcttacctgattgctctggttaggaattccagtactgtgttgaataggagaggtgaaagtgggcctttttgtctctttccagttcgtagggggaaagttttcaacctttccccattcggtctgatactggctgtgggtttgtgatacatggctgctaatattttgaggtattttctttccatgcctagtttgttgagagtttttatttatgagaggatgttggagtttatcaagtgattttttttatatctattgaggtggttgtatggtttttgtttctaatcttatttatgttgtgaatcacgttcattgatttgtgtatgctgaaccacccttgcatcgtgcagtagaagcaaattgatcaggatgaattatcttttccatgtgttgttagattctgtttgctagtattttggtgaggatttttgcatctgtgtttatcagggatatttttgttgttgttgttgttgttgttgtatccttccctgattttggcatcatggtgatactggatttgcagactgagttaggaaggaatgtttcctcctcaatttttttggaatagtttcagtaagattggtacccgttctttttggttgtaataattttattacaagttcaattttaatgctcattcttgctctttttaaggtttctattccttctttattctatctaggaaggcggtatgtttataagaatgtatccatttctttaagttttctagtttgtgcacatggaaatgttcatagtagtctttcatgatgttttgtatttccgtggtatcaactgcactgttatttttgtcatttttgattgcgcttatttgaattttgtctcttttatctgtagttaatctagcttgtagtctattgattttgcttatcctttcaaaaattaactttcaatttcattaatcttagtatcatttctttattctcaatcttatttaattttgatctgatctttgttactccttgtcttttcttagcttggttttggtttgttcttgttttctgttttcttgaggtgtgacattaaattattaatttgatatctttctttttggtgtagacatttaatgctgtaaattcttagtattgcttttgctgtatcccagaggttttgatatgttgtttctctatttttactcatttcaaaagatgttttgatatccactttaatttccttgttcacccaaaagtaattcaggagcaagttgtttaggttctgtgtacttttttgaattttaagagttcctcttggtgttgatttctcattttagttcaccctgcttcaataaggtacttgatatgattttgattttttaaaatttaccaagacttgctttattgccaggtatatggtcaattttgaaaactgttacacagatgacaaaaatgtttattctgcagttttggggtagaatgctttataaatgtccattaattagttccatttggtctaaagtgcagtttaaatccagaatttctttgttgattttctatctctctatgataatctatctggatatcccccttctacaaccacagctagtgctctcttgaaagcaccaccgcctggctggaggtcaaccaactcaatccattatagcaactcagaagagaacaaccctgctccaaagaaggagaaaacaatagctaattccactgccagtaacaccctggctaaccagaggtcctgagtctgactacgtgacaactttagtgctagcataattagcatttaagaaaaccagtgcactaaacatgaggacacaaaggcatgagaatagtataatggactctggagacttgggtaaaatcgtgggagtggggtgagggataaaatgctacccactgggtgcagtgtacactgtctggtgatgggtgcaccaaaatctcagaaatcaccactaaagaacttatccaaacatcgtaaccaaacatgacgtgttccccaaagaactattaaaattaaaaaagactaaatattgatttaacaaaaaaaaatccagtgagattagtgaagtgttgaaatctccccctaatattgtcttgctgtctcttttcttaagtttcgtaatatttgttttatgaatctgagtgcttgggtatagagtgcgtatgtatctaggatagttaaagcttgttgcattgaatgctttattgttttataatgccagtttagtatttttatactgttgtttgcttaaagtctgttttatctaatataataataggtactgctgtttgctttggttttccatttctgattattgccttgttgatgtttcttttgtatagtattttccaggtgttctctgtctttcttgtatatgatgtctatatctctagcaagatcaagtatttttttttcattattccttcaaatatatttttcaaatttctttttcttattatccctcaggaatgcctgtaagtcataggtttgatcacactacataatcctccaaggctttgttcattaaaaatattttttctctatttttgtatgactggctcatttcaaaagactggtcttcaagttcttaaattatttcttctgccttttctaatctattgtgaaagctttgaactgtattttgaaattcctatagtgaattttccatttacagaaattgttttttaaaaaacatatctgtctcatcctttatattatgaattgattcatttattattttgtgttggttttccactttctcttggatgtcttgtgctttcttatagtccatgttgtcaattctttatcatttcagaatttatattttggttgggatccattgatatacagcttgcatcatcattggagatattgaaacactttgtctttttgtactgctggagttcttgggctgactctatttcatctgaaaaagcagtcacctgtttttgaaattggtattgatttgataggacttttaaatttattattcttttctcccctgtggatatcactgtagggtatgttatatatgagcgtttggcattgtttctaggagctttcagagagccagtgttctgtttgagttccttggttattatcttgtacagtggctttctcaaattctggttgttgtggcaatgtatttggcgtatgaacccactcacctgctgtgggaatgagagtgtggatgtctcacaaagcttctttcatactctagcatgattcccttctgtcatcagattttttattttgtgttcccatttggtctccagttcagttgtaggcaataaagattgggtaaaccaatgatgagtgaaagcaccctccctgacccctgattggagtagagtagtgtgggaagttcatggtgagatgtgctgaggcccaggtgcgggaggagactacaccagcttgggtgcagacggacacatgatccacttctctatcatgctcctgtataagggcttgccatcttccattcacagagacactgtcctttatcttcagggcatgatgcaactgagttccatgggggtggggggatggtggggaggggtgtggcggggaacctatctggcagcagtaaaatggccaggggaagaacctcttcagtcagtccaaaacagatagatttgcagctggtctgccctccgatgcaaggacacttctgctgtgtgtagagagggagaggtgagccttgccctctgtgtgagcacaggcagcggacacacttttaatgaatgtgcagctattgtgaataccactgggaaggttgttttcaagtgcagtcatgccagcctccagagggaaaaaccttggctacatccatagcatggacaggggaagagggggtgaccctccttcacctccttttccaggcagccagtgctgcctatcctctgggacaaaacaatgctcccctcttttgaagacttggactttatctgtgtttcctttgtctcaggaggtgctttggcagcttgccctctcattttccataggaatggcacatgccatacactagatctccaggtatcccacagctctccgggacctactagtccctgtgtttgccaaagtcagagtgtgttctagggtgtgtttgtgggagatttagtgatgcagtaacataaaggctgagattccctggtcaaagcagtggcccagaatgggtacacaaccagtatggcacacactgcctcagttcaggctgcctcagttcaggcttgtgcagagtataaccacacgtgtgcaagcaggccatctggtgctctgcccccaagaagttctcaaactgccacagtgttgcccagacttgtgagggcagaggggctctctgacaatttggtactcagtaggctgttgcagggtgaaggggccaaagaattacttccacctaccctttttgagggactccaggttccttgcggatcagtctgccatattcttgctaccctccttttctgcaccacagatgcttcttgtgggttttccaactggttttggcactctgccctcagctttccagtagggccgtgattgttcacctatgatctcgtatctgatggaggagaacttgtatctgatctctgtagctagtgattttgaataaaaactacttttgaaaatagtcatgtaccacataaggacatttcagtcaagaatgggctgattatatgacactggtcccattagattataataccatagtttttctgaaacttttattatgattagatatgtttatatacataaatgccatttcttacaatatcctacagtattcagtaaagtaacatgcttgtagtaaagtacaggctggtagtctagttgcgacaggttataccatatagccatgatgtgtagtagtctatcccacctagatttatgtaagtacactctatgatgttcctagaatgataaaattgcctaatgacacatttgtcagaatgcatactcattgttaagtgatgcatgactgtatttataataaactttgacaaaaatacaagtttgtttggacaacattagagaatcaagacagtgctatcccttagaatattttgcgttgatagaaatgtcctaagacttatattgtccaatacagtagcccctagccccatgtgaatattgagtacttgaaatgtgcagtgaagagactaaatttttattttatttcaattaatttaaattaaaatagttgtctctgactagtacctaccgtagcagacaacaactggatagcgtatttctgaaaattagctgtggcactcatataatcagtaagtcaaggaagcaaaaaaatgacaaactaagagaaactaaagagacttatgttagtctttgtcactcactcagctctcattctcccctttcagtgctattttgatcattctttgtatattttgggtagatgtcctttgtcagatataggttttgcagttatgtcctcactgtcagtggcttgtctttttattcttttagcatggtatttttgtagtgcagaagtttttaattgtgataaagtgcaacttatttcttatttcatggatcatgcttttgttggtatatttacaaactcataatcaaaccaaaaatcatgatgattttaccttactttttgagaagatttttagttttgcatttttatattttagtttatgatgcattttgaattcatttggtaaaacatgtcagatctttatctaggtttattttcttttgcatatgtatgtccaagttctctagcaccatttgtgaaatgactatcttttttccattgaattcatattacttctttgtaaaaaatctgttgaatatatttacatgagtatatttggggttctatatttctttcttttacctatgtgtctcttctgcctaataccagagtgtgttgattattatagatttatagattattacagatttattatagattattatagatttatagattattatgattattatagaagtcaggtagtgtgagtcttactttttttctttaatgttgtgttcctttttgtgggcctttccatgtaatcatttttaaatttccagatgttttactgtaaattgataatttataattatatatatttatggggtacaatgtgatgttatgcttcataagttcaatgggatacgtaagtcaagctagttaacatattactctggtttggatatctctttcaaacctcatgttgaaatttgatccccagtgttttaggtgaggactaatggaaggtgttttggtcaagaatgcagatctgtcatgaatagattaatgtcttccattagagagtgagtgagttctcactctattagttcccaggacagctggttttttttgttttgttttgttttgtttttccatcttttgattcttctcttaccatgtgacctttgcacatgtctactcccctttgccttcgactttgagtggaagcagcctaaggcatcaccataagctgagcagatggtaacaccatgtatcttgtgcagcatacagaacatgaacctaataaacctcttttctttataaattattcatctttaggtatttctttataacaacatgaaatagattaagacaaatatctgttaactaaaacgcatttgttatgttaaaaaattgaaatagctgggcacagtggctcatgcctgtgatcccagcactttgggaggctgaggtgggcagatcacgaggtcagattgagaccatcctggccaacatggtgaaacctcgtctctattaaaaatacaaaaattagctgggcgtagtggcgcgtgcgtgtagtcccagctacttgggaggctgaggcaagagaatcacttgaacctaggaggtggaggttgcagtgagccgagatcatggaactgcactccagcttggcaacagagtgagactacatcacaaaaaaaaaaaaaaaagaaagaaaagaaatatactctcttatgaatttccaaatatgtaatactctataattaaccatatttatcatgaggtgcaatagatattttttaaaacccacatattccttctgttcatctgagattttctaccctttgaccatcaactccaattccctccacgctccaatttttttttcctgtaaaagcactctgttctctgcctctatgagttttatttctatagattccatatgttagagagaacatgtagtaattgtatatctatgcctggcttattttacttagcataatgttctccaatttcatgtagtcaaaaatgacaaaatttatttccttttaagcatgcatattttgtcattgggtatatataccacatttctttattcatttgtgtgttgttgtacacttgggttgattccatgacttgactattgttaatagtgctgcaacatacatgggggtgccgacattcctttgacaaattcaaatcttttggataaatacacagaagtgggattgcttgatcacttgtaattctattttttggttttttttttctttttttgaggaatctctgtaaagttttccataatagctgtaataatttacattcccaccaagagcgtacaagggttcccttttctccacaaccctgcaacacttgttatcttttaactttttggtagttgccaattctgaaaggtgtgagataatatcttattgtggttttaatttgcatttttcatgattaatgatattgagtattttttatatttctgtttgctatttttatttcttttttgtgagatgtcaattcaactttcttgcccatttttttgtttttgtgctgttgagttctttcaatttcttacatattttagatattaaatccttctcagatgtgtgccttgcacaaattaacagtgtgattttcacactgttaattgtcttctatgctgttcagtagcttttaaatgtgatgtaatcctatttgtctatttttatttggttgcctgtgcttttggggtcaaatccaagaaaaataattggccagctctttcttatgtaattattccgtgatttttttttcttcttttagttgaacaatttctggtcttatgtttaaatcttctatccattttagggtatgagttttgtatacagtattaggtaaggatccaatttcatttttctgcatgtggatattcagcttttccaacactatttattgaagaaacagtttctttccattgagtattcttggcatgtttattgaaaggcaatagatcatacgtgtgtgggttcatttctggtgttttaattatcatagctctgtggtatacagaagtttgtaattatgtagtacaataacttcagctttctttttttaactcatgattaccttggttatttgagggttttattggtttcctatgtaaattaggcttaattgtatttatgtgaaatatgatattagaattttgatagagatcgcattaagtgtttagatcactttgggtagtatgtgcattttaataatattaactcttccaattcatgaacatggaatatgttttcatatatttgtgtcatcaatgtctttcatcaaagtattttaagttttagtatactgatttttcctctccttaattatttcttgatttcttttttagatagtttgttcttagtgtctataaatgctactgatttttgcctgttgaatttgtatcctgtagctttacagtatttacatattatttctaacaatatttttggtggtcatttcctatacgtaagatcatgtcatcagcaaatatcaacaattttacttcttccttttctattcagatgacttttttttttctcttatcttattgctctggcaagggtttagagtactttgtttaatagaggtggtaagagtgagtattattgtcttgttccagatctcagaggaaggacttcaattattcaccattgaatataaatgttagctgtcagcttcttacatatgggcttcactgttgtgttgaaatgcatgtcttctatacctaatttagtgaggttttggtgatgaaagtttgttgaattttgtcaaatgctttttctacatttaatgaaataatcatatggtttttgttctttattctgttaacatatttattgatgtgtgtgggctgaaccatctttgcatcccatggataaatctcacataatcttggtggatgatacttttagtaagttgttgatttggtttacatttgttttgatgattatttttgcatctgtattcttcaagtatattagcctctaatttgtgcacatgtgtgtctgttttgtccttgttctggctttagtagcagacagttcttgcctcttaaaaagagtttggatgtgttcatttcttttcaatttttttggaagagtttgagaaagatagatattgtttcttctttaaatgtttcgtagaattcagcagtgaaggcatcatcaggttttctttgctggatgaactgattcaatctcatttgttattgatatgtttgcattttgtatgtcttcatgattttgtcttttgttgttgttgttgttgttttagtttttatttccaaaggtttgggggagcaggtgtggactagtgagggttctctagagggacagaactaataggatatatatatatatatatatatatatatatatatatatatatatatatatatatatatagagagagagagagagagagagagagagagagagagagagacagagagagagagagagagagagacagagagagagaggagtttcttaagtattaactcacatggtcacaaggtcccacaataggccgtctgcaagctgaggaagaaggagagccagtctgagtctcaaaattgaaaaactaggagtccgatgttcgagggcagaaagcatcgagcacaggagaaatatgtaggctgagagactaagccagtctagtcttttgacatttttctgctgattttatattctagctggcagctgataagatggtgcccaccctgattaagggtgggtctgccttctccagcccactgactcaaatgttaatctcctttggcaacaacctcacagacacacccaggatcaatactttgcatccttcaatccaatcaagtagacactcagtattaaccatcacaagtccacgccttctcaacgtgaactcatacacatctcctgaggttatacataatcttcaaataaagacaagagtaaggtcataattactcctaacataataccttgtacatccagaaatgcatcaatccggaacccaaatactattacataaagttagcaatacttaaatactgatataaagtcaataaatcttatgtcacatgataaaggagaaagaaaatgaaatgaagatattttcgtagtacaagtatacacaaacatgtttttaacaaaagaaggaggaaatactcatgacaattccagtccttgtttcttcagctggtcatgtgttcgtaggtggtattgatgactaccttctcctactacccattctgtattctatttgccttcagcaagtacctcagcaggtcatggtttttttcctggtggagtgacccaaactttcattcttgaagggtctgggacatttgtagtcctgcctggattgggctgttgtagtttcccattgaccttaatcacagggcatggtaatattaagagacaccctgatagatctcctatatatcatgcatattcttccttacctctgttgtagagtagtaaactgatttcatcttgatagtccgggtcaatcaccccagccaacactgtaactcccttcttggcctgttgacctaaaggtaggaggagcccaaagtgtccaggtgccaatgttaacttctagtttaatggaatcattgtgcttcctggtggcagcattcctccctctggaactaagacctctaggccagcaaaacgtaaggtcacgggagcaggaagcaaaaattttgctagtagatcactagaggtgatggtcagtggtcccacttccacttccaccccttgattcctggaccgatgaatcctggctttgggagaaagagcaccatatattggacgctgattcagagtatacacagccttctggagaactttgcctcagccctgcaaagtattgtcacctagttggcattgtaattgtgacttcaaaaggccattccactgttctataaatccaggtgcttcaggatgatgggaaacatggtaagaccagtgaattccttgagcatgagcccactgccacaattttttaggcataaagtgagtgccttggtcagaggcattgctgtgtggaataccatgatggtggataaggcattccatgtgtccagggatggtagccttggcagaagcattgcatgcaggataggcaaacccatatctggagtaagcatctattctagtgaggacaaacctctgccctttccatgatggaagaggtccaatataatcaacccaccaccaggtagctggctgatcaccccaagtaatggtgccatatggaaatctcagtgttggtctctgctgctggcaaattaggcactcagcagtcactgtagctaggtcagccttggtgagtggaagtccatgttgctgtgctgagcccacgtataacctcagtacctgccaccatggccactttgttcatgggcccattgggcgataacaggaatggctggggaaagaggctgagtggtgtccacagaacgggtcatcctattgacttgattattaaaatcctcctctgctgaggtcacccattggtgagcactcacatagcatacaaatatcttaacagtttttgatcacttggagaggtccatccacatccctcttccccaaatttctttgtcaccaattttcctatcatgcttcttccatgtccttgaccatccagccaaatcattaatgacagcccatgaatcagcatataattgtacatctggccatttatctttccatgctaagtgcataatcaggtgcactgcttgaagttctgcccactgggaagatttcccttcaccactgtccttcaggaatatcctagaaagaggctgtagtgttgcagctgttcactttcaggtggtgcctgcatatcgtgcagaaccatctgtgaagcatgtcctagttttctctttctctgtcaactgatcttagggaacttcccataaggccactggtgcaggcttggggagagaaggcagggtggccggagtacagaccatgggcatttgagccacttcctcatgtaacttccttgtgccttcaggacctgttcaagcctgatcacatatataccacttctatttaatgatggaatgctgctgcacacaacccactttatggctagatgggtcagaaagcacccagttcatgataggcagtacaggtggcatggtgccttgatgacccgtaggcaaacattcagtttccaccaaagcccagtaacaggtctagagctgtctctcaaaaggagaatagttatctgcagaagatggcatggccttgctctaaaatcctagaggactctgctctgatccacctatgggggcctgcaaaggctccagtaagcctccctatctgccactgacacctcaagcaccatgggatctgctggatgatatggcccaagtggcagagcagcttgcacagcagcctagatctgttgcggagccttctccgcctggattccactccaaactggcagcctttcgggtcacttgataaatggcccagagtaacaaagccaaatgacgaatgtgttgcctccaaaatacaaatagacccactgggcgttgtgcctctttcttgcttgtaggaggggccaaatgcagcaacttatctttcaccttaggaggaatatctcaacaggccccacaccactggacccctagaaattactgaggtagaaggtccctgaaattcagttggatttatttcccatcctctggcactcaaatgtctcaccaataagtctagtgtgtttgctgcttcttgctcactggatccaatcagcataatgtcatcaatgtaatggacaagtgtgatatcttgcagaagtgaagtgatcatggtctctctcaataagattatgacacaaagccagagagttgatatacccctgaggtaggacagtaaaggtgcattgctggccttgccagctgaaggccaattgcttctggtgggccttatggacaggaatggagaagaatgcatttgccaaatcagtgtctacataccaggtaccaggagatgtgttaatttgctcaagcaataaaaccacatctggtacaacagctgcaattggagtcaccacctggcttagcttatgataatccactgtcattctccaagagccgtctgtcttctgcacaggccaaataggagagttgaacggggatgtggtgggaatcaccactcctgcatcttttaagtccttgatggtggcactaatctccaccatccctccagagatgcaatattgttttttatttaccatttttctaggtagaggcagctctaatagcttccattttgcctttcccaccataatatccctcactctaccagttagggggccaatgtgggggttctgccagctgctaaatatgtccatgccaattatgcattctggcactggggaaatgaccacaggatgaattcagggacccactggacccactgcaagtcagatctgagctaaaactccattaattacctgatctccacaagtttctactttaaatggaggcccacaatgacgttttgtgtcctctggaatcaatgtcagctcagagccagtgtccagtagtccctgaaatgcctatcatttctctttcaccagaagtctccttggggaaggatggaagaaatattaacagcataaattgtcagtagtgtagtggggtccttccttaaggggaccgggactccccttcattcaaggggtactgggtctgtaaactggatcaagtctggaaattgattgaggggccatgtttctctgtttttataatccaaattggtcttttgtccatttgacctagaagttttctgcttatgtaaattaaggaggaatgcaataggcttcctattaattttaattctaggaacactgtgattaattagctaatgcccaaactctacacaagtcagagtatttttaatgctgctttgcctctgctgtttattacagtagctatgctcaccttgattttgatggttcagtgccaccacttggcttctgctgcctgggatccaattattcccactgtatttaaattttgtagttgagtgactgtggttcccaccgttagatctgacatatggagaagagcaattacagggttttttaaagatgcagatgctgccctcataaacttatttcacaaggcattggtcaagggtatgtcttctagacactcccagccgggatgagtatgtctaaagtgactaacccacttcatcatcccaatctccctaagtcttgggatctcttcctctacattaaaccaagggagatcagacattttcagctcactcagtgtgggacatattttaatccatattttagctaactaagcaaataaactattaggattttttatttttatctatttttattattattgttattattattatactttaagttttagggtacatgtgcacaatgtgcaggtttgttacatatgtatacatgtgccatgatggtgtgctgcacccattaactaactcatcatttatctatttatttttttttgagatagagtctccctctgacacccaggctagagtgcagtggcacaatcccagctcactgcaacttctgcctcccaggtttaagtgattctcctacctcagccccctgagtagctgggattacaggcacccaccatgacacatggctactttttgtatttttagtagagatgatgttttcccatatcggttagtctggtcttgaactcctgacctcaggtgatctgcccgtctcagcctcccaaagtgctgggattacaggtgtgagccaccatgcccggcctattagaatttatttttaacttcccgatctgcaacattaaatgcagagtccctacttagtgggcccaaatcaatcagttcagcctgatccaactcaatgttccatccatcattatctcacacccttaatattcattcccatgcttgttatccagatttctgcttatatatattagaaaactcaagcagttgttttcaagtgtagcatacctcctcatgggtcacactctgaaccttacctctaggagcccgctgggactctattctagttataggtctagaggcaaacaggtattagggttggcttgtgaagataatcaacattatcttgcctggcaactgcctcaggggaggccatgactgttgcctcaggcagaacagggtttatttccttagacaaaggtagaaaggctgatggcagcatgggtcggggaggggatgttgccactactagggatggggaagctgtttcttttggcaaaaaaggtgcatcagtgtttacaaagtcagcgttcccagcttcatcagggtcctcccacacatcctcattccaagttttagggtgccattcttttccaatcaatgccctcactttaacagtagaaacctggtgaggctgtgcatgcacctttcactgcaggtcagccacttgcatgataagagctcgtgtcctgttttccacaatttcagctctttctctataggaggtaagactctcactcagggcaatctaagcagatttgaggcttagtgtctgcttctgaaacagggagttgcaatccctgagttcataattttctttcatcactttgtccactgaactaggagcaaccaaccagcttcattgttttttggttctctacatacagtcaaagatattatgtgcagagtcactaaactccttgcctcacatgagctgtgaatctggaatgtcaaatgcatttagtttgtataactctccaaacagtttacaccaaggactatcagtgttctccatactattagaagtagagtccttagcattttggggtttaatcatattaagcagtcaacttcagaaacccccgaaccaatgaaagaacaccatccttaatattctgtttctctagaaccactcctggtaccaaaatctgtattagtcagtgttctctagaggaaaagaactaataagatagttagatagatataaaggggagtttattacgtattcactcacacactcgcaatgtcccacagtaggccagctgcaagctgaggagcaaggagagcctatccaagtcccaaaactgaagaactcagagtccgatgttcaagggcaggaagcatccagcatgggagaaaaatgtaagctgggaggctaggccagtttattcttttcacatttttctgcctgctttatattctagccacactggcaactgattagatggcacccaccgagattaagtttggttcacctttcccagcccactgactcaaatgttaatctcctttggcaacaccctcacagacacactcagcatcaatactttgcatccttcaatccaatcaagttgacactcagtcaacacttaatcatcacaaggtggtatttggttacatgaataagttatttagtggtgatttgtgagattttggtgcacccatctctggagcagtatacgctgaacccaatttgtagtcttttttccctcaccctcctctcaccctttaccctgcatctccaaagttcattgtatcattcttatgcctttgcatcttcatagcttagctccaacatatgagtgagaacatatgatatttggttttccattcccgagctacttcactcagaataagtctccagtttcatttaggttgctgcaaatgccgttaatttgttcctttttatgactgagtagtattccatcataaatagacacattgaccaatggaacagaatagagaacccagaaataaacccaaatatttacagccaactgatcctggacaaagcaaataaaaacataaagtgggggaaaggactccctgttcaaaaaatggtgctgggatcaatggcaagccacatgtaagagaaagaaactggatcattgtctgtcaccttatatgaaataaactcaaaatggatcaaggacttaaatctaagacctgaaactataatgtcttcatttaatcttctgaaatttgctgaggcttgttttgtttcataacatatgatttattttggggaatgttccctgcagtctttagaagaatttgtattctgttgttatctgttggttggaagattctatacatgtctgttagatccattttgtctacaatgttttttgaaccaattactcccttattaattttctgtttataagtagagtattgaaagtagggcattgaagtcccaccttgttatttaattgtgatctatctctcttttcagttcttttaatgtttgttgaatatatatttagcttttccaattttgggtgcggtgcatatatatttacaactgatataactttttgatgaattgacctcttatcattatattatgtccctctttgtcttttttttttttttacaattttttacttaaagtctattttttttttaagtataactatgctgtctatcttttgagattcacttgtgtggaatatcttttatattccttcactttcagttatgtgtgccctttatagtgaagtcaatctctttttagtaacaggtaggtattttttttaatccattcagtaactctatttctttttgttgagaaatgtaataaatttacattccaggtaattactgacgagtaaggacttactactgtcactttgttttctgattgttttgtaggttttttttttctttctctcttgcagtctttctttgtggttccatggttttctgtagtggttcatgctttaaatcatgtgtgtaattcctgctttgaatgcaggcattcatgctttgaattcattctactttttttgtttgtgctctactaaagatttttgcttttttattaccatgttgtttactagaacatcctgtacttattgcattctatttcagtctgataagaacttaaattttattgtatacaacaactctggactgttactcctcccttcacagtttatgtttttgatgccagaattggtaacatttttattatgtatcccttgataatttattttcgctatagttgttgttttgcattttaatgcccatactaggaataaaattgcattacacaccttacacacacatcattaaaatcctagagtactctgaaaatgttgttttacttataccattaggttttgtgcttttgtatgttattgttgcaatttaaatattaataactcccattaagattcctgtaaggcaggtctagtgatgttatactcccttagcttttgtttgtctacaaaagttcttatttccccatgactctgaaaagacagttttactggataaagtattcctcattcgcagttttcttttttcttcagcactttgaatatattattcaaatttctcttggcctgtagggtttcttctaagaaatatgttgacagttctattgccattcatttgtgtgaaatgtttgtcttgtttcttgctactctcagaatagtttctttgcttttgatagtttgattattatgtatcttgttgtagtcctctctgggttgaatttgactgagctctgtgcttcccctacctgggagtttacatctatccttagattagggaagtcttcaaccattatttctctaaatatgatttctggctgctcttctctttcttctcctcctgcaactcttattatgcaaagacttgttctagtgaaggtgtctgaatttttaagaggctttctttattcttttttattcttttgtctttttgctcctctgactggattatttcaaattgtctgttttccactcactgatcctttgatttgtttgttctattccgctgtttgagctttctgttgagtttttcagttctggtgtattttttatctctaggattcctatctgattcttttttattgattctatttctttgtcaaactaatcatttttgtgtattgttttccaaactttattacgtttttcatccatatatccttgtactttactgagctttttaaatgagcattattgtgacttctttttcagtcatttcaatgatatttatttcttttggatttactattgtagctttattgtacatttggagatgttatgactccctaattcctcataattcttgtttccttgcattgttgtctgtacatttgtggagacttccctctcttttgtttttaaggttttttgtttgtttgtttgtttttttgtcagggatagatcttaactatttaatatagcctgtgattctggaatggcactctggtaataaccctggcctggtagagcttgctgtcggttttccagttggcttggctgctactttagctgtgatgtcaggtggagcttctggttgggctctactatcaggcatagcttctgtctcaggactgcagtgtcctctggtcaggctggtcacagcatatattacctggctgggcaattctgctctttgcaatctgcagttgggcagggctgcaggctgggctttgagttaggtgcagctgctacttggagggacaaataggaccagagtctatgctcattagaactggaagactgagaatagttttcctgttaggttgaagccatggggtgagcttttggctaagttgagtggctgtttgactttccaggtcaaaccagtgtagcccctttatttctctggaatgtatggaggtagaagtctccctggctcagcaaggtcattgggtgggcttttgtgctgagtggagctactgcataacttcccaggtcaaatcagtttagcctttgtgctttttgtaaaatatacagaggtgggagtcttcctgtcttggtcaatccaagggcatggacactagctgcctagggacccaaggtaagttaaacttcccaccatatttttgaaggcaactaggtcagttttttaagtgcactgagaagttgacttgtaactctaatctggtgccacaactggcaggaaaacagagcaaccaccaagattcatgcgctagtcactatgacctgcacttccttcctttgtttctgtctgagtctgagtattcttgccattctgttttccctagtgttctccatgaggtgaatttagcatggacttcctggaaagaatgttggaattctagggaagctggatgactgcctgtcattttcttcttcctttgtagaaactgtgggtcaggaaaatcctctctgtctggtattgtgccgacttggggaagggaataaagtggtttagttgaactaagaccattcttcttacccttctaagtcagatttaattctgttctatggaacatatggatgtttcagacatatttccaagtattggaattttcagaaggttattgtggtctgtggaaagttgctaggtgaactttctgttgggggtggggaagtggaacttgagactttctattttgctatcttgctgatgccactatttatttagtcttttgtatcagtattaatgtatatacaatagcgtactgacattttgattggaattgtgttgaatttatagatcaagttgggagtaatttattccacagtgttgtcttctaatccatgaaaacactatttctaaatttatttggatgtttgatttgttttatctgaattttgtagtctaacatatatagattttatacatattatgtaacatttacacctaaatgtttaattttttggtgctattgtaaatttaattgttaaatattaagagtacatttactaaatgtttattgccatattttgagttttgtgtattgtgactttgctatagtcacaatactatagcaccaaatacacaatactatagcactatttgctatagtcatttattggtttcgggaattttttttttctattgtagatacattgtgattttcttcatagacaatatgtcatgtgcaagtaatgacaattttatttctttctttccaatccattaaactgatctttctctttcttgccttattggtctgagatccagtacaatgttgactagaagtggtaggagaggaattccttgccttgattccaatcttgtggaggaaaccttctagtcttttaatgttcattttgttggtttaggtttttgtaaacatttttattcaagtcgaggaatttctacaatagtaattcttgatttctattgtctgaaagattttatggtgaattgctgttggatttcgaaattttatgcattagttaataagttaatatgtgaatttttttggcctgcttatgtggtggatttcattcatgtttcaaatgttgaatcggccatacatacctagattaaatgtgtgctacatgtttatttattatattttttttgtgatggatagattgaaataatcttttttattataaataaatttaagtaatctaggataaaaaatagcttcaatttttattcaaattgggtttagattgctgttttagtaccattttgtcaaggatttctgtgtctatcttcataagaggtattggtccataatttttctttttgtactattttttctggtttggtattaaggtaatgctggcatcataaaatattttaggaagtatttcctctgcttcttctttctggaaaaattgtgaggaattggtattcttttttcttaactatttggtagaattcaccaatgaaactactgggcctggtgctttctttgttggaagtataattattgattcaacttctacaacaggtataggattattcaggttatgtatttatccttgtgtattttggtagttttgtgtgttttgatagttttgtgtgttttgatagtttgtgtatttcaagaagtttttttcattgtaactaagttataaacttgatagatgtagccttgttcatactatttctttattgtccttttgatgtttataacatcagtagaactaatgattttctcaaactacagatctaagtagtgcaagaaacactaacaggataaatactaaaagtgtacatttagtcacttcgtattcaaactgtggaaaactaaagacaaattgaaaatcttgaaggcatccaggggtggggggtaaatgaaaaggtacctcacctctacaggaacatggataagaaatacagcaactttctcaatgctaactatgtgaacaagaagagaatggaatggattattgaagtatagaaggaaaaatgaataatttcatatctaataaaattatctttcaaaactgaagaataaacatttttaaacaaaaagctgaaggaaattttttctagcagacttgtccataagaaattttgtaatctatagaaacttctgagatcaaggaacttggaaatgggactatggtgaacagaaacacagagatgcataggtatgctaccatgatgtcagcattgagaaagtatttttttgttcatgtggacatagtgtgtatttctataaagttatatctaaaactgttcaagtaatgtttccttgttgatgctactattatggttcagtctagggtgaccctcaaatatttgcaggatggggatcaagatgacaaaatagacactcctattatttgtctaaatatttcctatttataaaatcaatagaaaattattaaatatatattagacccttttaaaaaggcacactgaataacatggctacacactcaataacatggctaaaattagaatgaatgataatatcttgccctgtgaaaggtgtgtggagcagctggaactctgacacatttctagtgaaaaagtgccttagagaacggtttgtcatttcttataaagttaagaaatgtactaccatttaatccagaaaatgactattgatactctcaaaatatagatgactcttaaaaaacactatgctgagggaagggaatcaggcacaaaaggctgtataattctatgtgtacaaatgcgagaagaaaaaaatataacttatagtgacaaaaggcatatatcagcaggtctgagaatttgcgtgggcttcacacagaaggagcacaaggattcctttagagtacaatgcatattttctacattttaattggagcagtgtttacatgggtatatacatttgtctaaactcattgaactgcaaacaaaaaatattttttattttattgcatttgaataatactttaaataaaggtagtttgaaaaaatgtttcttaactaagagggccaagaattagcattaaattagtgacagatctgggttttatattttcccctacattgcttgaaggtgcacataaatagaatctacatcattatattttaaaagagatttaatcattcagatgagaccaatctggtttccatggatgataaggaagctgtatatctgttatacagatgtgattaaaaaaagaagttaaaaagagagagatatgtccttaggtttctagccaaaaggaatatgttcatagtctttgaacaatggattcagaatttgaatcgagtatatttcctattttatattaaattactctgatgtagcaatgtttgctgttttatattttgttatagatctgcgtacaacaaataatattgcaaataaagccagtattaagtggacttcatttcctacagaaataattatagttattaaaaaatgacttcttttcattagatgagatattttgattttttgatgcctagaccacctgttttctattctaaccaagaaaagtcatggaattagaaagtagtaaaatatatacactattcttgtaatattacatacctctcacttgtagggaaagtttaattaattttaatagatatggattctatgatttaatatgaaaaataatcagtttggtattagagacattttaaatcaatgaccatgaggttaagttaaatcgattaagaatatattgtgctctgaaaattcttcaatgaaatgtgatgcccttaaattaattttaaatgtataccatagttttgattagatgagattctgaattgagttttagattgctgtagaacaaataatgaaagtaactacatcaaaaggaatactacataagcctttctggagagattttgaacatttagtggtaaatattaataacaaactctgagggtaggctgcctgggtttcattagaatgtcacttagtaactgggaaagcttggaagatgagtgagcacaaggggctttctcttttatcacactgagatgattataaataatgcccatcccatagacttgttatgtagcttaaatgagttaatatatggaacattttagaacagtgcctagcacatgagcacagcataagtgttacctctttcgttattgtatatgttggatgggaacacaactggtcattgaaattttctagtggtactagcgagaaaggatatcagagaagaaaatgaaaacttttggtaggtgaggtagagctatggaatatgttaatatttaggctaagatgcaagaaataaaggtaaaggttttgtcagttttcttactagcatactccaagaatcacaaatagaggcaggcaaatagtagtcaacaaatacttgttgaattgaattgatctttcccaaaacttaatgttcagttatatctgaatagttataattaaatgtgtaatttacataaaaatagaacttggaactatttactgaaaggctactgcaaacttaaaaggaaattatgaattagataatctgcatgtacaaaaacgcaaaaaagtggagcaaagaggaggtgacaataagtcattctcattagatgggaaaaaatagaaagggatggaaaaactctaaggaaaaagattttttgtcaatcttaatgaattaactgttaaacttgacgaagtttggtttcatcttccctgtttcctttttgtaatgtgaatcactaaaagatgaccagtaagaatggaggttggtaaataactacaggaaaactaaattttataactgtgctttggacccccactcatagcttgctttaaagtcccaggaaaaaatctttttataagagtagaatgccttcatttaatgacctcagattctttcttacaaagggtacaatctaccttctgtaatacctcagcctggggatccatgactgtttttcagtgggtgaatatccattcaggagggagcacatgaggtctgttaatagccaaaacaatagtaagttgctactatcatgtggttctgtttagttgggtgtggttactgaagacacaaagccaatttattgcatcactctcccttccctgctctttcatcaatctactttttcccaagaccacataattttacttttggaattatcataaatgattactaaaatcatggagatgaatttgcaagactgaattgcaaggtaaactcaactttattttgtaactaaaggacagctagggtaaaaaaaaaatactggtgccaaacaattctatattcaaaacatgtttgtgcattagaaataaattaatgggccaggcgcggttgctcacgcctgtaatcccagcactttggaaggccgaggcgggcagatcacgaggtcaggggatggagaccatcctggctaacatggtgaaaccccgtctctactaaaaatacaaaaaatcagctgggcgtggtggtgggcgccggtagtcccagccaccagggaggctgaggcaggagaatggcgtgaacccgggaggcggagcttgcagtgagccgagatcgcgccattgcactccagcccggacgacagagcgagactccgtctcaaaaaaacaaaaaaaaaaaacaaaaaaaagaaagaaaagaagaaataaattaaagactggtaaatccacaatcttgagattttgtgattttctaattctgtaagatgtatatgtatgtggtttttgaagaatgcaaggtaatgtgggcttaacatgcaatgcatgtaccaatggaggttgacttttttttattcacttgggggtctcccatatgggagtgcatgaaataccacagtacatgggaaaaaagaggccagagtgaagaaatagcgatatgaggcaaaaaaacaatatctgagggacaataatgtttttattatgctgcaatggaataagaacccatatttgatcaataagcaatcttaaaggtcatttctaaaagaatactcagctgcagcttaaaagataatttttaattactatttttacgtctctggactataaaatttaaaaaaaagtttcatattagtttagtgatgcaaggagaaaatattaaccgaaaatttaacaatataatgatatatattagagttttccctccccagtagcatgaataaagagccactaagcataaattgcaatggtacctaatgggtagtattaacccataatataaatagatattaaagctgttttaaaaagtgaccactgatacgtatttctgtagagatcttaactgatttctagacgttggaaggctactgtgccataataaactacttttttcttgcttgaataaattcacactaaacattcctcagaaggttcatagttatcttgaaagtcaaacattattgcagaatcttcagaagtaaattaaaaccacattgattttgtttaaagtagcacaggatttaaactagcagtgtttatgtaaggaaaattaagtacctccataagtagttgtgaagaggtgaagaggaaatatcaaatattataaaacaaaaaaaggagagtcaataaagatattttagaccttctaaaaatataggaagaagtttgggtatgtgtgtgtagatatggatatatatggtcatacatatagtcatatatatatccatatccacacacacacgtgtgtgtgtgtggatatggatatatgtgtatatgtgcatatatgtatatgggtatatatatccatatacacacacagaaacttttagatttgcatatatttctgcatacatatgcagaaatataaacctgcattcatatatgtatatacataaacatatgatatgtttattgcatataatcaggtaaaattttaaggattttaagaggaaactataaatagggcaagtttattacttatccttagagcactgtgttatttcatattggtttacaattctataatgtaatcttttctacaaaagtaagtacacacgatatgcccttgaccttatgatgtaaccgaaattattttattaaagcaaggcttacataaaaaaggccagggtatgtttgacaatgttctatataggtctgatgagttgtgagaaagagtatgttcatttaaaggtgtacctactggtaatttagctttgtgttgatgtttataacagcaattaagttttggaactagcatatttctttggcatactcagtaaacacttattaaataagtgttgacttattgttttgaattttttagttcctagaatatttaaatacttgaaaaaggatcaggaatagtatatgaccaatttcttaatttttaatggcatgcttgcattatttagttagcacattcaatttaattattttgattattaaagtaggttttccttcttatggtgtattattagtatcctggttctttttattagtattaactaacagaaaatgtccagaggcaatgaaaaacgcaaaacccagtgtaaattaataatgaacagcaagatttataatgattgtgagtaaatacaaagatcagcagctggtttatacagatggtcaataaaatgttggaatgtccaaaacataaacataaggggtgatggtaggaggcgggtagtgattagatatgtgatcactgaggttaactgttagttttggtagaacatggagcttttttttcttccactagaaatttccttcatgaaaaaaattatcaaaatgctccaattcaaattacaatgcctcttacagcatgtatacctcagtttattttgatagcctgaaatggctgctagagcatctgaaaaatatctgatttaaaaatcaagtaatcatttaggtcataagacatttaggtccattatttgacagctaaattgaataattgatataatttcatatttctgaatttactggtaaaatatgtgggcttcctctcagaattacatctagtcatttggaaatgcaaatcttacaaatatttattagccttattttattgtttttttagcatcacagagatcagtgatattttaaccctacctcaagcaatatattctgattaatatataaaattaaacaatcaaattgtacttttaggattccactatatgtgcctcaccatcctaaactaccttttatggtttttgtatccccgccatcccaattaccacacacaccagagtacacgcatagatacagtaccttagcaaaccatattctatgaaaactgacaaagtgattatcaggaaagaaagcaaagtatgctggtcatttgaactttatccctattttggccctcagaaatgtcatgcagttaattttttcttcttcttgatattgtgccagtaataataatcagtaagaaagtcaaccccatgcccagcatgaataggtgagtactaaaataaaataatacctatataacaatcaatgcaatgtaacagcgaaatgtcttgagacatgtaaaaatgtgtgttatcatcactttacctatagcaattttcaaagtatggggtttgcaacccaggaaatgtggaagatgcttcactgaagtgggaaaaatgaaacacttttattttatttttatatccttatatattatatataatacgtaaagatacacatcatctttatatttatctttatattttaccttttaattttctatttttgagttaaagtgatacctatgttaattcccagcaaacatgattcattacaaattcatactcaaacatttttaattgattaatgaacatggggcctgttgcgagaggactgttaatgtactcctccatgagatctcctgatcatcaactttccaatcatgttctttgcagttcccttaccagctggcgaacctgttagctactgctcatggtttagttcaggttcctacctcaagccatctctcccttcacacagtgctcagtcaaatttcccctctaaatttctgcctgatggaacgatttcctttcactcactgacttgcaggaccatgcatcagtagggttataaagaagcaactgctagcagttgctagcatatcggtgaattcttatttaatctaagcttgcaatttttcttcctttattaactggtcataaggtactccctgtgaaattatagttgtggttgagagagccaaccttagcaaccccacagagaagaactatggaaataaatgccttgacctcattcatcttctgtctcctaatactccatcattgccttaccaaccaggagtcaaagggaaagggaccctggctggtatggacatagaggtcagcaacccgaagcagagagctggagatggtgcagtcaggcctgtggagccaaataaatagcattcagcacaaccgccctcaacaaagtttcacagtccagcattagatttaattttataaattaaaatactttagagtatttgaggtgatccatttttctcttcacacttagtccagtattattttattgataattcgtaattgcaaattttgtgaaagatatatatattttttacttccaaaaaggacttgttagagcctgctaatacttgcctcatgctttctgtgactaaattaatgtttggagctctgttagatattttatgaaggtttataataaataaaatgttacatccagaaattattttaaaaatatatgtccacttcctaactagatgcatagtcaatgaatgcagtactcttttctttatgacaaaagtgagtatatttttcaaacatgatgaatccagcatgctgctcaaagcttactattttctatctgcggaataactcacaatgaatattggattatgtaaacagcttctgtaaaatggcccttgttttacttgagatgtcctcttccaaagggcttctcaaaacatctggcagccagattggtgcttttgtttccaaagaattcatggttatttcaaaaaaaaattttttttggcaaaatgggaagaatggggaagataaggatatttcctgtataaagctgaaactaaggccattactggagccattgcaagataagggccttttaaatattttttattgaggaagctcattcttaatacagaagaaaataatttcatatttcagcataattttattatcttagtgaacactttaaaagttgggtcaatggtttccaggaaacatttgtgactgtaacatgtgccaaacaacctcttattgtatataagaagcgtatgagcttaatgtgtattagtagaatatattataaggatgattgtgaaaggattggcaaacatttttatagtaatataggagtatgctttttcctaaaaaggaaacaaggaccttgctacttattttttctcagctactaaatattttccttttctgtaaattgtaatgaatttcctgtgaggaacttatatcctagaacaaatcgtattcctttataggtgctcctctgcccgcttctcatcttatgtccattaagaaactgtctcttcatggaactctgatcctttctttttcattccccaacatctactgactccactttgtacctgtcactataaaagccaggttatattcattttcactgaagccagatttttcgttaatacctagctaaaattaccctagtgggtgtattagtcagggttctttagaaggacagcgttaataggatagatgcatatataaaaagggagtttattaaggaatattgattcacgtgatcagaaggtgaagtcccacaataggctgtctgtaagctgaggagcaaggaagccagtccaagtcccaaaacctcaaaagtagggaagccaacagtgcagccttcagtctgtggccaaaggcctgagagcctcttgcaaaccagtgatgtaagtccaagagcccaaaagctgaagagcttggagtaccatgttcgagggcagaaagcatccagtacaggagaaagatgaaggctagaagactcagccagtatagtccttccacatttctctgcctgcttttacctaaccacgctggcagctgattaaattgtgcccacccagattgagggtgggtctgcctttcccagtccacggattcaaaggttaatctcctttggccacaccctcacagacacacccaggaacaataatttgcatccttcatccaaacaaatcaagttgacactcaatattaaccatcatagtaggtaatgtactgatttagaaaatatagataatgcaaatgaaagatgtaaaaggccctttaattaaatgaaccactgctaatcttcattgctgatatatgcatatacttcatttaacttgtttttccaaaaataggcttattttataacattgttttataatcctttttttttacttagtataacatgaacatctcccacatcattaaatattcttctatgcatcattttaatcactgcatagttttcttatatgaatgcaacacaatttatgcagtactgtatataagatatttgtgggggtgatgatatgtacacttataatgggatccatgcacaaacacacatgcatatacaagctactttaatcatgtatgcagggctgggcacagtagctcatgcctgtaattccagcactttgggagactgaggcaggtgggtcacctgaggtcaggagttcaagaccaagctggccaacttggtgaaacatgaaaaaataacatgaaaaaataaaaaaaaaaattagctgggcgtgcttgtgcacacctgtaatcccagctacttgggagactaaggcagaagaattgcttgaaccagggaggcagagcttgcagtgggccaagatcacgccatggcactccagcctgggtgacagggcaagactctgtctcaaaaaaaaaaaaaaaatcatgtatgcaggtaaatctttggacaaatctatatatgttttagaatatatttttaaaaggaatttgtgagtcataagttacaagctatgattcacttgcttgtatagaatagtatgggaaggtgtgatgtgggcatccactgtagtgcctattggctttggcatataaccttccatctaaactaaacggtgaaattatttaaatatcttatttaggaagagattgtgagcaagaaaggcagaataagtgatccatgattgtacagcaaatagctgacaatatttaataagccccagtttgtgttgaggtattgttgagactcctttgtagtagttatacaaaatattatttttattaaaagttactattggggcattgaaataaattaatcatgggctttttaaatttaaatggtgatttgctaaatctctacttatgatctaatttgtgatctaattaaacccattaagtccatagtgtccacacattttcattgtgagttgctatgattaaagatttttgagcttgtattaacacatatcaatttatttataatgtctatacatatagtaatctcaactcaattcatctaactttttttcagtaacataacagaccattttatatatatatatatatatatatatatatatatatatatatatatatatatctgagatggggaaaacccacgttaaaaacctctattctaattacttttttatcagtcttttgataatagaactagattgtctacaaattgccttctactttaaaaaaattattcactgattgaatgcacagtggcaagtactgggatgagccaaaattgatgcacaatgcttcggggagtttcatagactaacggaggaatgaaataattatattaataaaaataacactgacaagtataacaaatagacccaaaattctaatggtttagcaaaataaagttgttgttttgttttgtttttcatgtaaattttgcaatggatatttctcatgagcaaatggctctcttccaagcagtgattcagacatctaggttactgttggtagtgtcgactgctgttttccacacatggcttccaaagttgctacagcaggggaaagtacatggagaaccacacacgggaagtttttatgagcctggcttgaattggcacatatcatttctattctcggttaaggaccacacctaactgcagggcaggctggaaaatgttgcatagctatgtgtccaagaggaacaacaactacattagttcaatagttagaatctgtgtgataacatgcaaaaaatggaattgcaacattatgaaaagtataatggaatgatgtaaaagagctataaaattatgaaagagagttatcttacctgaaagttgaaattggtcttcagagatgaacaaggattatttgagtgatcagaggttgaaggaactttctggcaaaagaaatatacagaaagtcaaagagatgagaaaaggaataattctaatacagcatggttaattttcaattcacccattaaatttccactactttttcagaaggtattttcaggcaaatttacaaagatgtatacataaggaagaatattaattgcattgctgtttataatagatgtgattgaaaccaacataaatattcaaagaaaaagcattggttaaataaatgatggtatatccaaactttggaatattttgcacccattagaaaataagtatggattcacatatttatttggaaaggtttccacaaatgttttttaaatgataaaaattagcatgtacaggctgcgcatggtggctaacgcctgtaatcccgacagtctgggaggcctaggtggaaagatcacctggggtcaggagttcgagacccgcctggccaacatggcaaaacccagtgtctaataaaaatacaaaaattagctggtgacgggcacctgtaattccagctactgaagaggctgaggcacaagaatcgcttgaacccaggaggtggaggttgcagtgagctgagatcgcaccactgcactccagcctgggtaacaaagggagactccgtctcaaaaaacaaacaaacaacaaattggcatgtacaataatgttgaatgaaattataaaattcagcatatatgaatggtcctattttaaatacatatgtatgtttatgtacagattattgctgactgttcattcaagcagtagtttacttgatatttcactgtttttctatagtggcttcctcctttgctttcttccttcctgcctgcctgccttcctgcctaccttcatccttgtaaatgagcatgcattatttttatcataaaaataatatattttgagtaaaaaaaaatgttggtgatcagtgttctcttgtttctgtggataatctctcttagctagctgatgtaaaatgctaccttattgattatctaatagatgacacctttctgagaagtagtagctaatatatgctagacttgatgcagccggggcttgctatttacaactttctacataagaaatgaaaaacaaatcttactgtcagatgtgtcagatttataaaagttgtatatagtttattttcaaagggatgctaaatgaattgctacttgtcatacattaaatagaataaatttagttgtttaatttataggttaactatcatattgatatgtgaagtctatttttgtttctaagagaaatgggccaaagcaagtatatactgaatccccttattttattaagaattaaccctgagccacgtgtgatggtgggttcttgtagtgtcagctactcaaggaggctaaggagggaggatcccttgagcccagaagttcaaggttgtagtgagctgtgaccgtgaaactacacttcagtctaggtgacatagagaaaaccccatctcttttaaaacaatgaaaaaagcaattactcaaataattatccttgataaactagagcctttggactggcaaaagagcatgatctgggtaatggtgagtggagggtaaagtggtttttgtggtggggggtggtggaaaaaccagtatggttttcttatcttctgagtcatctataaacagataattgattgacaagaccaaaagcattgttttagggaaactgatttattggtagcagagtatgaatattcaaatatgagagggactaaaagtcagtgtttctaatttattacaattgtaaaattgaaagtaatgaaagtgaaagatctacaatgccaatgaaaagaaagattttaaaggaaaatatacagaaagtaacaactgagtagatctaagactagaaatacaatttgaaagatttttttgacaagcaaggcatatgggatattattcagattttgattcaatgttatgcttgtaccattattcatcacatattactatgttctctaacagaataaaattattactttaaaatcaatcaacttgaaatgttttttgttgtttgtttttgcttcaagctttttcctagatatagactagttcatttctcttttttcaaagagacactgcccactaataaaggggtaattctgcaaataagaaaatgttcacaatgtaatatacataagcaaataatgcaattgataaatagtgttctttttggtagatttatcagttgttttgtttataatatgatcatcttctttaacactgggaattctaagattaaaataaatgtaaattaaattttttaagtaggttctgtgttagagaaaatgaaaggtataaaatgattctggttttatcatatttctaaaagctttataatgtcattttgagtcaaactaattatttttttaaataatttcactatataattaggaagaaaatagctcatagcataataaattaatctctttttgaagtctacgccagctttggtatttgaacatttcatccatattcaaatcaacaataaaaaaaccacaatgtagatttgcttgccttctgcattacatttgcctattagagtagataaatagcacacatatttagatgacaagtggttttttttttcctctgactatggggaagcatgatattttgtgagtacatgagtctctttgtgtgtgtgctatgtaaaggaaatcaacaggtgagaaaaatgtatagaaactgatatttaaaggtgcttaagaccagtgataagtcacaacacccaactgcttattctttcccatttgttatttatgctatttgaagaattagaaaagtgttttcttctggtaagatgccttcctccaggtaaaagccagaaaaagtaaaaggctcgttccccactataactacttagcattctttttgcttgagcaaagtgaaaaacaccaataggcctgcttatacacaggcaaaacacacacacacacacacacacacattttaaaaatgtcaaatatatattcattagaagctgtaacagaagaatgtatttaactctggggagaagacgcttaacctgatattctttaagttgttacctattctccactaagaaactgagaataattaggagaatgactacatgttgttgcaagtagtcctaggtatacggacactgtttatgaccattttaatttcattgattatgataccaaaacatggcacaattactcctgctaccactgacaaaactataacttacataatgtgaaaataaaactgtcatgcctttgaatatattgcaaatatcaaatacttctgtgtgctttaaattgaccttcatagcttaaggtgttagagttgagcccatgtcttttccacagagcgaaattttaatcctatctgcttcctagtcttggaagcattgtgttgattatggtgactttctctgcagcatgtctttttatcagtttacagacggtgaaagggatcagaacatgcatccccaaatatgccactttgtcatatgggttattttaagctgcaggctctttcttaagaaagagcacatgcaggaagctgtttctgatctccctgtttctgcctaaaagaaggtcacaaagtttcccatgatacaaatccccccaccccttcccactgtattagaaagcaaaaattgttctcgtcaccagaagttatgagtcaacactggaatggacctatgcaaacaagcttactaaaataaccctaatctcctcatagttttccccatacatttcctagttacaaacccacaatttactgcccctagctccctacctaaatctcctttgtattatcacttactgacaatttattattctttgtttaaagtgatatataagcttttgggcctaaaaggttctttgaccttcattttccttctgaagactcctgtgtacacataaaaatacatttgtatgctcttttcctattaatctgtattatgccagtttaattcttatatcaccacagaatgtaagaggataaagaaggttttgttcccctacaaagatattgtaaacaactgtaaacagggaatttctttcttaatttccaaaaattatttttaaaaatgtaccccaaattatttaaccattcaaaagaatcacaaattttcaaaatgttaagaatcagaatattttttataccagggaaaaagtatctcttttttatggaattaaagttacagtccaagatatgttaaaaaaaaaaaaaaaacctaaactgaatatttatggttaataggagcgcccatgtcacctgtttatgttcttatttcagaattagaaagactcacaaagaagccacatataaattcatttaatactttatgtagactaaaaaatttttttaatcttacaaatgaaagataccttaatgtcattgtctcaccgacatcacaaattcatccaaagccaaatccaataacgtcatctgagtttagggatattacatatactaacacctaaagaaaattatttttattggaattttatttcttaaatttagaaaaatacaccttctcataaaatttctgccattgtttctatttttgctttttaaagtgaatgataatctttgtaaactttattttgatgacaactttttaaatagtttgaaattgaatacatatttttttctatattcaatgtttccagttctaactatttttatatatgtgagaggatttcaaggccaatcacttttttttacccatatctaaaggtccttagagatgcctattctcttatatggtttgactcatgccattacaaagtcatcaactggatggtcaactgtgtattcatgctaataataccagttttgctgttttgtggctatgatggttggctcagagcaaaatttgctggatgtgttctatcctagtttttaccatattcatacattattttagaatttatgtttttaatgaaatgttctaacttaaaaattattttcatatgcattatagtccttattttttttcagtatttcaaggtatgctgtgcctaaatatgtgccttttaatttatatggaaattaaactcagtaagattaatgtgttaggaactataatatagcagaacattggaagagtcgagacattggaagagtcgagaccagaaccacattcctttcactttaacctaatttaatatcactctgaagagtaacttcaggatgcatttgggccaactggcactttgtcttattactatatattagcatgcatacaggtatgtgtaggcaacacacacacacacacacacacacacacacaccccttgaaacgtatactttagatctagaagggactttagtgtagtgataacttgggagaagtggcgagaaaattagcctatatatcaaatcctgcgttctcttcacgaatattcaagcccagaatattattgtgaagtttcaattatagagcacatagtatccaaatttcaacttgacatttgaagttatgtgtcaccactatgaagcttcttttgacacaattcaaaatgtttagttttgtttgcctttataaagatgtaatggcagtagatatgtgaaatatcaaaacatttaattggatgtgaaaataaattaatcttagtattctttaaagttcttttattttgcattattttgtctgcctagtgttcaacttcagttttctctaatagtgtatgaaatatatgacagaagttttaagattgggtattttgtacatttagaattattgtcttaatgtttagtcatcatataatttatctaaacttggaagataatacgcagaattgatgtttttctttagcagagtgtgtggtttataatcagtaaaatcttgatcattatattataaaacctgtatgtaaataatatgcttcagaatctaatcagacacacaagtttatttattcagttcattatctgtgtgtttgtatgtatgtctgtatctctgtatgtcttacagctgttatttcaagaaaccaagaagggccaggagaaatgggaaaagctgtgttgattcctaaagatgaccaggagaaaatgaaagagctgtttaaaatcaatcagtttaaccttatggccagtgatttgattgcccttaatagaagtctgccagatgtaagattagaagggtaagtttgcatttgttatataatcttttatattcataatcaccatatttcagaatctcagaacttgagctaactcagattatatcaattctagcaatgtgtggttctgagtacctatcacatagcaggaatttattgtgcatgcatatgctgaaaaaggcgaactattttcttccctggcaaagaaaaatacgttacttgcaaagatgctgcaaaatactcaggccaaacaggtttttctatgtgagatgttttttgttgttgtcattttgttgtgctttctttatcgtaccagattcagagcaaatatgctctttagtagattacagtcgtatattgcttaacactgcagaaatgttctggaaaatatgtcattaggcaattttgtcattgtgtaagcatcataggtgtacttacacaaacctatatggtatagactactacatttctaggttatataatgtagcctattgtttctaggctgtaactctgtacagcattttactgtactgaacactagagataaatgtaacattatgttaagtatttttgtatctaaacatagaaaaggtatagtaaaaacacggtgtaacagataaaaatttgtatacttgtataggtcatgtaacatgaatggagcttgcaggactgaaagttgctctgggtgagtcagtgagtgtgtagtgaatgtgaaggcttagggcattactgtacgctacttgtagactttataaacactatacacttaggttatactaaatttctttttaaaatttctttcttcagtaatgaattaaccttacattactgtgatatttttacttcataaagtcttgaatttttttcacttttaaactgtttagtattaatacttaccttaaaacacaagcatactatacagctgtaaaaaatattttctttctttatatccttattctattagtttttttccatttttaatgtgattttcaattttttcttttaaaaacgaagacacaaacatacacattagcctaggtctattcggggtcaggatcatcaaacatcactaggcaataggaatctttctgattcattataatcttatgagactctcatcatatatgtgatctgtcattgggtaatgcatggctgtatttgccttactgcataaaaaggtccatatactttgcttataaaaagtatacctgcattgcttttccagcacaaaaatagctcattgtctatatgactctttcaccctataaaagtggtttattatggtttccagcaatttatactgctgtttataattagaatgcttaattatcagctatggaagaaatatgcacttggaaataatattgcacgaaaaatgatgttgaaaaattcaacttttatgtgattaactgtaagctatgctctagatagttgaacatattttaaacagatgtaataaaatgaaagtatttagtggcagaattgtaattctaatatatggtcctcgtaaaacaaactcttggcattaataaaagatgtgtcttgagattttagaaaatctccaggtttacaaatatactgcaggacacacttccatgtaaatagaaattgttcttttaagcacttagtgatttttctctacatgcaatagaacataattaatgcaaataaaatttgccacctctagtgggctacattacactactgtgtcatgatattagcatcatatttactaactcttatttttttctttctgaattacttcatataatatgaaaaccttggctgggcttggtggctcatgcctgtaatcctagcactttaggaggccaaggcaggcggatcaccttaggtcaggagtttgagagcagcctgaccaatatggtaaaaccccatctccactaaaaatacaaaattagccaggcgtggtgttgcatgcctgtaatcccagctactcaggaggctgaggcaggagaattgcttgaacctgagaggcagaagttggagtgagccgagattttgccattgcactccagcctgggcaacaagagcgaaactctgtctcaaaaaaaaaaaaaaaaaaaaaaaagaaaggaaaagaaaaaagaaaaccctgttgagattccagggcttgtaattgtcagaggtttatttggtatcttagcaactgctttgtgacaaccattgtatacttttgaaatgtctctctcaacaaaatcacaagtaattacatattgtggacatttttggcccctggggaatagttcaacatttaatattaaatttgtgcattgcaaattattatgtaaaaataattttacatgtagtcctgtgcatatgtgtgtgtgtgtgtgtatatatatatatatatttgtttgtatatagatacatttaaaagtacatacaataagcatatacaaaaaatatatacaataaacagtcttcgaagcaattttgagcattttagatgctaagtttataatgtttaaacattgcatttattactttgttttatatgctgtagtatgctgtagtgcaatggtccccaaccttttggcactggggaccagttttgtggaagacaatttttttacacatttggaggtggtggattgggggttgggggtgatttcaagacgaaactgttctaactcagttgatcaggcattagattctcataaggagcacacagcctagatccttcgcatgcgcagttcacaatagggtttgtgctcttatgaaaatctaatgcagtggctgatctgacaggacactgagttcaggtgataatgcttgctctcaggcagctcacctcctgctgtgtggctgggttcctataacaggccaggaccagtactggttttcagccccaggaacctctgctgtagtgtgataaaatgagtggctatgatacttatatattccagaaaactaggtaaacactatttcaagtttttaaaaaatctcgactttcaactgtcagaatacaaataaatcagaaccatgaattaaaaaaaaaataagtcttcactgagctaatgtttaaaatattcatagccagtgattttttttttttcttttaagaatctctgccaggcacggtggctcacacctgtaatcccagcactttgggtgggaggctgaggcgggcagatcacctgaagtcacgggtttgagaccaacctggccaacatggtgaaaccccgtctctactacaaatacaaaaattagccaggtgtggtggcccatgcctgtaatcccagctactcaggaggctgaggcaggagaatcacttgaacccaggaggcagaggttgcagtgagccgtgattgtgccactgcactccagcctgggtgacagagtaagactctgtctcaaaaaaaaaaaaaaaaaaaaaaaaaagaatctcttagctctagtttgttgtcttactctaagaaaaaaaggatcccttggcatactaagtttatgagtaagtcttaaactgtggagcaatccaacattttaaatgaataattcaagttgcttagcatgtaaagtacataaaatcctgtatatactgtggttattattgcttgaattttcatgttttacaaatagtctctgaaataatattaatgaaaaaacttttcattttatttttatataaaactacagtatatgttataagtaagaaaacagtaataccatccaaaattcctagacaagtcacagtgtatgaggtttaccagggacatttgcaagtcatcttgaatgactcaattgtagaactgcctgggaacaactaatgttgaaaaacttaccatgagtcacatatccaaactgttatttaaaagatgtagaaatgttaatactcatttgatctagaaaatatttttataatttgattatatgccagttacagttcagtttttggataattatatcttaaaaagatatagatacattaagctagcacaagtgatgactgatgtaaagatgtaaaaagaataggattctaaaataattaatttacgaagaagctgaatttattttagtggaaaacttgagttgatacttagaaagtgtctgagtcatccaaaatgtgaattcattcaaatatctaatcatattttactgcgttatacctttaaactattttggctaaattcagaaaattgtccaaaaagtttaatgttatgtttgacgctaatatcaatttacaaatattggaaaacgtattcggggaataaatctaagcatatatgctatgtttacacagagaacagactaggtaaaaatagtttttcttggaggcagttgtgaataaccatcaggacaaattgaagttctgttctgtaatatctatccctaggaatgtttaaatatttataaaaatttacttaaagtatttaatattttaatacacgcaacacatttgtatgtaatcctaatttttttgatagaagatgctagttacaaagaaattatgttacttttatattttaagtacaattaagggcagatgccttatgaaatgttttaccttcttgaaggcccttcattcctgggatatttatgtagttctctctctctctctctctctctctatctatctatctatctatctatctatctatatatatatatatatatacacacactaaaaatttacatataaatttatatataaattttatttatatgtataaataaaattttagacagctgtaaccagccctctctctcctttgcccattcccccacaaataaaatttttaaagtaaatatcttaatagcctatctgattcagaatgttgagaaaaatgactattaactaatggctcagcattagagatttgttagcatgtttctcatcaattatggggctaagatttgtaaatttgtatattttggatttcagaagagcagggtttaaatgcttctgttgtcagaaagtaaataaatagatgccattttgtttggcttttaacctaaagtcctttagcatttacttgaattcagtcatttaataacacttcaagggctggtattgagtgtttttgaaggttataatgcagctagcatttaaatatttttcatcaggaaaaaattgagaaaataggaaatttattttagctttttatatcctaggccaaataactgcttcttacatatgcacactttcaagtcaataaagaggaaaagactctagcagccttacattattagtggaagaggagctgtagcatacaaattttgaataagttgctctcaaaggacaaagaatttatttactacataaagtaggaataagacatagtatatattttttctgtgctcaatctcgtgagtacgtgctcatttataaggtttgcctttcccatgaattaaaatatgataaatgtagcattgattgcacaaaggagaaatagaaaatgagaatattaattggatttccaatctctgttccacatcttttctttttaatttgagaattattgcaacatttatatgctggtaaaaatcttccctgtgaagatactaataatttctttaataatttgatttatgtaatgtgctcatgtgtagaattaatttcactatccaaattaaaagtggtatgttagaatgcctgtatgtttacatatgcacaatgtatgtgtgtgtgtgtatatatatatatatacacacacacacacgcatacacatacacacacatatatacatacacacttgaggaatgtggatataagtattattatcatttgggggataataacactgttacactgtaagtttcctttcaaataagaaagtagagtaacacatgtctaggcatgttctcagagacacatttaagtacgttgtatgcagaaaacatgccacataacctttatttacacttgaactacccctccatagtttcattatgtaatttaattttctgacactactaccttcaacttctaaaaaaaagtggtattatatacataacataaaattgacaattttaactattttaaagcacatagctgagtaatgttaagtataaaggacatcagaatatgctaccctaaaatatgcgaatttagcataaagatccttttgagctgaaggcaattaaggaaaagcaggcacaggaaacctctctactcttccccatctacctaaaagtagggcatacatttgacttataaaagcatcccccactctcataccaggaggagaagagcaacctttattagcagaaatagaaatgctgtcaggataagccagcataaacaaatctcactaaataacctttattatccattagtttccctcctgcattacagagtttcccaccttagaagccccaaacccttttcctttgtcttgccacttctccacaatttatcacccttttttaaaacgtcatataaacccactgagtgtcactacttgtttgggtcttcacttcttttctatgaaggtctccgttcatgtgaaaatcaaatgattataatcaaataaaatgtgtatgccttttttccggttaatctgttttttgttagtttaattcacaagccccagttatagaacctaagaatgtagaggaaaggtttttctcttccctgtaagtgaatttacattgttgtgcaatgaatctttagcattattttcattttgtaaaactgaaactctatagccgttaaacaggaactccacatttctccagcccctaccaaccaccattctatgttctgactttctaaagttggtattttcagcatttatcgggacctaattgtgtaccaatgaaaactaaaatatacggttttacattagagaatggaatgactatatacatatatatgtatttgaatggaatatatatatttgaatggaatatatatatatatttgaatggaattttatatatatatatatatatatctcctagtatgtggcagtgtgaatttagaagtgccattgtatcaaggcatgatgaaggacagttttacaggaaggtgtatttggaaccaagctttgtaagatgaatttgtgtagaatcaggctgacacagaaaggagacagcagaaaggagagtgtagacaagcaagccagttctggttagaggagggccaatgaaactctttgctaggaatgtgcatcataggtaaacaggtatggagcctggctactattttatttatacacttaataattcatatattcaagtttaccaaatacctatttgtttgtttgtttttgcaaattctaattgagaaagcagaaaatctaattttcactttctaaatctacctggtaatcatatttttacttatgtttttcctacttgagttatgtaggcctgaaagggtttttaaaatattatccactatcatggttgttaatgtgttcttatatttctttctttttttttttgctgggattttgcttttattttttatttttattattattatactttaagttttagggtacatgtacacaatgtgcaggttagttacatatgtatacatgtgccatgctggtgtgctgcacccattaattcgtcatttaacgttaggtatatctcctaatgctatccctccaccctccaccttcccccctccccacaacagtccccagagtgtgatgttcccctttctgtgtccatgtgttctcattgttcagttcccacctatgagtgagaatatgcagtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacatgtgcacgtgtctttatagcagcatgatttatagtcctttgggtatataaccagtaatgggatggctgagtcaaatggtatttctagttctagatccctgaggaatcaccacactgacttccacaatggttgaactagtttacagtcccaccaacagtgtaaaaatgttcctatttctccacatcctctccagcacctgttgtttcctgactttttaatgattgccattctaactggtgtgagatggtatctcattgtggttttgatttgcatttctctgatagccagtgatggtgagcattttttcatgtgtcttttggctgcataaatgtcttcttttgagaagtgtctgttcatgtccttcgcccagtttttgatggggttgttttgtttttttcttgtaaatttgtttgagttcattgtagattgtggatattagccctttgtcagatgagtaggttgtgaaaattttctcccattttgtaggttgcctgttcactctgatggtagtttcttttgctgtgcagaagctcttgagtttaattagataccatttgtcagttttggcttttgttgccattgcttttggtgttttagacatgaagtccctgcccatgcctatgtgctgaatggtaatgcctaggttttcttctagggtttttatggttttaggtctaaagtttaagtctttaatccatcttgcattaatttttgtataaggtgtaaggaagggatccagtttcagctttctacatatggctagccagttttcccagcaccatttattaaatagggaatcctttccccattgcttatttttctcaggtttatcaaagatcagatagttgtagatatgcggcgttatttctgagggctctgttctattccattgatctatatctctgttttgataccagtaccatgctgttttcgttacagtagccttgtagtatagtttgaagtcaggtagcgtgatgcctccagctttgttcttttggcttaggattgacttggtggtgcgggctcttttttgcttccatatgaactttaagtagttttttccaattctgtgaagaaagtcattggtagcttgatggggatggcattgaatctataaattaccttgggcagtatggccattttcatggtattgattcttcctacccatgagcatggaatgttcttccatttctttgtatcctcttttatttccttgagcagtggtttatggttctccttgaagaggtccttcacgtcccttgtaagttggattcctaggtattttattctgtttgaagcaattgtgaatgggagttcactcatgatttggctctctgtttgtctgttattggtgtataagaatgctcatgatttttgtacattgattttgtatcctgagactttgctgaagttgcttatcagcttaaggagattttgggctgaaacaatagagttttctggatatacagtcatgtcatctgcaaacagggacaatttgacttcctcttttcctaattgaataccctttatttccttctcctgcctgatttccctggccagaacgtccaacactatgttgaataggagtggtgagagagggcatccctgtcttgtgcccgttttcaaagggaatgcttccagtttttgcccattcagtatgatattcgctgtgggtttgtcatagatagctcttattattttgagatacgtcccatcaatacctaatttattgagagttaatagcatgaagagttgttgaattttgtcaaaggccttttcggcatctattgagataatcatgtggtttttgtctttggttctgtttatatactggattacatttattgatttgtgtatattgaaccagccttgcatcccagggatgaagcccacttgatcatggtggataagctttttgatgtgctgctggattcggtttgccagtattttattgaggatttttgcttcaatgttcatcaaggatattggtctaaaattctcttttttggttgtgtctctgcccggctttggttatcaggatgatgctggcctcataaaatgagttagggaggattccctctttgtctgttgattggaatagtttcagaaggaatggtaccagttcctccttgtacctctggtagaattcggctgtgaatccatctggtcctggactctttttggttggtaagctattgattattgccacaatttcagagcctgttattggtctattcagagattcaacttcttcccggtttagtcttgggagagtgtttgtgtcgaggaatttatccatttcttctagattttctagtttatttgcatagaggtgtttgtagtattctcagatggtagtttgtttttctgtgggatcggtggtgatatccgctttatcattttttattgcgtctatttgattcttctctcttttcttctttattagtcttgctagcggtctatcaattttggtgatcctttcaaaaaaccagctcctggattcattaattttttgaagggttttttgtgtctctatttccttcagttccgctctgattttagttattacttgccttctgttagcttttgaatgtgtttgcccttgcttttctagttcttttaattgtgatgttagggggtcaattttggatctttcctgctttctcttatgggcatttagtgctataaatttccctctacacagtgcttcgaatgcgtcccagagattctggtatgttgtgtctttgttcttgttggtttcaaagaacatctttatttctgccttcatttctttatgtatccagtagtcattcaggagcaggttgttcagtttccatgtagttgagcagttttgagtgcgttttttaatcctcagttctaattagattgcactgtggtctgagagacagtttgttataatttctgttcttttacatttgctgaggagagctttacttccaagtatgtggtcaattttggaataggtgtggtgcagtgctgaaaaaaatgtatattctgttgatttggcgtggagagttctgtagatgtctattaggtccgcttggtgcagagctgagttcaattcctgggtatccttgttaactttctgtctcgttgatctgtctaatgttgacagtggggtgttaaagtctcccactattattgtgtgggagtctaagtctcttcgtaagtcactcaggacttgctttatgaaactgggtgctcctgtattgggtgcatatatatttaggatagttagctcttcttgttgaattgaaccctttaccattatgtaatgtccttctttgtctcttttgatctttgttggtttaaagtctgttttatcagggactaggattgcaatccctgcctttttttgttttccatttgcttggtagatcttcctccatccttttattttgagcctatgtgtgtgtctgcatgtgagatgggtttcctgaatacagcacactgatgggtcttgactctttatccaatttgccagtctgtgtcttttaattggagcatttagcccatttacatttaaggctaatattgttatgtgtgaatttgatcctgtcattttgatgttagctggttattttgctcgttagttgatgcagtttcttcctagcctcaatggtctttacaatttggcatgtttttgcagtggctggtaccggttgttcctttccatgttcagtgcctccttcaggagctcttttagggcaggcctggtggtgacaaaatctctcagcatttgcttgtctgtaaagtattttatttgtccttcacttctgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggctgcccttaacattttttccttcatttcagctttggtgaatctgacaattatgtgtcttggagtagctcttcttgaggagtatctttgtggcgttctctgtatttcctgaatccaaatgttggcctgccttgctagattggggaagttctcctggataatatcctgcagagtgttttccaacttggttccattcaccccgtcactttcaggtacaccaatcaaacgtaggtttggtcttttcacatagtcccatatttcttggaggctttgttcatttctttttattcttttttctctaaacttcccctctcgcttcatttcattcatttcatcttccatcactgatactctttcttccagttgatcgcatcggctcctgacacttctgcattcttcatgtagttctggagccttggctttcagctccatcagctcatttaagcacttctctgtattggttattctagttctacatttgtctaaatttttttcaaagttttcaacttctttgcctttggtttgaatttcctcctgtaggttggagtagtttgatcgtctgaagccttcttctctcaactcatcaaagtcattctccgtccagctttgttccattgctggtgaggagctgcgttcctttggaggaggagaggcgctctgctttttagagtttccagtttttctgctctgttttttccccatctttgtggttttatctacttctggtctttgatgatggtgacgtacagatgggtttttggtgtggatgtcctttctgtttgttagttttccttctaacagataggacccttagctgcaggtctgttggagtttgctagaggtccactccagaccctctttgcctgggtaacagcagcgatggctgcagaacagtggattttcatgaaccgcgaatgctgctgtctgatcattcctctggaagtgtctcagaggagtacctggccatgtgaggtgtcagtctgcccctactggggggtgcctcccagttaggctgctcgggggtcaggggtcagggacccacttgaggaggcagtctgcccattctcagatctctagctgcatgctgagagagccactgctctcttcaaagctgtcagacagggacatttaagtctgcagagtttactggtgtctttttgtttgtctgtgcccagcccccagaggtggagcctacagaggcaggcaggcctccttgagctgtggtgggctccacccatttcgagcttcctggctgctttgtttacctaagcaagcctgggcaatggcgggcgcccctctcccagcctggctgccactttgcagtttgatctcagactgctgtgctagcaatcagcgagactccatgggcatagaaccctccgagccaggtgcaggatataatctcctggtgtgccgttttttaagcccattggaaaagcgcagtattagggcgggagtgacccgattttccaggtgccatctgtcacccctttctttgactaggaaagggaactccctgaccccttgcgcttcccgagtgaggcaatgccttgccctgcttcggctcacgcaggatgcgctgcacccactgtcctgcgtccattgtctggcactccctagtgagatgaacccggtacctcagatggaaatgcagaaatcacccatcttctgtgttgctcacgctgggagctgtagaccagagctgttcctattcggccatcttggctgcttcagtgtgttcttatatttctaatattttgttttgttccctatatttttgttccatgtgacttaaggcagaaatactcaattatttaaacctcagcaaaaattagagttcacagcaattaaatctgatagttttttccaaaaaaataagaaaatttaataaagaaaaagtaatttttaaaatgcagaaggtttggataaccaaggaatggaaaatgatgatacagttcagacagaaggtatgtgaggcctgtgagaggagaaaacaactcaattagaaagttgttaactatccatccaagctcattggcctgcagaggatgatgaagaatcttaaaaacaattttatttagacatgtgataatagtcaacaaggagattttagaacaaaaacatgatgtgatggaaatgatatttaggaagcgttattcttgcagtattatataaaaggtattatagataagagaagcctgaatttaataagattccctattgactattatagtcacatagatctgattggataaggaacttgtccaggacaatggcctaagaaacataaagcaatatgtagtaattaattaaaatgaagagaaaggaaaaacaccaaacttaagatagcttcaggagggatggcatgcggttgaattttcaactttatttgtatgtgtaagtatttgtgtatgtgcatttataggaaagacagaaaggaactgtaagtaaaaattatcctaagtatattttcaactgattttccagaataggtgacttactagatataagggaagtcaaaatatgactttaatgtttcaaattgggtgactaggagatttgtggttttgctgattgtttatgtttgtgtgtgtgtgtgtgtgtgtgtgtgtgtgtgtataaacatacatatacaaagagaaacacataaatgccacttttaatatggatagtagaattaattttgcacataagaacattagataaatcaaaatattatggaaactattattgttatcttcagaggcaagattttttaccagcttatgaaagctatagtaattctcaacttgaaaataaaagatgtgtaccagagatcagaaattcaattaatattctcacttctatttcatctttatgaaatcaatgctgcctttatctgtatattattaaaataattgtgcaaaatataatttttaaaaacagccatttgaaagtcagtctttgtggttaaaatgtgtatttttttattcgtctcatggaagaaatctaatttaaaaagcaaagatttgttttagtaaacatttgcagattgattcaatttaagaaagcagatagttttgttattgctagaaaaatcctatgtggaggaatatttgacttctgtattaaattacttctcactattttttgccccagatgttttctgtgcacataccagtttcttaagggaagggtaaattgttctaatgccagcttacaatagtattttgctgagggaaaatgtgattttatagttaaatagcttaactcatgatagtaagacatagttttgttgacatgagagatgttagcatctgtctaaaaattctcattgtatattataattaatattctcatcagcttgcaaagtctccctgtagaagccagtatactttctgtatggtaattgctgtttaaattagaaaatttatatttggactttgaattttaatatttaatgttgctatgtaattttgttcattaagaatattgaaaacaaggcccaaaataagttgcattttgttacattccaagtccaacttgaaataaatggagcatattaatggttatacttttaggataaaactatatatggacaaatatattttctacatatatttatgtattgcataatacatatatattcgacgtatatttatgtattgcatttatagtgtcttattttattttttccctaacataaagcattctttctattattttttatgtcttttatttgtgagttatactgtagatacagatagagacattttcactaaaatgtcataggagactttctggttatatttgaccagatagttaattttctaagatagtgttctatcttcaaatagaaatggaaagatcaaatagaatgtgattgttttatcatcatactatataaaatggcgttgaatttcaccatataaattcttaagtaaaattcacattttatattcatccagtgtctcatttctaagctatattttataagaaatttaaaagcaagtgtagcacatagttcctatccttgataagcttacgtagcatagtgattaggaagatatattttcccccatgacacagtttaaacacatgaattaataaattatgtgataatagtaaatgtagctaaatatcaatatttattgaatttttagtatgtatcagctatatattaagtagttgaactgaattatgacctggaattttcaatcaaagcccagtgaagtatatcatatgctttaatgtatttgtttatagattaggaaacatacttagaaaggttaaggaacttcctcagggtcatgcagctgacatttgaagtaaggctgtctaattctgagtatttgctctcaaccactacagaacaccaaagaatataaaaggggaaaagacaagatagagagttacattactaggaacttcatggaaaagatgaggcatgggttggcccttgaataaagtctggaacttatatagatataagggagaacacaaaggttccaaatggaaagacaaaagtcctttattattccatctcctcatgcacagaatagaatgattaaatagtgtgttgaagagactgatctaatatattaatgagtttatttgggagacggttcatacagtcatgctgacttgtcttaagttaaatacttaaatcactactctgaggcaggcttcaatgctgtccatcagtcatacgatatttcccttgtctatcctgttttccacttcgtaaattattattttataaattcatcactcccctccctcacacctataatacttcctctcaaccctcattctcattatcttaccttctgtttcactgagaaaaatagatgcaaagaaaactccccctagtctcaccatggcatctacccatctacccatttacttgaatttgtagccctttactctgctttctccactgttactatgaatacatcgtccatgtttccagttacaaccagcccatcctctaggtgtcctttcctcttacctcttaactgcttaagcacaagtgcactgttccaacaattctacccactttttttaagagatggggtctcactatgtcgcccaggctggatttaaactcctgggctcaagcaatcctcctacctcagcctcctaaataactgggactacagaatcctgcttacttctttaatcagttttctctcttcggttattcttaccagaatgcaaagatgctgtttatcctcccttaaaaacaaatgtataaacaaaatacttctctagcgaatgcttatcgtggatttgttcatttttcttttcttattccaaaaagttcttgaaagagttggctgtcactctcttgagccatctccgtaccaccattttgttttgaattccctgcaattgacttttatccccacaatacagcaaaattgctattgccgaggtcactaatgattgctatggtgctatatttaacagtcaattttcagttctcatattgacttgccagcataatttgacatggttgattatgatctcctttttgaaataaatttttcacttggcttttaagtcactacactggaatataattttctcctacttttctggtgattccttcccttcattatttgctgataccttttcaccctaaccccaagcgtagatatgtcctaagggtaaggcctaagggtaatgagctggctgattttctgtggcagtcattcccgtggtaatttcatgtagtgtgtcaatgttcaatatcatttaatctgcagcccagacttctcccctgatatcgagaattgaacatctcatggtattctggatatcttcccttgactatccaacactcatctaaatcttaagcaccagatagtcccaaactcagcaccagatagtccccacaaagcctcgtattttcaggaagttaatcctcttagaaaacagaaactccattctttcatttgctcaggccaaaccaggaagtctcattgcaccatctctttctcttactatcaacatctgactcatcatctcattaaaaatattaactcttatcatcatcttccctgctactattaatattttagtctaagctgcttatatttttacctgaatcattgtagcaatctactaagtgtttttgtttgttttggttttgtttttatttgttgttgttgttatgtttaattttctttagcacccttccatctctgatcaacataatagtcacagtgtgcctattaaaatataaagtcctgttaaattgtaaatcagttttgtgcttatttctctcactgcaaggtacaggtgaaccataccaagaacaattctactttaggacctttttacttcctattctctctgcctggaggtttctcctgaatatccacatggttttgctcccttaccttcaatctctttaattatgcctgaggttgcaatttttttgaatttgaaaaatcagaccttggcaatgaccttgagcagtaggatataaataactcccacatgctgagcattccaataatggaacagtagtcataaatgggttaacccatttatcatctctctaaattcttctttggccacattatataaaattactccaacccgtgacactttctactcccttattctggtatatttttctgctttgtactactgactacctaatataatgaatgttgttttacttacttcttttctttattatgaataaggaaataaaacatatttcttttctcactaaacataagttcatttaatgcagtggtcttttttattatttattttatttatttatttattcatttatttatttatttctgagacagcctcactctgttgcccaggctggaatgcaatggcactatcttggctcacagcaacctcctcctcctaggtttaagaaattctcctgcctcagcatcccaagtagctgggattacaggcacatgccaccatgccaggctaatttttgtatttttagtagagatgaggtttcaccatgttggccaggctggtctcgaactcctgacctcaagtgatccacccacctcagcctcctaaagtgctgggattacaggcatgagacaccgtgcctggccaattgcagaggtctttctaggggactttcatctgtatggtgggcactcaataaatatttgttgggtgaatttataaattaataaatgatgatatatattctgattgcacacagaagatgtgacaggcagaaaaacttgactttgattttgtaatcaaaagtaaacttaataggtttttagagacatactaagatgatgaaagaggtatagatctgtattgggatgagttagtgtttttttaatctatttttttcccagcaggacagtttagcctggagcagaataagaaaaaaagagaaattgaaaatagtctaatgttggggattactacagtgtgcactataacaaatcagagtgtaattgaggtagtcggaatttaatgatagctaagagaagactaacacattattacaattaaagttggaagtcctttttatagcttccatttattgagcaactaccgagtgccctagatgctaagtcttctaccttaaatcttcctcttcaatccttaaattatgcttagaaagtaaattgcattattcccattttataattaagggaactgagggaagaagagatacttttatttgggctgaactattggaaatgctttctcctgtactttcctctaaatttgttgccagacttctcttcccagcctttatttgatttatctgaggtttttggccattttcagctattttaaaagtctcatttttagatactatggtgcagcctagtttttggctaatactggttggccttcatactctccaatgcggcatgcatttatattttcattttttgtgagaagcattttggagactactttactgtaaaattcccagcagaccaatgactcccacctgatttctttcagtctctctcagttcctgcttcagacagaacaccacgcaagaacttgcttctgaggctctcttaccttatcagacagccctatagaggagagacttgagtgcaataattcttaccatatccacttccctgtagaattcatgactccttaccacatccaaatttgcaaaggtacttcttcaaccactgacttttccctactcagcccttataatctttttcaagatgattcctgccttacatgtctccaaacattaaaaaaaaccaagtcatgttactatcccatcacattctgtcataacccaaggcattacttcagattataattttatggccattaaacatttttgcaagagtgagatgctgatctcttaaaagcagttacaacctctgaaaatacatgttttaagattcccatcacttggcttaagagataagaagcacacttcttcccttccctagaagtagaaaataccatcatgtacctaacgcctttaaattcccttacttcattgaactgttcttcaaatttcttatcttctcccacataaattagagatgtatgatagattcactgttacaatatcagtactgctatctttccaatggcttcttttagaatttgggggtaacttatcattggctagcctcacttttcgtacttgctaaaattccaggaaggtgaatttttcttatctctatgcttaccacatttatctgttaccgcacagtatacaagcctcaaagtcaggaattgaacaaatctctctgactccaaagttttactctttcttctgcttcctacttgagtttcttgagagggtaaaagacactgaaatatgcatgcgataaggaggaaatggtcaggatactaagattataaatgtgagcataaatctgtgaaatgctgcagtgttcttggttcaacaactgtattcccattgtctaataaatgcattctatattattaatgaatattctgctagaatgtatatttcttcatttaagagatctaaaagttcatgacaattgcatcaagatgattgaagcagtctggagtagaaaaaaaaaataaatgtgagtcccacactggtatcattttagggagttcagaattggtatgcattgtggtaggagtagggacaggagagaacaacaggaatgattacgtgggtggctgagacagatggtgtggacttcaaataaagaaacccagaaggtggtggataaataatgatgagagtagcatcggagagtaaggaaaaattggacagttctatctcaagaactcaaggaataaaggatgaaatcagacttttaaatgtttactacctttaattatttaaatgatgtgacaacaaataacacttggaaaatcatttttcaatgtttttgttataacctcttataaacaagaggattagtttataggaaaagacaaggctgagcaacataacaaaatcaagtgtattttttttttttgttttcagacggtctcgctctgttgcccaggctagagtacagtggagcgatctcagctcactgcaagctccacctcccgggttcacaccattctcctgcctcagccacccgagtagctgggactacaggtgcccgccaccacacccagctaatttttttgtatttttagtagagatggggtttcactgtgttagccaggatggtcttgatctcctgaccttgtgatccgcccgtctcggcctcccaaagtggtgggattacaggcttgagccaccgtgccaggcacaagtgtatttttttcttttgaaaaattatattgtgattttacattctaacataaatactctatatcagaaataaacaaccactagaatgagaaacagaatgtcattacactggaatgtggtaaaaaagaaattgttgttgataaaagaaccaccaacttgtgtatgtggggaaatatctgtttaactgttaaagttttgtgttatgtagaattcttaaataacataataattttttaaaagtcactgagtgcctttcatcaacagttttgataatctgagagcctattcacctgtgaatgattttaaccaaagtaaattgcttcaactctgtgcttaatagatggtgtcagaagattgtggcccagaaaacaggatgctgaaagacatgagatgtacatgagatacacatgtttcagtcatagcctgagtatggtagatgtagtctaggagaacttggctgggaacacaacaccatgtcttcatattcatttcgaatgagatgggggtagacagagatagggtcttcctaaagaagtatattagtttgtttttatatatgcattatttgtgtcttataaagaacagtgttagataaagagacagagttaaatactgtaagatttttattctcactgtgcttaaaaatagcaaccaaaaatatttgttggcagaattaatcatattattgtcagttttaccattataaaacagtactaactagagtgttagtttggtgccacttttaaacatatgaatgtattttacaccttcttttttgtgtagatgaggtaatggaagtccacagtagtgagccgagttttccaaagtcacttatgaaaaagaacaaaactctgtctcaacccacattctttttttttattttatttttctatttttttttttatattttttattatactttaagttttagggtacatgtgcacaatgtgcaggttagttacatacgtatacatgtgccatgttggtgtgttgcacccattaactctttatttaacattaggtatatctcctaatgctatccctcccccctccccccaccccacaacaggccctggtgtgtgatgttccccttcctgggtccatgtgttctcattgttcaattcccatctatgagtgagaacgtgcggtgtttggttttttgtccttgcgatagaaggaaatagagacacaaaaaacccttcaaaaaatcaatgaatccaggagctggttttttgcaaagatcaacaaaattgatagaccactagcaagactaataaagaagaaaagagagaagaatcaaatagatgcaataaaaaatgataaaggggatatcaccaccgatcccacagaaatacaaactaccatcagagaatactataaacacctctatgcaaataaactagaaaatctcaacccacattctttagtacggtgttctgttacccatctcactgctgttgtctgtttgactgactgtggcagttgtgctgattggagcagttttctatttggcctacagtagcgaggatggctgtgtgtcctttcatattctttagcataatcagaatcatatctgtacagtaacaagcccgaagctatcttaggacagggatagtgaatatagatgaacaccctaagaaataagttaataacaatgggaagttagtagaaatggtggagtttaagtaggagcacatagaaatatctgtcgtaaactgggttttaaaaaaagtggacaagaattcaggataacatttctaaaaatagcttctctgtcataagctgttttcctcagttctcactctgtatttcataggtcttagtttttttgtttataaaataatagtattgactttgatatcatccaagatttcttctagctgtaggatttcatcttaaaatgaagatgtcttaagatataaactcttcctaattaagattactgaaccatttggcatgccaaatagtgcaaagctttatatcatactgaatcacagatgctgaagtatttataaaacattttagtaggcatcaatgtaggcatagtgtaggcattacatagaattattctaatgtcccaacatatgagacaggaaaaaatagttaagaatagagcatggaaaaaaaaggggtgaatctaggaattcacaatctttatcaggaaaaactggtaataggggtaaattaccatatagatgatcacccaaaaggtgatctttgggcaattaattgcttaaatataagtgaaatatccatagatcatctatagcattctatttctgtgtaacattaattatatttgaaatttggagttatagcttaaattcttcaaatatttataagatttcaacaactagatatattttttgacaagaggtaatagaagcatgagatacttgtccttcaaggaaagatacgacagatttattacaacacacacaaaatctaaacttggtatccagagaaacaacatatataggatgtgagattcaggagaacaaactctgttgactaaacagagaattgttatgttaagttaaaaggttttttcaattatctactcaaaaagtttatttagctttaatattgaaaagttctttgtaaggaacataagaaaacgtgacgtggcagcctcaaatactagaaatttaaatttagaacttgattatagaatgaatatttgaatttgagcacacacatgtgcacaatctatacaaatttagaattcagaaaatcaaaaaatcgaccaggtttataaaaactaaaaaacaagtttttggtttataataagtcttaagtttaaggaggacagcagttgggtcttgtttttctttccccctttaatacattctaatatctagcaaagtatctgaaaaacagtctttactgaataacgatatctttaatacgttaagaaacacactgtttgaaaaactgaaatcaaagtgaaactctaacacaaaatgaaaaatgtgtctactgtcccaagagtgttccaaaaacatttcaaaggagaaaagcacagggaaatagtaagatgctactttctcatttttaagtgagtgttaatgtgagagaaaaatcaacaaaaatatttctctaaagaatagaataatataatctaacaggggtcaattagaagactgatatttttccttggggaacttttacctccttcactgtcttttaagacaaaattcatcaataatttgaaggaaccatcctgtttgtctgttttcctttgaggaaagtcctttctgtttaaagtttcttttttttaatttttcttgttttcttcacacattaggtaattatcaccattttcagagattggtaattaactgagacatatgtacatgcttacgcttacagcctcattatattatcaaaatacaaataaagttagttttagaaaggatgaaccattgatttgggaatttaatcatcttaagatgtgcttgaattgtttattaacattttattatttgtgtttatattaaaaattagttttcattaatatttagaattcttgcaatttaacttaataggaatagatgcagcataacattctgattcctcatagtgaaagaatttaaaggatattctggatctttctgttagaagaagaggaaatctaaaagaaggattaccaaagggcactgattgtagttttgagctggagaaagtgaaattagaccaagatctggactccaagctgagaagaaaattacacgaagagaaagctattagctgaactcagtagaaaggatatcactgggtcaaactccacaggtggaaaagattttcgattgattaccagttcaagagagtattgaacagagtcactttttgcttgacatctttgggcacaaggtgtttattatttaaagctctgtgtaagaagtttgggtgtcatgatctgtgtctggtacactggtcagtttttcttaaggtctcacgtgtctaaacaaaataactttttatttgttccaaaaaacttgtctagaggaactcaattcagtcattaaataaaaattgttggctgggcactgtggttcatgcctgtaatcttagcactttgggaggctgaggcgggtggatcacctgagttcgggagtttgagaccagcctgtccaacatggtgaaaccccatctctactaaaaatgcaaaaattagctcagtgtggtggcatgtgcctgtaatcctagctgctcaggaggctgaaacagaagaatggtttgaacccaggaggcagaggttgcaatgagcggagatcacgccactgcacttcagcctgggcaatgaagtgagactccatctcaataaatcaaaaccacaatgagataccatctcacaccagttagaatggcagtcattaaaaagtcaggaaacaacaggtgctggagaggatgtggagaaataggaacacttttacactgttggtaggacagtaaactagttcaaccattgtggaagacagtgtggcaattcctcaaggatctagaactagaaataccatttgacctagccatcccattactgggtatatacccaaaggattataaatcatgctgctataaaaacacatgcacacatatgtttattgtggcactattcacaatagcaaagacttggaaccaacccagatgtccatcagtgatagactggattaagaaaatgtggcacatatacaccatggaatattatgcagccataaaaaaggatgagttcatgtcctttgtagggacatagatgaagctggaaaccatcattctgagcaaactatcgcaaggacagaaaaccaaacaccgcatgttctcactcataggtgggaattgaacaatgagaacacatggacacaggaaggggaacatcacacaccggggcctgttgtggggtggggggagtggggagggatagcattaggagatatacctaatgtaaatgatgagttaatgggtgcagcacaccaacatggcacatgtatacatatgtaacaaacctgcaagttgtgcacgtgtattgtagaatttaaagtatactaataaaaatgaaaataaaattaaaaagaaaaataaataaataaatattgttagggcctatcaggttccaggaattgtgccagatcctgtaattgcaaatatgagtaaggcatattccctgccattgcagaatttatcttgtagttgagcaaaagtgaaaagtacacagaaaacaccttgtatattagaaaacatagcatggtcaattgatctgtttctctaataggcacatatagcacttttaaaattgtattcttctagggttgatagaggaattctattactaactgaactttgttgattaagcaactttcagatattcgaatatttgaaaggctaaaaaaaaggcagcctcttctttgaacaagcttttaggagtgatcactctaacagcaaacatctcctttgcatgtaaaattaagcaaaaacttttcttttactcctttcctttccattctccttttttcctaccacttcagcccaaagccctaaggtggcactgaacacagagggagggcaatggtcagtgtgagtagagagacacaacttaatgtagggagagaaaggcatccatgtgtgaccacatatgtgggtataagtagagcaaccacatggcatcagagcccaagcaggttgaggatagagtcctgatagaaaggcagccttgcttggggggcgagaacctgtgcaggttggtaccaacaatcctatggatggtaccctggtatggcatgtcagaacctgagcaaggtaaagaaggcatccttgtaggaggacttttcaaaatgcagtgtaagagcctgaccagagtaaagagtattttcacatgggaagggtactttcacccagcgaagttggagtgccaaagccaagtcaggtggggagggcatcagtgcatggaaagaaagcagtttgcccttcggatctggagtccaagtggggtgggtatgttgtccatgcagtatctggcccaggcagggtgtggtatggagcctggccaacgtgaagtggtctggtgtatggcagggtagtgcagagcagcatgtcacagagagatttattttaaggaattggttcacatgatcatagaggccgacaactgcagaatctgcagagtgtatcggcagactggagacccagggaagacatgatgcttcactttaaattcaaaggcatcctaccggcagaattccctcttcttcagaagaggttagtctttatctattaaagccctcaacttattggatgagatgcacccacattatggaaagtaatctgctttactcaaagtctactaattgacctaatttcatctaaaaaataccactatagaaacatctaaaataatgtttgaccaaatgttttggtccattagtgttgctacaaaggaaaacttgagactaggtaatttgtaaggaaagagatttggccgggtgtagtggctcacacctgtaatcccagcactttgggaggctgaggcaggcagatcacaaggtcaggagttcaagaccagcctggccaacatagtgaaacctcatctctactattaaaaaaaaaaaaaaaaaaaagtagccaagcatggtggtgggtgcctgtaatcccagatactcaggaggctgaggcaggagaatcacttgaacccgggaggtggaggttgcagtgagtgagattgcaccactgaactccagcctgggtaacagtgtgagactctgtctcaaaaataaataaataaaaaagagaaagaaaagagatttattggctaatggtactgtagtttctagtccatacacgaagcatggtgccagcacatacatctggagagggcctcaggctgcctctactcatggtgcaagggggaggggagccagtttgtgcagagatcacatcatgacagaaaagacaagagagagagacagaaaggagggaggtgataggctccttttaacaacctgttctctcaggaactgacactgcaacactccctcactccccgctaccaccacaggggacattaatcatgagggatccatccccatgacccaaacatctcccattaggcctacctccaaccttggaaatcaaatctcaacatgagttttggaggggaggggtcaaacaaaccatatccacactatagcaacaaatatctgagtattttagcctactcaagttgatacataaaattagccatcacatttgggaaataggctctgaggtataagtagtctcattatggctgattttaagctatcaacttcacgtcactggatgtaaactacagaagaattatatgaacacaaccagctcttgtgagcaggtattagccagcagcagcataccactgagttgacttgagttatgaagtctgaatggaatcttcttccaatcctatggagggttttgagaatgggacacgacacccttcaaaactgccccatattggcactagtgagtgagtcagatcactatgccctgaatcaatcaatccttggatacaggctgccttcagaagggggcaaggctttgagaaaggcagctctcttcaatttaggcagttttcaaagctgggctgataactggagctgctcactggcagcactccgggtaagtttggtaataagttacttaatggtggatgaggatctaggcagcacatcgtagcttcatagcacccaccgtattcaatgatgagtctccgtgattgggtctcactaaatccataaaaagaaattggaggctgactctctctctctctttcccttagagagagagagtaagagagagagaacccagttacatccagagttctagggagcagaagcacagtgctgcaaggaagaaacttcagctgaatttcaggcagaccaaggctcaactgaatttcaggcagaccaaagctcaaattctaaaagtattattttcttattaccagcttagttgagtcatagaactagtctttcatcattgaaagtgtatacttttaattgttagggctactgttttaatcagggtttccagctgcagaaaagaaagattatttgcctttttcctgccttcttgttctatctgggaccttagccaattggatggtgcctgcccacattggatgagggcggatcttccttactcagtccactgagtcaaatgctaatttcttccagaaacaccctcacagatatgcccagaaataatgcttttccagctatttgagtttaccttaattcagtcaagttgacacataaaattaaccatcacacccaccaaaactgtattcaataagggaaaggtaggagatttgatgctggactgctatccacgttgtttacagtgaccatatatatgattgactcaggtctacacctgcttcctggaataactataataactgctcttttactccccaaagagcccagtttgagcaataaattacattgttatcctaatatgattgcttctacaagacaggcagaatagcaagcatagtgccagatgtcacaacctttcactgccatgtgaaacctgggaataataataataataccttttaagactgtcatgggaattaaataagataaaatatgcaaaaatatacatgctaagttattggaatagcacctaagtattattatattttccttgtgatggcattttatattgccccaaaatgagtaaatattaaaatgtccctacaatagaattccaacatgaaaatatccagtgccaataataaaaagaaagaaatgattgatttttaaacaaatgaataatactctggaacaacttgggtagtttgctggagaagctttcaatgcagaagtcttgggtcaaacccaaaatcttataagcagtagttgtttttgggtaatttgcttaaactttctcagccttgggtctctcaattattgggttgtaaattatcaaaagaatatctttaaagcccatagtatcttcctggccctcttagacactcagcaatgttaatttccctctcctggctgaaaaaagtaactgaggttaggaatatttttcagaccaaacaaatacatggagggcttggaaggagtcttccaaactcctcaaagcagagaggcttccatcctcaaactctccttatcaaataataaaattcttatttatggggaaggatgggagggaattaataccacctactactctagaaacttgttctcaattccgcttgccttctacctactccaccagaaacatttcctcatggcttgaacgacaatatgtagaaaagcatgctataaatttgtgtgttttcaatttataaaaatggtttcatatattacacctcagttgaaaatcaagacaatgcatgagttgtcaaatcaggtattagtcccattttgcagatgggaaatatgaaatcccaagaggttacttgacttgcctggataatacagttaataactggaagagacaggcaggatatgaacatacttttctgaactctaaagtgaatgatttgtctgctttggaacactctgaagtccctgactctgaaataggagctcctggatgtgttattaagacaggcacagtgaagtatgaatacataagtgctaaagtgtttctcagcttcacagcttgttttatcagctatttcaagactatttccacttgagagttttgtacttctagcctgctgtgagtcactaatgatataatccattttggaaatggtggtaaattatgggttgtggtaactctgttatgaacttattattattaattacttgccatcacttgccatctcaattgtgttttgttcagtaaacataatatccatgctcaatacaaaaattaaatctttctttctcatacacacacacacacacacacacacacacacacacaatgctaagccagtaataaattttacttgaccttaagtttgagcctcaaatatgaatctggattcctgaaaaattgagtttctaactatctttgccaaataaatatttttgagggtgaatttcaaatgaccatgtctaataaaaatattattttaaaacttatttttattttttacagatgcataatagatgtacatagtttgagggtacatgtgataatttaatacattcataaaatttgtaaagatcaatccatcaccttttatgtttgtcttttctttgtgctataaacattcaaatagttctctactagctattttgaaatctactatacattattttaaactattatttccctactaatgtatctaacattgggtgttattccttctatcatactgctttttggacccattaatcaacttttctttatcctccctccccactaccctttctggcctctggtaaccaccaatcttttctgtcttcatgacgtccatacttttagctcctactcatgagtgagaacacgtagtatttatttttttgttcttggcttatttcatttaacatgacgtcaagttccattcacgttgctgcaaatgataggatttcattcctttatatggctgaataatattctagagtgtgtgtgtgtgtgtgtatgcgcatacatacagagcacattttcttcacttatctgttgatgggcacttacattgattccatatgctattgtgaatagttcagcagtaaacatgggcatacagagatctatacaagaaaaaactatacaacattgatgaaagaaattgaagagtacaaaaaaattgatagatattctatgctcgtggattggaagaattaatattgttaaaataacaatactacccaaagcaatttatggattcactgcaatccctatcaaaataccaatggcattattcacagaaatagaaaaaaatcctaaaatttatatagaactacagaagaccccaaatagacaaagcaatcatgagcaaaaaagaacatgagtaaagctataggcatcacattacttgacttcaaaagttactgcgaaactgtagtaaccaaatcagcatggtattggcattaaaacagacatatggacaaattgaacagaatagaagacccagatataaatccacgtatttacaaccaacttattttcaacaaagatattgagaacatacactggggaatgaacagtctctttgataaattgtgctggggaaactggataactgtagaagaatgaaactagaccccaatttctcactatacacaaaaaaacaaatcatttaatttgattttttaattaaatttaattaattaaatttaaatttttaaattaaattaaattaaattaatagattgaattaaagacttaaatctaagacctgaaacaatggaagttgaaagtcttaaagaaaacatttgggaaatgatccaggatattgttctggaaagtattttctgtgtaagactttggaagctcgagtaaccaaagaaaaatagacaaatgagataacaaagctaaaaagcttctgcacagcaaatataacaatcaacaaattgaagggacaacccacacaatgggagaaactgttagcaaacaattcatctgacaaggaattaataaccagaatatataaggagctcaaacaactcaataacaaaaaattatctgacaaaaggtctgaatagacatttctctaaagaagacatacaaaaggccctcaagtatatgaaaaaatgttcaacatcactaatcatcagagaaatgtgaagcaaaactataatgagacattatctcactccagttaaaattacttttattaaaagacaagcaataatagaagctggaagctggcacagatgtggagaaaggggaatgcccacacactgttggtgagaatgtaaattagtacagccactgtagacgatagtatggaggttcgtcaaaaatctaaaaggaaaaccagcatatgatccagcaagttttctgctgggtatatatccaaaagaaaggaaatcagtgttctttgaacttaaattagatatagataatttaattgtgatgagtttgcaatttatgattttcttgatttgttgtttgcaaagataatttaaggtacattaaaattacgcagtctcaaccccttcactgattggctggatggtctaagtggatttagctagactacctcagagtgttttcaaatgcttaatcaaatactggtattcctgttaagggaaagtgaatagggcagatgcaattacagtttaagctggggtgagcagctctactctagggcactacatctatgaaaccacacaaaaggcagacactgatctgtatagtcaaagactctaagaaacaagtgaactctggggtgtacagggtaatattaaattcaggtagataaatctgaggattttttaagctaacataacagttccatgagcaagttggaaagcatttaatgaaatagatacacacgacctttgaaaagtgaacattaacttgtacttgtctaaaataatcctttctagtcaaagaaggtttttaagcaagatgagttttggagtgtttgagtttattaggtttacttaaagatataacctttatttcctttcttctatgtaaggatatacaggaaacttgacatttggttaattgactttttacatttctcattgggaaataagactgaagctttatgaaaattcaaatcaactacgtatatgggatttttgtttctgctatgtctcatttttcattgatgactacaatagaatattatcacgtttttctagctgcatgtctattataataataaacattttcagtcttgggaaatgaagaaaatcttcttgtcaacataactgtattgctttccatatacttgattagaaagcctttgcatattaaaaagagatttactgaagttcttatgaaaacttgagctgatatttcatttcaatgtggttataataactagtatatttttcttgagcaaataatgcataatattccctatcattttgttaatttgattagacgggttataaattcaggttttctaatctttgaaagaaccagtgagccaaacatctgcatattcttacccaatgaatacacacctctgttaggaacttaactcataattggaggaactctagcattctcttttcattttctggaacattttagtttatccagtaaacacatcagtacatgacatagttaatctgttcttttcagatgttctcctgatcaatactgtgatcaaatcaatttataaacatccacatagatcacataacaagacactttcaatgtaatgagattcattcattctgtggagaaagacatgagcctttctactgtctgaataaccacatttccatacagatactcaatatgaaaggtgttagtcaggtggcagaactgaaaactattctggagggaataattgaagctaaatgggattcttagtgctaatttggaacaagcaggatattttaccaagctgtttggggattcttaacctttaaatgccacaggctccttggaaaatcttgttaaaactatagaaaccctctgagaattaatttttaagtgtacaaaataccaaaaaatatatatattgaaatatggtcaccaaaatagtttaaaataaatgtgtagtagggtaatatatactggaaaattatctctatcttgaggtacttctaataactatcataatttcaaaatagtaacaagcatacatgataatcccagacacttgcaactataatgttcttatgaaaaatctatgatttatattatggataaagtaccagttattgcagtacgtctatggtttgctgcttatagtcataattaaagtaaatgttatttcttacttagaaattaaggaaacatattttcccccatccaagtttatgaattctaaacatggaccactgtcaaggtagtaaaaaaaaggttaagaaaccctgtgttaatgatttctctgagaggcagaagtgataacgaaaacattagactatgctacatagatcaaatatacacacagacacaaaagagagaacataacccattttgtactagaatttccggttctttgttataagaatctgtgcctcttagaagtcagcatgatgcagagtatgtttgtttaaggtctagtagaacatatatattatttatttatttatttatttatttatttatttatttatttatttatttatgggatggagtctcgctgtgtcacccaggctggagtgcagtggcgcgatcttggctcactgcaacctccgcctcctgggttctcctgagtagctgggactacaggcgcccgccaccacgcctggctaattttttgtatttttagtagagacggggtttcaccgtgctagccaggatggtctcgatctcctgacctcacgatctgcctgccttggcctcccaaagtgctgggattacaggcttgagccaccacacccggcctagaacatataatttaattaataaatattcattttaagaattcctgatatcaaaagaataacaagacagctatttggtttatggtacatatttattatggataatggtatgaatgatgttacataaaaccaggaagaggaaaaccatgattaagatgttcatttagtttgtagtgtttctattatggctattgtgctatccatattcccctaaaatgctgatttttgaaaaggtgtttaatatatctcatttaacatgtcaaagcaaagggaaaattcttaataaaaatacttagtgacttcattttatttaaatattttcttagcccaaatttatggttttggttatctagactattgttacttaaattgtgggccagggagcagcagcatctgcaactgcatgggaacttattagatatgcagattcatgagacccctctccactccaaacttactgagtcatcatttggaggagtatggctaaggaatcagtcttttaagaaccatacataatgttcaacaacaataactgccagttaactaccaatatttaaacttagaaagattttatattaaaagaattcagaattctaatctcaagaaaaaagaaacagacaaaacaaggatctgctgtggtacatccagacaatggcatatcattcagtgatagaaagaaatgagctctcaaacgagaaaaagacatggaggaacctaaaatgcatattgctaaattaaagaagacaggcttagaaaggttatatatagttgaaactctatggtttcaactatatgacattgtggaaaaggcaaattacagagacagtgaaaaagccatggttgccaggagctggggagggggaatgaataggtggaacacaggattttagggcattgaaaatactcttgtgatactacaatggtggatacatgtcattatccaatggtgaatccatacatttgccaaaacccagagaaagtacaccaccaagagtgaacctgattgtaaactatggactttataataatgcatcactattggctcaaccattgtaattaaagtagcgcattaatgcaagatgttagtaacagggatactgtgcagtaggaatagtgggctaggggaaagggaatatatgggaatgctctcaatttttctgtaaacctaaaagtaaaaataatgctatttaatatatatgtacatacatatatgtgtgtctacatacatacatatgaggcagagaaagaccagacctgaaaagagacctggcaacacaggactatatttttgtgtaattctgcagctgagtagtagctacccctttttgaagggccaaggacacaccaacttgcttcaatgctcaacttgccattttaagaatttgatttatatacttctggcttctgaacctttatgactcaagtaatgcaaaagcaagttttaggagcagaattggtattaattcattcagtaattgcaaattatttgctcttgagaactctgggagaggataccactgtcaccgtcttctgttactactgtgcttacctgtgattattgctgcagctgggccaggaaacatgccaacccttattcaccactataagttaggtgctaagataaggtagaaacttgctggaggtcacacaagtacactggctggaagagggtactcagaatcaccaggctatgccaaattgtttctggttactttttcatttggtagatttggcagatatttttcaaatggaaattagaatttagtgtgaagaaatgttatctaaaacatgggaactgctaagggaattgaacaatgagaacacatggacacgggaaggggaacatcacacaccggggactgttgtggggtggggggagggggagggatagcattaggagatatacctaatgttaaatgacgagttaatgggtgcagtacaccaacatgcacatgtgtatatatatgtaacaaacctgcacgttgtgcacatgtaccctaaaacttaaagtataattaaaaataataataataatgtcttcctctcgctcaatctgcacacggagttggtcacaaagtccttaattgtatcaattaacatattcttcaagtcttctctcactcttccagttccattgtcctcatcatttgctgcctgagggtttgcaatagcttcttaatttatctccctgttgccggcatcatggtcaatgtcctttcccattcagccagctccagtttctttcatgagtctgccagaattgtcttctaaatgcaaatagtaatcatgtggctcccttcctaacatctttcactgatattctagtctaactgctttagcaacatttaaaactccttcagacagcctttctaagtttatctgcagcctcagtcccaaaggtgcattaggatccaatcacacagaaccaatctgagatttttagagctctcagttttttcttactgataaaactcttttaccatggcgttccctttggtaagatttcctttattgccacatctgcccaataaactctcacttatccttcgtgtcccaacaaaattatccctgtctctgaaactccttctactctcttaactctaccccaggtatgttaagtagtaaccattaccagaacattctgtttataccaatattatatagtttattatggttaattttacctgtcagtttccctcatctagagaatacatcagagactattttttgtctattttcctagcatatagtaaatactcaataagtattccgtgaacaaatagatatgagtaaatgagtgaatgaatctgcatgtgaaatatataatgctgttttgctgatttcattacaaataaattgtgaaaagggaaatttgctggtaaattacatgtatgatttaacttcctgttgattctctcatactcattttaaaattaaaagtatatacaaaatgttcttaacgtcaggaagtgtgaggcaaaactgtcaaatgtggaatatcaactctgaaagcagcctgatttttgcagggttgtatctttgagtattaaagaactttactaacattcatttgaaatataatgtcttgggttttcatttgtattatgaaacaggccacaaagacgtactaaatgctcatctttaagggctttctttttctcatctgacctttataactgaaagaagcttcaagtacaatttcataagcagcaaagcagcttctccagaaatgacatttgtcagtatttctggtttggggaccctcttccatgataaaaaaaaaaaaaaaaaaaatcttaaaaggagtgttttcagctaactcagacatgattctatttgttacttgagtgcatatccaatcagatactcagggaggcagatgttttggacacacgtttctctatagctgacttagagtgcattttattatgtgcttggtttgaaaacaaatttcacagcaaactttacagaagtatgctgcttagtttgtaatgcagttcacacactcagcatgaataccaatttatgaaggtgtcatcaagttgtttaaaccaacccaaacacacataatacagatggcattgtaggcatcagtgcctgaaaaataatttgtgacatctgtagccttctctaatcatttcagttttttgtgctttttattcagtgactcttttatgccatttcaaaatataaatagactcataacaatatagaaattgttttttgagcattaaaatgaaaattttattgtatataatttttgttattttattatatttactttaacatagctagtatattaaacattttggtaggtctttttttctccttgccttttatggatctttttgtcaggcagttaaacaaaccacttatttaaaaaaaaatacaaatattgctgtttaaatttacatttacaatttcttgctgaaagatgtacgtttctacagttataagtacctgttaaaaaaatagatttgtttttttctgattataaatgtaattaatgcattttggaaacttttttaaaaatccacaaccatgtataagaattctaaaaatcaccatgcataataagcgtagttaaaatgttgctattcataattctcaccttctttttctaaattaaagtccctataggggtgtatctatctgtatatctaaattaacctgtgtgataaatattttatggtagttgttttatttttattttttcctaatatggtctatatacttaatttcattgctcttttttaatgtcattaactggagatctttataagcatgttagtgataaaacaagtgttaaatgaaaatatagttgacccttgaacaacatgagtttgaactgcactggtccacacatgtgcaaggatatttaaaaaaataaaaaccatcaacccttaccattggtgggttccacatccacagccaccggtgagtggtattgtcaggatgcaaaacctgccataggaaagagccaacttttcatatctgtggttttcacagggccaactgatagacttgaatatgtgcagattttggtatccactgcattcctagaaccaatttcccattgataccaaggaatgactatattgctttgaatttaatcaatactttattgttgtatatttagtcacttttatgattttgtaaaccatattgacagtaaagtgttgattatcagtaacacttcggggaacagattttagcactaggatgagaatttagaaggaaattaacaaaataaaaatgcatcacttaaaagaaaaatattttatccttgaagagaaaacactcctcagccttgctaccaatgaggcatttatttaatacttatgtttatagcatttctcatatttacattaacattttttctctctggcaggtaattggtaaaataacaattttaggttttattacttgatttaaagtgagtatgtattttccccaaaggaataatttaaagttgaaatgaaacaatgctattttgctttttgaaaaacaagtttgataaatttttacgatatgatatatatttatagtctttaaagttttaactataaaatacattctttttctgttcacagtaaatatttactggatctcataggtaaaaatagaagtaattaatattcttattaatcctggatgactgcaggttacctttacatatctcttacaggttgctcaaagtattttttcatactttaaaaataaattacaaataaatatttaacataaataatatttcaccattttcgtcagttccttagtatctaagctaatattacaaatgtcaaagtctactaattagtgtattccttaagaacattattagattttctctctctttttttttatgtttatatgttattggttatcatttgtctctcttcccttgtaagaacttttaatatgagagtctaataagattaacagtgataacataattgaaatactcagagatatttagggaattcttaccgaatatcaaacactatgctaactattatatatgcgttgactatttaatttagaacccactcaacttgtactatttctagctccctttgcttatacagaaacaaacgcttatagaggttaaacaaatggcccaacccagcagtgctagtaacttgagaaatagagtttcaagcccagggtgtctgactcccaaagatatgttaatcatttgactactaaacttgtaacaagacaatgtttcatttcttcaatgcatttccagttgcgcatactgaaaagcataaattgctgttttttgtgtgcgcatttggtaaaagtacttctacatatttgaaagttgtcaatgtattctaaatatcatgatcagatatatctgagcttcaaatggctgctttttgtgtacaataatattggttctattttgtggtcattaaggatctttctttccccctatccatgtggaataataagccagtagttctcaaacattcatcttaaaaattattgaggaacccaaacactgtttatgtaggttataactaattttatctgttttataagaaattaaagcagaaaaaatatatatttattatatggtatataatatataaaaatatgtattatatttatataatataggataatatatttattatatttgtataacatataaaatatatttattgacattggtgttgacccctttttaaaataagagtaggcctggcacagtgactcatgactaatcacagcactttggaaggcccaaagctagaggatcacctgagcctaagatttcaataccagactgcgccatttgtttctcagggacaaatcccacttgatcattgtgtatggtcttcttaatgtgctgttgaatccagtttgctggcatttttttcagaatatttgctttcatatttattagcaatattggtctgtaattttcttttcctgtagtatcattgttttggtttggtatcagaataatgctggtcttgtggaatgagtttagaattgttcctcctatttaatttttttggaagagattgagaagcattggcattgaatcttctttaaatatttgttagaattcatcagttaagccattagctcctagacttttatttgttgggaataaataccaaatcaatgtttttagttgtaattagtatgttgagattttctatttcttcctagttcagtctttgtgaattgtatgtttatagaaatttatctctttctgctaggttatccaatttgtttgagtataactgttcatagtagtttcttatgatcctttatacttgtggactctctttcatttataattgtatttatttgagtcctctctctttctctgttgtttagtctatctaaaaggttgcagactgagtatggtggctcacgcctgtaatcccagcactttgggaggctgaggcggttgattgcttgagcctggaagttcaagacaagcctgggcaacatagcaaaaccccacctctacaaaaaaataaaaacattagctgggtatggtagtgcatgcctctagtcccagatacttgggggactgaggcaggagaatcacttgagcccaggaagtaaaggctgcagtgagccatgatcatgccactgcactccagcctcggcaacagagtgagaccctgtctcaaacaaacaaacaaattgaaaaaaacttgtcaattttgattctcttttcaaaaaaaaaaattcttagtttcatttttcttttgattgtttttctaatctatttcatttatttctgctattatcattactatctttactatgttttttcttctgctaatttggggattagtattctttttctagttctttgaaatggaaagttaagtttatttgaaatttttctttattcttaatatagacattaattgttatagactccacagggtcttgctgtgttgccaaggctggcctcaaagtcccaggctcaagagattctcacttgttataaccttatcatgaattaacccatatattatttgaatttataaatttataatatatttgaacttataaatttataataatacatgggtaaaatatattatacgaatttacccatagattattatagaataaccttctttatctcaattgtgacaggttttgacctataatctattttttatatacatatacctgcctcttctcactttttgtaactcatagaatatgctgttttaccctttgctttcaacctttgtgtgtacttaagaataaaatgagtctcctggatactgtttttaatccattcagtgactctctgtgttttgattgaataatttaacttctttatacttgaagtaattattgattgagaaggatttattattgtcatgttaattgcttttctgttttttaattcctttgttatttttttcctatcttgctgtcttcctttgtgatttttttcttttcatagtgatatactttgtttcctattctgtatcatttacagtttcctctttgtgattatcatgtgtcttagtctgtttagtgttgctaagaatacctgaggctgggtaatttgtaaagaaaagggatttatttggctcatgattatgcaggctatataagatgtatggcaagagagaaaacaagagtagggagtagaagtgccaggccctttttaacaaccagctcacaccagaacttatagagcaataactcacttattactgcaaggacagtgccaaacctttacattttttcatataatatatcatttaaaaagttattgcagctctagttatttgtaatactttaatcttaacttttatattagaattaaaagtgatttatataccaccattagagtattagaattttcttaatttgatggtatacttacctttgccagtgagttttatgcctgcatatgttttgatgttggtaattagtatcttttcattttaactagaagaactttctttagcatttctagtaaggcaggtccagtgatgataacctccttagattttgtttgttgaagaaaataattatctttttatttgacagctttagtggttatcaatttcctagtgggcagttattttctttaagcactttgaatatgtcatttcactttgacctgacatgcagagtgttggctgaaaaatttacagataatttcatgaagtttcctttgtttctgataaattgcttttctattactgctttcaaaattctctctttgtctctgacttttgacaatttgattatcatatgtttcagtgaagatgtctttattctcaactaattggaattctttgggctttatcaacctagatgttcatttccctatttgtatttgaaacgttttttgtcatgaattatttaaataagctttctacacctttctctttctctatcccttccgagattctcatagtatacatattaattcacttgatagtgtaccataagccctataggttttcttcacttttttattgtttttactttttgtttctttgactggataattttaaattatctgtctttgtgttctctgattcttatatttgattaaatctgctgttaaagttctccattgactttttcagttcagacattatattttttagtttcagaatttctatttttttataatttttatctccttgttgaacttctcatattgctcacttattgttttcctgattttatttagtaatctataagttatgtttctaaatgattatttctaaatgattacctacaatgaagaatctgactccatatcaaggtactttctatactctgccgtattaaaatgtattgcctagcttgtagttcaaatggatattttcactcatgctaaactttgtaatattatttactgttcatttggaaaatattttttacttaattattacagtcttccaaatatagcatatttcatattacactagttggtagttttatgtcataaaattacattggctaatagcatcaccaatctcatcagagaattttttttacacattgtaatgctttcaagctcaaggtgaatgatacaagtattcttaaattgtaatttttgtttaaaatcttgaatttttattatttttaaaaatctactactgtcagctgtttacatgaatagcagcattattttgttaattttgaagaaaatattaggcaaattcccaattgttaaatgacagtttgtctgtcatccatcctttccagtaacaatgtcattagatgaaaaaaacagatatgttagtttgcaattcaaacaatctcatgattgcttattttaggcaaccattatatttacgtatgtagcagaagttctttgggcatgctctccgtttcatctcacagaattttcaaaaggtacatgttgttgctgcttacgttatttttactgggaggtgaagaatttaatgatcactagtatagtttgctgccaactggatttctctaagaggccagcaacttacctaccattgattttacatcatcagtacaaatgtcaactctgtgacaaaggcaaatatcttagttttgctttgaaactagttgagaaactctacaataatccatcaaaacttctttgcttggttctacttgaaaccatatgcctatgttattgagctaaagtaaaattgttttctcacagtcctagtagacttacaggttaagcccatgactttgaccctgagtgcacaaaaggactaatttagaagaatgtgttgcattaattgtgattatactctttgccttcaaacttaaaccaaatcatataggaagccagatgtcaaagaagcattctatcattgcttcaagtttatatatggtaacaaactatgtattgagaaagtatctttctgatcatatgccattaagtctgagtagaaataagaagcaagattaaataacagaaccaaaaaaaaacccccagtttattatgaaaataaaatagtatcaaagtagtcttacaacttttctagttttatccctcttacagactcagtctgaattggtgagtttattgccctatagaaaacttcatggttatatgaggaaaagtgaattctggattaccagttcatattgcttaatcaagatctgataaagctcttcaacctggtgctttttgtcaaacatatctgattttactgtattttaaattaaatttaaaatgttttagacacataaatgcacttttaaaattgtgtctagtataattttagtaacattttttatttaaatattctccagaaacttcttggaacagttaagtgaatgagtaagaaagagataggagaaaacacacacacacacacacacacacacacacacacacacacacacaacttctaaacatgtttggaaacctcaggtggaatccactctgaggggtatcagccataacaaacatgttaatatatcactgttcacctcatgatggtttcgaaaatttcctttttttgaatatgcagatttgggctagtcagctcaatggtacatttattagcatgtaagtttaagtcattgttttattacttatccttattacactacatgactcattaaagttataggcattctaggaagttagagagacatgtgagctcaaaactggatgtagacctaaacaactacctgagagcacagaaaataaaaactagagatggggaaaagaaaggcaactaatttactgcatacatacaaaatattaaaatggcattttttaatgttataattaaaatagtttttttggtgtttctgtgacattttattagggtttttctgaccataagtgacagaaatgcaaaccctactagttcatcaaaaatagatatgtaatgaagattgttcttttctcttagtattgatgagaagaattcccttggtgatttcacagaaaaagtaagccaagaaaagagtagtgatgtagctaggcatcaggcattctctctctctctctctctctctctctctctctcctgtttttctgttcatattagcttcattcttttctcacagcagtgcaactttccccaaatggtggaaatatgacctccaagatttccatctctagtaacatgactcttttgaacagatgtacaaatgtcagggaaggaactcatttgcctttggtcagatgaatgctctgtagccacgcagaataatgataagaggtcggagtaagggcagtccctgcttgaactatatggactgagtacaaggtgtcaacagtccccaaataaagaggggttattgtagctgaggaagggatggatactaggcagacaaaatataagtttgcactacagagattcattgttacaagattttaaaaatcaggtcaattaagttattataaattatagttataagatgtatccatgctgaataaaaattaaatccattactaggccaactgccagctgaggaaaacaaaacacaaaaagatgctatgattgtgagcctagcaaagctttgcatgtaaattaattagtatttattaatgttaaagcaaaaaagataagaatattaatctcctaacagcaaagaatatttgatgaacagcagactattttcaaattagattgctgaatatttcatttgtccttgtatataacaaatggagtaggatgtgaccttttttttatttaactttaatgttattttggaaataaaaattatcatggggaaatgtataggctatttcattcttaaagtacaaagcatatctcatactcaaaatatagtatttcatttttctgcacatttctctagataatatttttaagactgtagtttgacagcttactaataggttggtgcaaaagtgattgccattacttttaatggcaaaaactgcaatcacttttgcaacaacttaataactagtcttgaatcaattatttaaatttactatgcctcagtttcctaacataaaaaaacgggcttaataatccaatccaaaaaaattaaaatttttgaattaggtgatttaaggaaaacgtttggaactaagataattaaaaagctgttcttattcatatagttgtactctgaccattcagactagtgtatagagatggaatggagatgcttttaatgttcttattcatatagttgtactctgaccattcagactagtgtatagagatggaatggagatgcttttaattataaataggacatataaaatttaaaagttggataatgttatggactgaatgtttatgtccccaaaattcatatgtggaagccctaacttccaatgtcactgtatttggagatggaacctttgaaaagtaattaggttattagggcaggaccttggtctgatggggctagtggccttatgagaagaggcaccacagtgcttgttcactttctctcttctcacgtgcacaccaaaaaaaaaaaaaaaaaaaaaaggcgtgtgagcatgcagcaacaaggaagagagtcctcacgtccgcacctgagcagccatgctggcaccctgatcttggatttccagtttccagaactgtgagaaaataaatttatgttttctatggtattttattatggcagttgaagcagactaagacagatgcaaattagaggtttacatagaaaaaaaaaaagaatgatttgaaatggtaaacataacagtgttgtcagcttccatcccaataaatatgtcactaaccacattttattccaccatccactcctactatggtggagtaggataagaatggattagtaataagtaaagctgtttgatctacattagtaaaaatagcctcacctcataggaaaaaaatggaaaaagattcacatgtttatacctataacagtgctacttaaattgttctattgttagctttaatatgtaaaatacaggtggttgttaaaaccatataaaaacctgaatttaaaatgttttttaaagctaaaatgtcaggtcataaaatacaccgtatttggtgtccttcttgtgtgtgtttttcgttatcttgttctcaatgaaattccctcaaatgctccttagaggcaggtttgcttgcagcagggtccatgatgtgagaggactgtaactcaattttctgatttaatagtgcagtgttattcaagcatgaaattacctattcatggagagcaatcccctttgcctggcaagtcaaggctcaaaaacttgatgtctactgtgattacagctgttgacccaaccaattgttgctagaatcagagttaagtttttctgtatgccccactgaggaaaatatgtctctgtgaacagctaaaaggtgaaaataggtatgtagctctccttagaatcacagcactatgtgattaacatgctgggttaaaaagaaccaaatataattatagcacaaatggaaagtatattgtttgaacttttaggttcagggatacttgaaaagtgtatttatttaattgacattcggtttaaacaagtttcttttaacaaaaattctaccaggtttaagaattacagaggaggcaaagtccaactcagctttgtctgtgaccatctgctctataggaaacaatgaaaaacaatttgattttcctcattaacctaatcaaacaccataagtgcagttgtttagcattgcaacctctgaagtatgaaaattcaaatagtgcaaacttgtccaggagtaattttgagccagaaattttaactacatatgtaattgtattttttcctagtaatcacttcaaaaaaggaaacaggtgaacctaattttaataatttatttttaatttatccaatatatcaaaaacatgattgctttcaacacttaacaaaaacatgtctgatgagatactttatattcttttattcatactaaatctttgaaatctggtgtgtatcttatacttaatggacatctcaatttgaaatagtcatatttcaaatgctcaatagccacatgcttctatcatattggactgtgcaaatctaccatccttaacatcgtaaaatattctctctgaactcaagggttttcagaacctttaagtggcaaacactggagatgtgaaatgattgagaagaacaaacaaggctgcctgctctaatgaggtgttttcagtatgataaggctatctaaaaaataagttttctttttttatgcaatgggaaaagtcacaaatattctctcacacacacatttgcacgcgcacgcacgcacacacacaccacttaaatttttggctcactgacttctcttttcctgagcagagtaatggattaagaagtttagatgtatttagactttagactagacaactacaatttcagatgaaagaaaagagcttggaaagctgcacttggaagcaagaaaattgtcattttcggatgagatttaacagagagtgataggagagactgaaaacatcaactgtaggaagagaaattcagaggggtaacattttattgtgcggtatgaatgtaatcaacctgagtaatccactccatagtttttggtaaagtttaaaccacttttcaacttggagagatgcttaactgatgatggttttctgaaaataacgtgatacctatgaaacgggaaaagttcccttatccccctcacagggcgtgcagtggggtgtggctcgcttcttcggtgccccaccactcaaaaccccttgggagagcaggcagatgggcaagttgtggggcttcgaccccacggcagtgtctaggggtgaatgttacagctcctgaggccccagtgggcgtgtgttaccatgtgcccttttagtttagccaaccgctgttggctgtgtttatcagctcagttagaccccccgccttacagcaagcacagagggctttctgtatcccagggtttcttgccttggtgtaccagaagaatcggatcacatgtgggcttggagaatgagtgcaaggttttattgactggaggtagctctcagcagatgggggaagccagaaaggagatggagtgggaaaggtggttttcccctggagtcgggctgctcagcagccaggctctcctccaaccgccccggggcaaactgcgcatcatttcaccagtcatggcttgacggtgcctttcagtgtgctctcaggccggtgcgtttctctccacgtccagccacttatcttcttctgtcagtgtgttcctctccatgtccagccgcttgtgtgcctgcccgctagggtctcggggtttttataggcacaggatgggggtgtgacaggccagggtgagaaatccaacatctgggtgcgaagccaggagtgcgtcctcacctaggtctgcgggtccaggcccgggggtggaaccctacccagggacccgcccttctcctcccagctcttccctgccccactcctgtatcacctacatggaccatgaagtcagccaggtttatttgggttatatttacattcacatggattgaatgacatatatatatatatatttaacagcattatgaaataaagtaacttgtccgtttgtgtgtgcaaacaaacatggtgtaaaacttcaggtttatctttataaattttttttatctttgttagccagcaattaggtccatttttatagatgtttctggtaatttgtttgttttagtcacatacatgaaatttttagaaatattatttaagttatttaaaggctgatcttgaaggacaaaggttttcagagtaaaaatctaaaagttttaaggttgttatcttgtgatttacttaaggcttatgtgtagcttgaaaaagatgttaaaatctctttgctgtcaagagctagtttcaatattttagaagcacatgacttaaaaatctgcactaataattctcattcacaacattgaaagttgggatttgttgagttctttaaattggctataagttccatttcttgagtaaaaagctattgaaaaaaataattagaatagttagagtaaatgtcacataaattaaaacattttgactaaactattagtgtgtgtttgtgtgtcagatcaacatagtcatgtgtttcttagcaaggaactattcacatatgttttgcttctgctcaggataagagtacaaatccctctggctctttctgaacaattacaacaaataattttatttgaaaatatttcataaataatttataattgttatacacacaaatattatatgtgtttattcttatgattcacttcaactttatctggcaatctcaaatgataactgatatctctagctgcttagttttttattcttgttaaatagaactcatggactcaggtttgcagacatccaagttgtgttgttcagttgcatctccagaattaggtcatctctccttggggggcagtagatggcctccctcagaactaaccagtctgcagttttgtttcctgaagaaccgtgaccatgacgaaacatcacttgaatgttgaaagtttttatttctctgtaacttttctccagcagcctgattacctccagattcctggcctgatcagtgacagccttgtcctgacagaggctgatgaaacacaccaccatgtcccaagaaactcttgattcagtgctgcaccctagtaccatagcaataataactcatgtaatttacctcctcttattgcttgagagtgaatgtcaaaagtttactttgctttctaatgtttataggtaatacgtgtgagcaagcttcttgggttttaataccagctccacctctgactatctatactgttttgggaaaattacctagcctccctaacctcaatttccaagtctgtaaaatgggaataataatagcagcctattttggaggattactgtgaatattagatgagttgagggcaagatgtgttaattcctgtaaaccaagttgaataggacctggcaaatggtaagcaaccaatagataccagttattattaccatcgtaagataagtgtatttttgcagcagtggctctagactgcacagcagaatcacccaatgaaaattttaaaaatcaagctacttgtgtcccagcctaaacttactgaattagaacctcaagaggtaagtctcatcatgtgttttttttcttttaaagttccaaagatgattctgatattgcagccaagtttaagtcttactgctgcaagaagatattataattctaattggtgtccagtttttattaattacaagttaatcatatactaacactgaccattctgtgctttattgactctagaccattattcagtgtcattattaatgtagatatctcaaatgagaggttgagaccaatttttttcctatgccatttacatgccatttttaaaaagtagagttgggaagaagagcccaccgggttgaagtttaactatgaaaatacagtgtagacagaaagggaaacctagattttagttcagccttagagtgaacagtcatttcctggggaattgttggtgaaaggttgaatttacatgaaccagatggtaaatctgaattttgttgtatctttgtttcccccagtatttccactgcccctttagagcacagttgcactacagtcagggtaaactttttcaggtttgccccaatattgttattagctaagatttattaaaggccctctgttttaggggcttcatatgattttatctcaataatgccacgaactaggaactaattaatatcatcattttacctataaggaggctgaagtcagagagattaagcaacttgcctaaagctgcaaagtttataagtagtgtagccaggatatcagcctggactctagagctgtattttttttttttttttactttaagttctgagattcatgtacagaacgtacaggtttgttacatagatatacatatgccatggtggtttgctgcacccatcaacccatcatctaggttttaagccccacgtgcattaggtatttgtcctaatgctttccctcccccttgccttccatcccctgacaggtcctgatgtgtgatgttcctctccctctgtccatgtgttctcaagagagcagtattcttaaccactgctctgtactgctgcctcccacaactgcagctcttcagcccatcccacttgagaataaatacatcatcttaaagatgactattttgggtaaacacaaatattcttcctctgggcatttctttctctctccggacttttgtcttctgctgcaggttttggccactactctaccttcattaaatttgcttttcttagcatttcaagttacagtgctattaaaaacagtttttcattttcttttaaaaatgtaccgtgggagaaatgcagccatctttccttcggggctctttcttttagacatgattaaacaatccacatcaataaatgactcaaccgggtgaaacagagaattcctaagaaaccataaatctcacaagtttcaaaggctgctacccatttcacattgttcagatgaaatatatcaccctaaattcaactttaatcatattattctgattgtctttgctccttatacttcagattttcaacactttggtctttttaatttttggtccatcctttgtttagtgcaaggccttccacacatataggagctcagagcttctttgtggtaattaaaaatgagcctcttcaaattttgaaaaaaaaaatattagctatggggcttaaatgaactactctgtctcaggtttcaaacaattggatagtgatattttccaaacaccctgcacagccaagcacttgcagtgaagtgattttgccactggggagcatctattctggtgccccaacccctgctcatggtaccagaaccctaactccattctgcagaactgtactgctcctattcatagatctatgattaggataatattgacccacccaagctagaaacagaaactgtgaagtccagtcttttgttcaacttaattgcatcaggcctgggcctgtgagtcagttcaaaccaatgagacattgcaaatatttgctggtgtcttttgggtaaaaagcttttctttccactgagacctatgaacacaatgttacctctttacttctggacattgaaatacaagattgtaaagcctagaactgttgcagctatttctgataaaaagagaaaagtcagtcttagaaatgatctgatactcaaaaaaaaaaaacaactctcatgaattacgtgtgagaattcagatcaaaccatagtcagagaactctgggctttttaattcctttttatgcttaaggctgcatcatctgtgatttttggctacatacaacataaagagttcaaattatatttcaagagagaaacagaagagttcatgcttgaattgtaagtgttcatagaagttcttttatttgttttctttaattttttattaatctactggtgttggtcataccaaagacacagagaagtgaaataattagctattcatagattcagaggcagcataaagatagaaataaaaagcaagctgtaacaaaatttaattcctgtttaaaggctttgattcaatcaacatgatcattaatatgtatttgaaagcgtaggtgattctaaaaggaagctactaccggtcactgttaagtgagtttgttttcagttgtataaactttgtgataattataaattcaaccatgtttcaatagtcacaatataattatagatttggactttcacaatcaaaagctctttggttgctctttgaattcatatttccaagaattgggttctactaaaattatcatttcatgacctctttgttgaatgccctttggcaatatctttgctaggtggtcatatatcctatgcttaagcatcatgggttctaatcttgattggtttttactattattatatgtgtccttactctcaagagatgaatcatctgattgctatctcattccctaagtgccatatagaaattatgtgtacacatgaaagccttttcgatgttcaaagatgtcctttataacttttatttatttttaaattatcttcaatatcttctcaggataaattcccccaacatccttaagttatttgattttttaaaaagtgccaggcagaggttgcggtgagccgagatcacgtcattgcactccagcctgggcaacaagagtgaaactccatctcaaaagaaaaagaaaaaagaaagaaagaaatgtctcttaagacattttctttaagccaaaaacatgaatgacagtaaaatatataaaagaaaggtggataagggaccagaaactttcattatttgtagataatatgtttctccaaacaaagaagcccaaagaagcctagggcaatgaccacgcattgtattccaggtggtaaaggatggacttttcaatcaactgagctcataaagttgactttccctattccaaaagagtctgttagaagaaaataaatgagtacatctacctcacgtgatacacatagtcaattccagatgattaaagacttcaaagtaagaagtagaacactaaaattattattaatatatttaggagaatgttttatcatttcaggataaaaaagaaaaatttttaaagaactcagaagagaacataagctttgaagtaaaagactgatattttaaattaatttaaaattaagcacatctattcattggacagcatccagttaaaaaaaaaataaaaagaacactagccataaataagcagaagatatgtgtagcatatataactgatgacagattaatccagaacatacaaagtctagtaagtaattcttaaaagacattgatctagtataaaagtatctagataacagaaacacaaatggtcaacaaatatatgaaaagaagcttaacttcattgaaatcacagaaatgcaactaaaaaccgtaataaaccccattttatattcatcagattcacacaaattaaaaaagaaaaaaatagcaagtgttggcaaggatgcaaatcaatagatattcccagacataacattgaagaaaaaacagcagcagatatatacatgtaagataaattacatttttaagaaattacctttttaagaaattaaaaaggtaaaatgattttacatgttgtttaggagtacatgcatatgtattcaaagtagatacaatgcatagaaaaaacacatttaattcagagcagtgagtaactattgagacggtgagatggggtgagagagaaggaatgccatcagaataagttaccagcaggtttaattgtacctcacatgctttaaatcttttattttctttttctttgttgttttttgttttgttttgttttgtttttgcttggtgacttttttattgtggtaaagtatatacaacataaaatttactattttggtcattttatgtgtacaattcagtggcattaggtacattcataatgattgtgttttcaatagttaaagtaagttttttccccttatggatgtgactaccatcctggaacagaaaatttgggtggacaaggcactgaaaatgattgtaacttctttaacttacagggaacaagacttggagtccctgcaagtaccctataaggggtacttgcagcatataacctttctggctgaaattacagaacagaatataaatgttattaactttttgaaaaaataaaaagtaaaatgacccagtaacaaattagaatatgggtaggagggaactgaagggtcaaggacttaataaggttatcttacaaagtggagaattaagatatactgtctatggttgttgtaatacaaaatagaggtttagatgtgctacctaaaaatatacaaatacagttactagagtaatatagccttagtattataaatatatcagaaaaaggagtaggatctaactaagctaaatctagcatagcagaatttcagtggttaatgctgacttttccaacaaaaatatatgtatatgttcaaatggagaagtaagaacagaaagaggtcgaagtgcttgcatctaaggagctggactcagggtggggaacttgatcaggaaattgtggcttttaatgataatttcttctgtttttttttaagtaacatgcttgtattctttgattaaaaataatcatcatggtatgtttagaaaactgattctgttctgctctgaatgtttctctcagatttatatctaaattttaattatttattattgacagtagtatacctattatagtattactgtaaaaaatggaatgcaagaagaaaggggaagcattttaagtctaggaagtagaataaaatatgctgcaaaaaatgttttaggtttagtattccttgaaatataattcaatcttgatgttcaagagaatttttgactgtatcagtctttgtatataatcaaacagagcacaaaatgggtacactcaaccttaggaaacttgaggtttagtaaattttccttttgtaatatcttaccaaaaatggttgtgttaattttttatgttcatgcaatttacttccaagacaaggtggttaacgagggttttgtagttgtttgacagtggaagctaaacaagatatgtctcagtggagtaattattgcttatgtatgtattagaatttatctattagtaaaaaaacagtcttataattatgtcataaaatttgattagggacataaaactggagattgtaatactattagagtgcagggaatctgcaattttctaaaaatctaattttggaatgtgtctcttttggatactaaatacagaattttttggccctagggtaagtaatcttttatctgaactctttcttgaattttctaagacttataataatcaaggtttggattgaaagcataataaattattcagagatgcattatatccttgattttataattaccgagcaagaattccagagatatgcacagttgcatgttccatatagactcctcagaaatcataccttcaacataagtaaaataacttccactagtaatttatttattttttgtgagggatggggggattaattcttaaatattaaggcattaaagtttctacaaattgttatccctgtaagatttcattttaggagtcatgaagatatattgggtagtaaacataaaattatattttgtctttgcatattcaagtcagtcctctaagtgtgattgtcatttaacttatgtaatgcataatttttcttatctctttcgagataagaaaagaatttcaatagaattactgcattaactatggagatggggtggtgattaaggggaatatcccaccaaagatatgaactgtggtctggtaagagtatggcaagaggaatagaagaaatgccactacattacttttaatgcatttcccatgaagattgtcttagtctgtttgtaaagctataacaaaatatcatagactaatttataaataacagaaatttatttctcacctttggaacttgggaagttgaagatcaaggtgctgtcaggttcaatgtcttgtgaaggtcctggtctccactttcaagatggcagcttgttgctgcattatctggaagagaggaatgctatgtcctcacatggcagaaggtagaagggcaagagggccaagtattgtgtgaagtctcttttatcagagccttaatcccattcacaagggaggagccctcatacctgatcacctcttacacacctcacctcttgctactatcacattggccattaaattttaacacctgaattttggagaggacacattctgactatggcagagattaagctgtaaaacttgactaacatacatgatgagacagttcatctattaagatttattttgaactgaagaggctttgggaactagcctagaaaatgtatatcttatataattttgtttttccaagaaaatgcaattctattttacaacaattaaaagaactttaagaaaatacttttggaatattatcagttcctacatttgaagtctctttatatgtatatgtgtgtgtagtcacatcaagtggtatatataatatgctttgtattagtttgtaagagctattatcaagttcagctagccaactgaagaaattgtggtcagcctacaaagagttgtcatgtgtattaataatgtaatctgaatgactgcagagtgatgaaattatactgttagtagttaataaagacaatagaaagtcttccatgaatgtgtattcatgacagcatgagagaataattctgtctagttacactttgaaatcctggcatgtcatagaagctttgtttgatttgttgctgttgctttcttgacagaaattcaatttagggagaaactctgagaccaacgcatctcttacctgttttgtgaagcatggcattgaatactgtcttatacctattagcaatcatggcaagaagacattagtaacgatgacacacatgcatagcatcaccttcttactttatttaaagtgtcatgcgattgggccccttagataactgtttcaaacaggtttagacaattttgcagtttaaacatacagaggctaccaaaaccactgaccataaaatgttgttctttagatcacattttttaaaaagtatccttggttatctcctcttttcaaaggcttcctttatcttcattttgttttgataatggtaagagttaattctaaatgtttttgccataagcatgtgtgtttgggaattctttgctttttacttacagaacaggcatctaattgagcaagtatgtcccaaaagatagatatgtgtctggcagtgcttgcccttcacctaagtccttgttccattagagtgactattattgacagacagcaccatctttgattcttccttgatgcttcaagactcagcaagagtcacctaattttattattgctgtttacaatttgtcccttgacaattacatttttacaactaagacacattgatgaagataactttctggcatttatactgcttaccctttgatttaattcaatccaaaatacttttgtgaaacacctactttgtgcctggctgcaggcaaggttgctctctgtctagcaggggagaaaaataactatattatagaagaataatgcagacatatgtaagatgttaatggagtgtctactgtggaaaagataaaaacttttgctttcatgggaaggggctagattggggtattcaggaaaacccctgtaaggtaatatttgatctagattttgaaagatatatgtattttaattacatatagtaagtactgtatgttccctgatgaagttctatttttcagggaatgctgctgcacttagcgtccttgagatcacacttctacttttggattagtagaaacatgaatggaggtagcattttttaaggcacatattcttaagtggacactttacagattatgattatgactctcagtatcctctttctttagccatgggccagggagccagggtaacttaaaacaatataggaaaataatacattagaaggctggagaaaatttaggagattttacttgttatctgatggctaacaccaagatccaagctttcttcactatgaagattttataagcatatatttattaatctcccatctttcaccaccatgacactctgttaaaaaatattaagaagctttgtttatgtttaggtccagtctcttttgatatcccaaacaggctaaaatcatatacttcagcatttcagcatatgtaacaattatccaaaatgactaccatcggtgattccaaggtaactgtgcatcaagttatctcagggaaattaataaaaacacagaattctgagcctaacattggatgtttcgctgcaataggtctgggctaggaaaatataataaggatttttaatatgtaatttcggtgaatctgattcagtcattttatgaaatggggcctggaagccgttaatctagattttatacacctgctaacgaaaatatacttttgaaagttccagtctgtacttgtgttttcgggggctataactggcccccaagcagaagtatcccagaatgtaaaacttattgtaacccagtgtgaggcatggggaggagggagatacaaattaataaaattcattttgagcactcataaccagttagccattttcgccttgagcaaccctggcagaaaattatgggagaataaatgtgagtgttttgtattcctcttattcaattccaattctcttttcatgtttaacatctggatgattaataacttattaatattctgcaataggaagctctcaatttatcagtgttgaaagccttactgtcaagctgtcagaattggcatccccagttgtaacagaattgtctttcctatgaactgtctcatgtcacattttctctctctccatatagatagaaagatagatagatacatagatagatttttaatgacaatttttttcactataaaacctcctcctagtcatgtaattcctttcaaagtcattcagacaagaagtctggaggctctccctaactcctgatttccagggaacccccaattcatccattccacctccagtcttccctgtatcagcaaatgacaactccttgcacctggtgctttggagaaaattccaggagtctttcttgattcttttctttgatttataccacaccctcaatttccactacatgaaagccctattcatccagctctataatgtagcctgaattaattcacttctcttcctttcctgtaacaaatcactgccattgccattgcaccgttgtctacctacaatccattatttatgcagtaacaagaggagactatataaaaactaagtggaatggggtcactccttcaatagtgattctccaataggttcaaattgctttaaataagatgcaaaatcttcaccttacctactacgccatcaatctctgacttctgcccacctctttaactatatctctggtttcacattcccacaagcccattttgatccaaacacacaggccataattctgttctttggactttgggactcattcactctggaccattgccatcctttctctgacacattttatcctggactgcctcctcattaataaagtctaagttcaaacatcaaccatcgttcactgatcagcctaactgtggtgctaccattctattctctctctcaatatattaccctatttaagtgtttcatagaacttattttttaattgtatagtgatttaatccaagtttttccctctaaaatataagatgtgtctgtcttattactatatttctaaatctagagaagtcccttatatactgtaggtatgcaataaatattaactgaataaataaaataatacatttcaaggcacgataacttgaattatttattttcatttttccaatttaaaagttcctgaattatgagaggactttaatattttttaagactcacaattattctaacaattctccttttcccagttgaatctcaccacattccatcttccacagagttgccaaagttaaatttctaaaccaataaggtgatggaccttttaccattctccaaatccataagataaagtcaaaagtcctgagcaatgtctaaaggctttttataatttattctccatctgtatttttagcttcattttctgcctcttccctttgtactctactatctaaccacataaaacttgagtagtctcagacatatcatgttatgttgtgatccatgccttcgccagtactagtatattattccttttgaagttcacttcaagtgtcagttctcccctcttcattgagagttagctgttttcacaagtctctgtcttagtgtttaatacagcatatggtaattatttatttatatgctgtgttagccctgatggctaacatagtgtgctcagcatatgtcccatatgtgtaaattgaatgagtgatggatgaatgggtggatgggtggatgggtagatgaatatatgaaagatgtcttctactaattcataatcatcgggtgaataggatcctttcccattcatctgagtgttcccttgatactgggctttaaacatggtaaagactttatattacttattaagggagtggataaaataactgtacttatttatccactgtactgtaataaaagtacttattaagagagtggctaaagtaatggtattcacatacttttacctaaagaagcattatctttgtcttaaaaagttttttatttctgtgtgttttccacctgtgttctctaactgtggaactagtagccactagttattcgagggtactgagcaattgaaatgttgctagtccaagccaaagtgtgctgtaagtataaaatatatacatttagtagaaaaaaagattgtaaattagctaggcaataacttaacatgaattatatattgaaatgttaataatttgggtatattgtcacatagacactgtattagttcattttcatgctgctgataaagacatacccaagactggacaacttacaaaagaaagaggtttgttggacttacatttccatatggctggggaggcctcacaatcatggaggaaggcaaggaggagcaagtcacatcttatgcagatgctggcaggcaaagagagagctctttcaggggaactcccatttttaaaaccatcagatctcgtgagactcattcactatcatgagaacagcacagtaaagaccctccctataattcagtcacctccctctggattccaaaagataatttatttttaattttggaataggtccaaactttagtatcagaaaaaaaattctctagttttctttgtttagacttcagctttatttaaatgttttactttgcattgtattttatttacaggctctgacatacatgttttgaaacaattatgattttccttttattattattattattattattttaagatagagtctggctctgtcacccaggtgggagtgcagtggtgcgatctcggctcactgcaagcttcacctcccgggttcactccattctcccgcctcagcctcctaagtagctgggattacaggcgcccgccaccacgcccggctaatttttctattttttttatagtagagacggggtttcaccatattagccaggatggtctcgacctcctgaccttgtgatccgcccgcctcggcctcccaaagtgctgggattacaggcatgagcaactgagcccggccctaatttttattatttttgtaggaaaaattttgtttttgaaatcatatatatatagagagagagatatatctagagagaaagagacaaatacacttttttttcttttagttgaaagttgtggttttaaaagaatctgcttacttacaaatatttacctagtaaacattctaggtttggaatcacagttatctaggggtacaagaggaacgggggtcgggcgcggtggctcacgcctgtaaacctagcactttgggaggccaaagcaggtggatcagctgaaggcaggagttcgagaccagcctgaccaacttagggaaaccctgtctctactaaaaatacaaaaacattagccgggtgtggtggtgggtgcctgtaatcccagctactcaggaggctgaggcaggagaattgcttgaaccttgcagtgagccgagattgccccactgcattccagcctgggtgacagagggagactctgtctcaaaaaacaacaacaacaaaaaaaaaaaacaggaaggggatttgagaggttaaggaataagtctaaggtcaagaacatggtcgtttcaccatgcatttcaccgtgcaaatcagcaatcaggatttatttatcaaatttgatcatctttctcatctctgatatcatgccctgttctagagctttactactttttaccatgataatttcaacaatctcctgttatccttctctccattgttgtctgcattaaatccatgttccacactgctaccagagatgattaaatatttataatttaaaactatcactttcctaagtgagagcctttgttaatcactaactatgaccccattaaatacagggataaagtctaaatccctagctaaggtgtacgtatccctgtgtaattgaaatctggctacctccaatgtcgtgtcttgtttgatgcctcccctacctcctgctacatgttctaacaccaatcttgtcttcctcattctcatctccataacctgctcttctccacttgcctttgctgtctccttttgttgctctcctattaataatctgttgaattatgtatcatttccgtacccaattttattatgaatctgtttattataaattacccaacaagactgcttgttctgtaaggcagagatcttgccttattctctgtggcttgttttcctcatcagaaaaatgagaatgactcattacttacattgtaggaggagtgagttaatacatgtgcctggcaaataatcagtggtcattaaatgttatatcacttaacataattattgtaattatccatattaatagtaatttgttaagcactcagtaatgtgtatatagtaaataaagatcaggtgattaattatatttaggatcccaggaaaaagggacagggaagaactgagttgaattaagaaggaaaaaattcaaaaagcaagcttgagaccagaagtctctaactggaactactgattcctctgccctggtctaaacctttatcattcagttagcttacatgctaactgtctcctgaggagtcatttttcatatattcattgcaagttccctcagagagcatagtattagatgatgtcgcataggacaaaggcaacatatgtggctttggaataggacttttcaatgtaccctcttcagcattatcctgatttacttcctgtaattctgcactgctaatttggctcttttctatttcaataataaatacctaggggatttttttaagcaactaagaaggatgttatcaatttttcataagttccagttagatcaaagaggaaatctatcatgtagttggtaaaaacaaaattaaccaaaaggtcattccagaaaaagctgtaaaaagagcaagaaaaatatcatatcacttaattggttatgatttaagtaattaacttgttctttttgtctggcactaatgatattcagtaagcataatatattgttataaaacagacctagttcttgtttttttgagtcattatgagaaaagcagaacttagagtcagaaaactaatctgcatattgcatttgtatacaaataaatatattttacataaaaataaatgtaaaatcacttcatacatattgctgctaatatgtaatgtagtgtgtgaaatctaatattaggtaatagttactgagaatctattttttcctatgtaattgtcataatgatctggagctcaggttgtttcctggagtcatgcagtggcagaaccacaaaattcaacagagatctgtttgaccctggaatctgatatctgaagcactgccttgtcttattttaatcacgttttgcgtgtctgtgtgtgtgtgtgtgtgtgtgtgtgtgtgtgtgtgtgtgtgtgtagctaattgaacttttatgcctagaacagtgctggtctaacattagataaggatcatatacttttattacctcaaatgcccataagtatcatatttttataatcacttatcatacttcagctacccaatctctgaaagtatatatattttaatcctgtagaatatttttataatgagatccatgtctgtattaccttcattgaagcacaaagaagtagaaattctttttatttcaattaattttgtctctgtcctgctgcaagagatacctacaataatggtatttaaggattcagtaagtaggtctgtatttcccatttacaatttctgtatggctttataaacattgaagacatcccttctaaactgccctaattccagatcaaagactcatcttcagtgtttttggttagaacaacaaaaacaggaagaattatatttttcttaaaaaaaaaggtgtttgttaaagttcagggaaaaaagagaaagagtaccaataaatgagagcaagtgatgtttccaactagataaaatgagaatatccaaatccttcttaaaagcaaatttaattaaatctgaggatacagtggggttttgtggtggtggtcgtggttgacctatttttaggtcacaaatctcagtggagaatgtaatgaaagctaaggattttttcttccaagcaaaatgcttgcatgcaaataaatacaaacttttttcatgatatttcagggaatagggcccaaaggatggaccttaggttaataacttctgactgaatctataaattaggattcactttactgaattgaattcagttttcactatctcctgctaatgattgtgtcttctaaagctataacatgttttactgctttaccacttgatgtctccacctatcatttacataatgctaatgctatttcatctctctaactctgctagacatttttttcattaaaagttttagaaaacatccagacttttaagaattgtcccacatgcctactacgttatttgaacattgtctcagaggaattatttcatgttccctttttaaattgttaattgacaaattatcatgtatgtttttgtgaggtaaattgtgatctttgatatatgtacatatgtggaataattaaatcaatctaattaacatataaaccacctaaattacttgtcatgttttgtgataagaacatttcaaatttaatctcctagaaattctaaaatataccttatttaactatagtcaccatgctgtgcaacagatctcacaaaaactatccctcctgtctaattgcaactttgtagcatttgtctaacatgtccccttttccaccacctctcagcctctggaaaccactgttctcctctctgagtttgaatgttttagattccactcataagtaagatcatgtggtatttgtctttctgtggcttgctaatttcactagcataatgtcctccagattcatgttgtcacaaatgacagaattaatttattttttaggtctgaatagtattccattgtatatttataccacattttccttatccactcatccattgatggacactttgttcgatatcatatattaactgttgtgaatagtgatgcagtgaataagggaaagagatatctcttcagcatgctaatttcgaatcttttggatatatacccagaagtgggattgctggattatatggtagttctatatgtagcttttgagaaacctttatacagtttctcataatggctgtactaatgtacattccctccaatgagaaaaatatgccttgaagccagaaagatcctgacacagttaaggaactgaatgaaggccaatgtacctactcatataaattactgggagaatgtcagacaatgtggtttgacagaaaggcatggtccatattacacaaaacctacagggtcctatttaagagttgtatttcatttaaatataatgtgggacacttaatggtcttacactggagattgatatgatcataatttaatttttaaaataccattttgaaggggtttggaaaaatggaatggaactggcaaatatggtggcagataaaccatttaggagattgtttttctagttctgataagagaattatggtggttttagctaagaaagtatagtgatgatagataaaagaagatggaatcaagatatatttagggagtagatttgatagttgggaggtggacgcaatgttagaaatgactcttaggtgtctagcttaaataatttaatgaatgtatgtattattattagagatgttgaaaatacgaagagaggcaggattggtagttcaattttggatatgttaactttgagatgcctgtgagacattcaagtggatatatctaatagttcagagtagaaactagggctttatatagaaatgtgtgagttttcaacatctacactcatgcattgcttaacagtgggaaatgtgtccttaggttattttgtcatgcaaacatcatagagtgtacttaccatatagcctattacacatctaggctatatggtatagcctattgctcccaggctacaaatctgtacagtgtgttactgtactgactacggtaggcaattgtaacgcagtcatatttgtgtatctaaacatatctacacatagaaaaaggtacagtaggcctggcgcagtggctcacacctgtaatctcagcactttggaaggccgaggtgggcagatcacctgaggtcgggagttccagaccagcctgaccaacatggaaaaaccctgtctctactaaaaatacaaaaaattagccaggcatggtgatgcatgcctgtaattccagctacttgggaggctgagtcaggataatcgattgaacccgggaggcagattttgcagtgagccaagattgcaccattgcactccagcctgggcaacaagagcgaaactccatctccaaaaaaaaaaaaaaaaaaaaaaaaaagaaaagaaaagaaaagaaagaaaaaggtacagtaaaaatgcagcattaaaatcatatgagaccactatcctatatacagtttgtccttgatggaaacatcgttatgcagtgcatgactgtaaatggcatttaaagttatggtcctagataagatatcccaagaagtgagtatgaaagtggaaaacagaaattcaatattagccttgaagaggtttaaagcatgggtcaagaaagacaaaacaaaaaagtaaactaagaagaaatgagggtaggtcatttcccacagagaaagggtaggtcaagaaggctgtgagaaaggagtggtaatctgtgagatatgtaccaaagaaaaaactaaaaatattgtccattgagtttggaaaattgcatctttggtgatacactctccaaagaaactttactagcatattaagttgagaagccagattgaattgtgttggaaagagaatgagaagaagtggagacaggaagtgtaggcaacttttcaagaatctttgttctgaatgtgtacaaaatgttttgtggcaggggtgcagggggtagggggtagcgttttgaagaaattcaatcaggcatttttttttttgagacggagtcttgctctatcgcccaggctggagtccaatggcgaaatctcggctcacttcaacctctgcctcctgggttaaagcgattctcctacctcagcccccgagtagctgagattacaggtgctcgccaccacgcccggctaacttttgtatttttagtagagacaaggtttcaccgtatttgtcaggctggtctcgaactcctgacctcagatgatccacccgcctcagcctcccaaagtgctgggattacaagcgtgagccactgtgcccagcccaggcaatttaaatgtacattcttcttacctttctctctcttcctcttgcttctttttcttcctattctttttctccttttctttctcctcctcctatcccttttcctcaccttctcttctcctcccactttcctttctccttcctctccctgttcccctccttcttccccccatccttcttctccttctaaggcaatggatactaaagcaagtttaaatgcctagagaaataatctggtggaataaaaggaggttgccagtgaaggtaatataatcccttaatacaatgtttttttttttcagacttgtgcattttttttcactttgatacacacattttattaatctcaatggtagaaatagaataggatcgatctcaaagtgttatctggccttaaaatatacagaaaatgtaacattcatttgggatgtggaaatcaaaggactgagttagtgtttgaagatcacttttagaatttgacttaaaaaggaagagtggctatatttgccttaaagatgaagtatgaacttaggaaaaaaggaagtcaggtttttgttcatttgtccatttgtttttgagaaggttctggctctgtcacccaggctggagtgtagtggcacaagctcagctcactgcaacctccacccccaacctcagcctcagtggctggactactggtgcatgccacaacaccccgctaatttttgtatcttttgtagatatggggttttgccatgttgcccaggctggtcttgaactcctgggctcaagcagtatgcttgccccagcctcccaaattgctgggattacaagtatgagccactctgcccagcccagttttctttatattgaagttaaggtggtcaaatgactttgaatttgaaagtaaatgttgcagacagactaatggaaagcagattgtacatatgaatttataaaccatatttatgaagtcagttccaagttaatataacagatatctggaagatagcagattagaaaataaaaaggactagatgggtatgaagaatgagtaagagagacagaagagaatcctgcttagagagtgaaaaaaaaaaaacggaatagacacaggcagacaatatgattttggatgtgtatatcacaagaggagatggtggctgaaactaaagcttggaagccatttttctgaaagaagggagtgggaaatcatgtttttataacaagatagataatgcttcaataacaggattgatgagacgaataaatatttattcattattgttaattttgtatttacctaaaatcaattctcatgttagaatttattcataattatctgataagagttagagtaatagtcattctcacgtacttctcttcatctgttctgctcctcagtatttttcttcttaactacacaaacttttcattgtattctcatttaaacaattttgacatcaacttttccagatctctttctgaggtccacctgcctactagaatattccactaacgtcattataaaactcaccaatgatgtaatgaattattgataaattatcataattgatgataattgataaatttcacttgtgaatccactgtaagatcctttctcagtgactaactctaccattgtctgctcactaacacgaggcaccaatagtcaatcctttcctctttctgacaaccaataaccaatccttcatcaaatgctgtccagtcttcctctttgttctaagcttgtattgaatccaaatggattttccatctccttggtttccaccctcatttattacatgttatattaaaacattctacctagtgatccacctttgcttgttgtactattgttgtatttgcctctcattctcattcccttcttatttaaacaacatcattccagttcataattaggggaaccagcctttccctattgatatggtttggctctgggtcgccatccaaatctcaccttgattgtaataatccccacgtgttaagggtgggatcaggtggagataattgaatcatggaggtggtttttcccctgatgttctcatgatagtgagtgagttctcatgagatctgatggttttataaggctcttcccccttcactcagcacttcttcttcctgccgccatgtgtgaagaaggacatgtttgcttctccttctgccataattgtaagtttcccaagacctcctcagccctgtggaactgagtaaattaaacctcttgcctttataaattactcggtctcaggcagttatttatagcagtgtgagaacagactaatacacctattatcagtgtgtgtaattggagtggacttgtgctggctgtacccttaagagcagtctgtttccctagcacaatgctggattcacagatgacatgaataagatgatctatgacagcactcactcaaactttgattttggctgttggggaaaacaatatttttcagaggtattgctgagctgtgtagtatatgtaagccaaaagtttctggtggttaattctgcaaccatatttgaagagaaaagtcaacatagaagaaaatcaaacctagatgagaagacaggcacttgacagcattgtttgcacacatggatccagctgtgtacagagctctcactctcccttgactttggaagttatatgcgccaataatttccccttttatgcctgaactaatttgaactgaatctctgtcatatgtagccaaaatttttaatataccacttctatatgttgaccttccaatctagtttttactgccaccagacaaatatttctaacatagaaacctggttatcaaacccctcttgctttatttgcataatagagcccttgggataaacacagtgcctcactgtgacctgacagataccttcatgatctaacctttgacctacctttccaactttgtctcttggcactctccctccaccacatttgtccactcattcttctaagtattcttatatttaatttgctctgcctgaaatgtctttcttttccagccaataggtagtaactatttgctctcctttactcatcaggttttatgtttaaaacccttcttcgtatccggtagctcttggtacattcctttatgagaccccataggatttatttctctttctttcatttaaacttccataaagagaagaattttttttctgaatctccagctcttaccagatcatttggtctattaataaatgtttacttaatgaatgcttggaggagcaaatgaataacaatctttaaaaggctaaaataataaatttacagtgccttttcaatgggagcaggttagaatattttgctgtgcttcagaagccttgctcatttaaccttaggcatcagagtctcaagttttagggaaaacgaactcttatacattttgtagttagaataaattttaaaatatttatatgaaaaaagattatattttagaaatataaaacaaattaaataataattattttacatttgatattttctttaccatttgttaacttacattacagtgaatgtaggcatctttcttacatattttatttttgatatatacacacatatccttttgagcttcctgtacaacacatcttatgtgtagtaatgtctaaaatattaatgctttatttaggtttgaaaactccccaggaagatttgacatttaagattagattcagagtgtattatcatgaacattgacagctgagagtgtgactgaagggtctttgtccttacaaactaaaagcctatttatagtgcttaatgaaacactagaaagccattttccttacatgtttctatatacatcattctctacaaaaacttgattggttgtgagtatttttatttaacaaaatttaagacgttggtgaagatgtagttgttttatagatcccattttctcaatacgaagcaaatttcttgttaattttttattgattataacaaattatgaatgtgaaatgtacatggcttgcactcgaaaaatgcttcagatattgcccatctttttattaaaatgagattaaatcaagatggtctaaaatattataagtttacttttctttgttcttaatttaagacaagttagaactttcaaatgaaccactttacatagatttatattcatgcccatctgtctgcatataataattaagaaaaaatattaaaatgattcattttccctactttaaaattattttaaaaggcaaacacttcatttactttcatttctctctctctttttttttttttttttttttttttgagacagggtctttctctgttacccaggcacaagtgcagtggcatgattatagctcattgcctcaaaatcctgggcacagcctcccaggtaactaggactggaggcatggaccaccacatcaagctatttttttttttttatttttttagagatggggtcttgctgtgttgcccaggcttgtctcaaacctttgacttcaagtaatccttccgccgcagcttccaaaagcactaagataacaggctgagccacctcactagcctcatttctctttttattaaactactcaagttgcttcttacaaaaagacttttatattctctattattggggatttaaaaaatataccctatcatttgccttacctcttatgaatgggattcctgaagaacatgacaaataacaaataaaatgtaaactccagattccagcaatgaaattctcattattttgtatataattcacatttaacttcttattttgaaacatatgaatgagcaaagtactatttctggaggggactacatctggccattcatttagaaacctgcctaatgtgtttgaagggaaaataaaattgtgtaaattagtggaaagaaaggttatcaacaacatttttttaagtttatgttttaactttatgtatcatatgttctattctaatttacatactttttgttttgaatgacatcaaatgatgttatatacatcttctggcacttgttagcctcatgagttttatagaccatgctgacgttgttgatccccttatgtatacaaagctttggaaatatttatcaaaaaaggaaaaaatcttcactgaggaattagcattccagtgacatgagaattatgcaatgttaagattaaaataattttcttttttcatgagtaatgcatgcttatagttataaaaagaaaataaattaaaactgcatggaagtatataaagtgggaagtaaaatgaaaaatatgctgtcctcacaaaacatattttaagatgtattttcaaaagagtgtgtgtgaacagaatttatatgcacttaatcacctctggacttagtttagcaatctacgcagttgtccggaatgagatctaggtaagcagtaagggtctaggaggcttaaatgacaggaaaagatcaggattatcttctgcaagatatccaacaagcctatacttgtgagatcatgaggacatttcagtttccaggagaccaatatatcacattagctttggattgatatcagattccaggaaataataatatcaatttgacaaaacagctagtcaataaaagggcaaatatgtagttaagtgaacccagagaatggtctgactttcatcagtttctcagcagtgagcctgagcattaacattcaatcagtgttacatttactgtttcctcaaaggctttgaacaggtgattccctatatatcctagaatcagcctttgacagagatgtgacagtaactacatttcctcagtctccaaaccctccttctctcctgactcttggcctgtgaacattctcccattgtttcagccatctaaagaggcaaacaaacctacatacaagaaatatgccctcccttcacctccaatcctcctccagatgttgtactattcctcaccttttcttaagagccattgtctttcaaagagtgattgtctttattcactcatttccaatttattactctacccactgtaatctggtacttgttttccaaaatcattattggtgctcctctcccaagtgtcacagagggcctccatgttgggaaatccagcaggcctttcagtctttctcttactgtgtacttctgactaagcctccatcaaatcactttatcttgaatcttagccatattttctcagcattacgtttcaagctcctccataagttcctcttttgcctttcataccttaaacattagtattcattttagatacacatttcttatctattatgcctaattttgtgaacaattgtctgttgattttccattatctgtctaaacatttgactaattccagagcttcaaagtcaaacattttatcttttgtatgacatattgtcttgcatctaaccaagtcagagtgtgccctacagttatgcctaagtgctctcttttgactctcccatatcggttcctcattgggtatctcttatctctattaattataattgaaaatctggagtaatctcaactcctctgtatctttcaccagagttcaaaattaatcaccaagaatctaatatctcttaaatgttttcttaatttttatatgcttcctagcctattttaataatgatgataaataagaactattttaataatattagctaacatttattgagtactgactacaatgcaggcactgtgacaagtgctttacatgtattcattcatttgatctcccctacattcttatgaggtaggtgttattagtgattacattttaaaggtaaggaaattagtcaaaagatgaataagtcactttaccaatcttctaccccaagtaaattagagtcaagatttgaattcaggcaaatctggtgccaagcctgccttttaatctccttacctttctccattttcacaatcttaccattcttcaatcctaaatgtacatgtaaatctttctacccatattattttcaagcaatattcatactatctggaaaacacattaatagtatattgtgcatcactggcatgcctcaagttctgtttttaatttcaaaggtgtcttacaaattcaccacttcagctctttgtttatgatgaagtaataacttaccaacccaatcctgctccagttgagcagtcttcagaaggcatgggccaggggtactttttgggaatggaactattaaagtaccagaatatctttgtgatatctagcccttaatgtgccatggttaggtcctattccctgatgaagaatgccagtctccacctgggaagtgatcattcctagcagacattatgatttgcagaagctttaagggctgaagccttcagtctatggacatatatgacctcagatgcctgatgcacagaaacagggagaccctcagcagggagcaacctaatttccggtaaatgaagaataaggacacatatcatatatatcatatataacttccagggcagatccaggtgtgttgtgcctcatacttaaactaattggggatattctttaagaagactaataaaaactctgaatataaaattagatacagggtaccaaatgggctatgcaagcaatgggccctaatgattgagattccttggctttatggacatctacctctgtccacttcaatgagtactagaatcatgttgacgcaatttccctcatgagtaaatgttcccatatattccaagtacaaattttatccatgagccataaatgaaatatttggatgtgtagtaaaagaaaagcttaaagtcatttgtagagattagaaagtagagaaagaacctgtaaatagatgttaagattagtaaaaatcttggaattcaaaagactgaagagaaattagttattctgatgacataccaaagaactaatcgcctgcttttcagtatattcattctcagcaattctaaagtcatgttctactaggtcttaagctcttaaattaatttcctgactttctgttcattttcacttcaaatcttaaaaatacatgtgcacatatgcatacacacatatttctgaagaaaagaaaagttattttaacttacatatttatattatgaacttgggatagaagctgttaaaatcttgatcttgtacaaattttttttatcatgggtttattattttgcaatgccagtaataaagcaagttgtcataaaagtagtcaacagtgaatcatcttataacaatcaagggagtaggtgatacttattaaatcctagtttttaaagacattatgctaagaaggcccattgtttataacatttaattaatgaaagattgcagaagtttgtaaagtttaaataagacacttgtgctttagtttctggcccaaatacttgtcctaattctccagactgtcacctttttgttttagatgagcgcaaagaaataatggcattttatagacagaccaaattaaattatattaatttgtttactcacattttaagcacatagtgcactggggcttagaaagataaaggaatcattttctctggactccaaaagcttctaataggtttttaccacttaccaatatattaaccaattctttccacctgccagaatattctagtaataaaatgcacaaattagtattgtcagtcaattaacttagctttcttgaatacaggctgttacagtacttgttgatgcaaacagaaaaatgcaaaaatgagagcctgctttccttatcatacgaataattattaatagaaatagtaatgtttatttttcattgttatatcatgtatattgtattagacaataataatttttaaagtgaatgatcctcaccactgtgttcaaagccagcatctattattattagaattcttatttgaataactccttgacttagtaattcaactaattacattgttttgttttgcaggtagatatttcttttgactgttggcttgaggttgattttgttccctaaaattagaatctgtaattatagactaatgtaacatttgagatctaagacagcagtgatcttgaatttgtaataatttgacaatcacaagtgcagtaggttctccttagagaatgaaaggcaattctatttgaggcttctagtaacagattccaaagacaacttgttcctttctgcaggatatggaaaaaggagttagagttcagatactaaccctattcattactcttgaaatcttccttctgacatggaaattctcttttagagcacagcaattgacattcaaatgaagtttgttcttttcctcaatgaaaacattacttgtttatcttattatgaaaattcatttgttttaccgttcattaatgtttgaaatggggcacagagtaggctttcctttttcccaagacaccacaccactgtaattctcaaagagaaatggtggaaccaccccaacatttctccaaaatagttttcatttcttttatagttgcttgaattccagctctatttgttatattaggaaaaacttaaaatgctatgggtgggtgcatttttctagcatttcagaaaatgcaccttttaaaaaatatttttttctcaccatttattctttacataccattgttccatttctgcctgctctttttgcacaatttacaggttgatccactctccttaggaaagaaagcattgggtattttgtctacagatcctatgtaagaagtcttactgaaatcaaataatctagataaaatttaaattcctaaaagaaagttataatatcttccacaattaataatacaaattattagccaatgaggcagatctttgaaatgtttccctacttttcctcatgagtactattttattttcattgaaactatattctgatcagccaatatcatgaaagataaagaggcttttataagaaaactgaatagaccttaacagaaaataaaacaaagtaccttatattattttaatccctaaaattattgttgataaaacacagaatgaattttgacctggcctattccttttgtttttaatctgttatttgtttcataaaaggtgaactgtgtagaacctttgcattttatgggtacatttcccctacagtagctcctagacaccctgaagaggcaaggtcagtgattggagaattcagagacttgaattctggtcaaagcacagcctctagctatttataatacttttgtcacattattttccctgtttgtgatgcactttccccatatgttacctcctcaatcagggacgggttgaggatttatgcatgagttcatggagtaagttggattcgaaagagaagcatcattgaagtggtacctgtgattggtgtcaacaaaagagagacaaactttttcttttttaattctgctttatttcaaaaggatttaaggacaatataagctatgctgtttaaataaataatgaagtagaataaattaagaaaaaaatgccagctctagttcagagttcacgtgtagcaagacaggaatacttgatttaaacatgtaacttctatttattaaaccaaaaattatagctcttggttaaattatttgaagatagaatctgggatttctttagcatataaaactataaaagggtccacctttaggtatgtaatcaagtggtcttaaatcttcaatatgattttaaaggagaaacctattattttgatattcaatttatttttcagcccttttcatagaatacagatgtgaaattatttaataatacaattaaataaacacacaccatgtttcatacagctaaatgtaagagatagcagtaacatataagggcttctggatagatactgtatctatttgggagtgattaagttcactattacttttcactatgttattgtagatggaaagctgatccactttgttgaaatttattatttattttcttttttctttttcttttttttttttttttttttgagacagagttttgctcttgctgcccaggctagagtgcaatggcaggatctcagctcactgcaacctccgcctcctgggttcaagcgattctcctgcctcagcctcctgagtagcagggattacagatatgtgccaccatgtctggctaattttctatttttagtagagacagggtttctccctgttggtcagactggtctcgaataaatttagtatttcacttttaataaatcatttggaaattatcttatctcaggtaaaagtatttgtcacctgggattttcattcttcagtggtaatagctgctcttaactaacattacattgaaattaaagatagctatatttaacattttgatattgattgcagtcagtaaggcatgatattttatattacatttagcaattacaactgaagctcagggcatttatgaggtgttcatgatgggaagggaggagttgacatatggagattactttgacttcagttattcattgcacttcagaaaatgcttagtaataaggtcattcttcagaattttaggaaaaaaagaagtttacattatttatttatttatttgtatagcgtatgtgtgtagacagatagaaatagagaaaattataaaagccctttataaaagagtatataccttatgatatcatggcaaaataattatgtggtgataaaaagcaaataagtcgttgattcataggacagaaaatttcttgtgaagaaatgtagctatgataaatcttcacattttaataggagtttaggttacacaagtgtaagcatttatcaaaacttaggaaatacacatttaagctatgtgcatttcatggtatataaattttacataaaaatactgaaacagaaatcaaactctagttaataaagcacacgtcaaaatttagggaggagtgtgcctatactctgataagcataaaacattcgatggatcagaatgaataaaggggctcacaagaaaaaaacatgctaaaatagctaggaaagcaaagaaaaaaagctacaagggagaattcgtcttgctggatattaaaagatagtataaagttttataattaaaataatgccatagaggagcatggatagacaaaatgaatgaaatagaaaatatacagataaatacaaaaataaatggaggtttaatatatgataaaaatgacaaatcactcttctaacactaataactgatgctgaaacaactggtttatcatttgataaaagatataatttgacacaaatctcacatcagaagaaaagaataagctgcacataaatcagcattctaatgtttttgaaaaaattatctaaattcctcttaaccttggtggaaggaaatgctctctgtctgtggtgatactgcacatgcaacagaagaaaatattgatacatacaacattttatgtagcaaagcaataagttaaatgaaaagacaaacgtcaaactgatagaaaatatttccagatatgtcgcagatggagtgctaatatcactataaagatctctaaaaaattgatagggttcaaagcaagacaagcaaataaacaaaaaccctccaacacaataatgaatgaaagactagaaaggacattcacaacacacatggagagatagatagatagatagatagatagatagatagatagatagatgacagatagatagatgatagatagatagatagatagatagatagatagatacagagactgagagactgagagaaaattgacgtttcacacattcaaagatgtttgacttcattcttaatttttaaaaatgcaagttaaaactgtactgagatacgtttattcacctagcagtttgctgaaaactttaaagtatgataacacgttctgcttgcaagtctatgggaaaaccaaaactgttcacacattgatgatgtgaaagtaaactgcaacaacccttgtagtgagagatttggcaatacctaataaaactgtatatgaatttacctttcattcagcaatttaatttctaggaatttaccctcaagatacagctccaagtatgtgaaaaaatacatgcacaagatatatgttaaaggaaatagttatcaatagatgacgtaggtacaggagaaaaacttcttcgccctcttgaaggtttgctgaaaatcacagacaaagggagattaacaggaaagaaaaggcatacagttttattttatcatagttttacgtgatatggaagccttcaggataaaagcccaaagatacaggggaagtttgtccatttttatgcttagattcaacaaagtatgaacagctgtgtagaatatgactggacagaaaggggtacgatataatgccaatacactgagtggggaaacacaacaaaggctgtctgtctagatttttacctctctgtgcaacagtccttccttatgggtgtggggcaggaccctctccagaatggggatcttatgatctgtagttaaacaatgtaggtcaaatattttcttgatggacaatttttacacaaaaagttaaagggtggggagttagaggaatatttttaggttttgtgactggctttggggaaacggggttctgtttattatgacccaccttggaaaagagggattctggctagccttgggggagaatgaatgaacagagacaggagggcaggagaaggtcagagaaaatcttttattatgaagcctttgttttggtgtatcgttttctgagctccaataatgatgtaactagtgagtgaaattttgataaaaattgaaaagtttacaaattctcaccttaagtgatcaaagttaacattagtaatggcacaaatcacattctctgtcaacttctatgatgcactaaatacacagtatcacttctcttgcattcttgtcaaaaaatgcttccctgaatgtaatgatgtgtaaataccagacaaatctctcttcctcccaaaatgatgttcctattattgtcatttataacaatgattgtacttaatgagaataaaatacaaagagaaaaaacaatgtatttattctttaaaactgtgcatggagaaatatgcaagaagagaaatttatgatgcatataatcttttaattgacacttaatttagcagcaattaaaccttgcgattactatttaatattttttaaattttattttagtaggtaaaacaacatgatttctctgctttaattttttaacttatttcacacacaaaactgatattaattgttcttgttgatggatttaaaatgtttttgtaaatataacaagtagtatttaagtttttatgccgcaagaacaaagttgttccttgaaacatttctttagtgtcagaaattcatgatattcaatttcagagtattattaaataccatttatattgattttatatttattggcattagtatatagtgctatatagttaacaaagatagaaataaatggaaacagtatctattctcacaaagcccccatttttgctgtatgcagagagacgctcctcattgaccctgctcaaataaagtgcaattatctgcatgactttctgctccacttcatctaaagatgcaactgttcctctggcaacagaacatatcatctctcgtagtcagggtgatttaaggacttctaggctcagtacattcatgcagagtgatccagtgtgtgtactgcacaaagacaccagctgaagaaatgagtgggtgcactctgctgatgatgtggggaggggctgtctcactgagaaaagggtgactttttctggatacaaaggcttcatttgcttttaggtttgtgatagcaggactccactggctacctggggcacatttttctttttttctttttttttattatactttaagttttagggtacatgtgcataacgtgcaggttagttacatatgtatacatgtgccatgttggtgtgctgcacccagtaactcgttatttaacattaggtatatctcctaatgctatccctcccccctccccccaccccacaacaggccccagagtgtgatgttccccttcctgtgtccatgtgttctcattgtttaattcccacctatgagtgagaacatgcggtgtttggttttttgtccttgcgatagtttgctgagaatgatggtttccagtttcatccatgtccctacgaaggacatgaactcatccttttttgtggctgcatactattccagggtgtttatgtgtacctggggcacatttttctaatcacacaaaaataggctggttgtggccttcattctagcttaacccatttcccgtttgcacctgcagtactcaccagtggcgcttgtggctgtagcgtttaccctgagataactttgccacgaaatatctcacttttattattatatttgcatggctctagtatattgactttggaaacaatagacatcattctatttattgaattctgtttttagtagtggtatttccatttacaaaatatggtaattctcaatcactgtaaatgtcaaatcctagaaaacatagcagtcctacgtgtgatgttaacattgttctcaaacagtttgctggctgaagattcatttgatgaatccaatttttctgaaatagatgattcttatgattcagatgattctgatgttagttctgtttagaaataactccaagaacagtttttatatttcattttcccattaaaaatcagtcagatttgcctcagcctcaaagagcgtgtttatgtaaaattaaatgagcgctggcagagatctacactttttttttccccctaaatgggaaagggttaataagcccatttttacatcttaattgaccctatctctttaggttactgctttggtcctgagctctagttcccacgttgcactgtgatccatgaactgattctgtgtcctgcacttttgtatgaatatcttgctgcagcaaaatcagaagccctgtttctccatgagggaattattttctctgggactgtgatctatttctgaaatcgtcccctggatgtggtccctgctattgttactgaaacactagaggtttgctgtaggacctgctgctcaccttgcagaaagccaatgactgagaagattaatattgccaaggaagaaggctttaattgggtgttgccaccaaggagctcagtctcaaatctatttccctaactgactaaaactaggggtttttatagaagggaagaaatataacaatgtatgagaaaacaggaactagggaggagtaaggaagcaagcatgatgaatgaggggtctggaatctcattttcaggatgtggtgatctggtgagtttcagttctttgatgcttttttttgagaggcttgaaggtcctttcctgaggaaggaatttagataaaacaaatataagtttcaagctttaagatcagaaaggtcaatttctatgtttatcaaatggaacagttgatgggactatttgggtcagtttcactacctgctaccaaactctacaaataccatcaatttatctgttagtatctcttcattgtgcttgttgctgtatacccggggcaagcctcttgtcctttgccaacactgggctgttcttaatgtagtgtttttcttggcacttcagttctgttgcattcttgaccaaaaaaaagaaaaaaaaatgcttctctgaatgtaatgatgtgtaaacaccggacacatctctcttccttccagtcatagcttatcctaatttactctggatacagagcttcaattgacaatttgactttcgttatcaataactacatctttcttcaagattgtatggcccatagccaacgtatgtttagtatatactaattctcaaaacttttgctgagtatgtaattttatatatatatataattttaaaaattctatgggtgaaaagtctcattagaagaatcctaagaggaaatggatcttttcagagaatctttcatattttgcactgaaaacagtagttacactaccatcaggaattttccacacacttcagaatgacttcaacctctcagtgagtttaattgcccaatatcctatttatataagaaggaaaggcgaataaatatataaaatttactgggagatgaggagagggaatagttgaatgccaatggagaaaattaggatttctgagaggaagtgtgacttgaggcctatcttgggtaatatacgtgagttctgcatgaaagaaagcattccagatagaaggcattctacagctagaaagagttaaaagcatgagagggctttgttccctgaagaaacattgatatgttcaacattgctgaagagttgaaaggcaacagtgaaaggaaaagataacatgaggtgaagctgatccagatcctgtgaagcctttagactttatcattaggaaggaagagtcatcaaaaacatttgaataaaggagtggatgttttagatttgcgtttttgtctgccatgaggagaatatattttgaggatcaagaatactccacagatgcactatactgattccatgcaataatttaagggcttgttgattcatgatgtcagcatcaccattgtaatgtcaacatcaaagtttctggctttgaacttgggtggatggtggtttcattgtctcagagaggtaaaaaacatgagcccctgagtggtcagttgactgggataagaccataaatgagagcagaagcaaagcccagaccagagtccagacctgctgataataaaatccagtgttattattactaacaaaagtaaaaatttaacttatgaattgcaggaggaagtttgctgcaaagtcactttaattacagttatcacaggcaataaacttatttattccaggcaactaattgttaactacttccaatagcatgaaagaattatattcagaggttacataaagggaacaattccaaaaattcctgttccaaaacaacaaaggccacaacatttacttggtgttcttttacttttattatcatttatttccaaaattcaagagagttcttcacaatagaaagaatataaaacttgcttgcataatactgtaggttatctccctcatttttacgtgctagataaacagggtgttttaaaattattgacattgtagaaataactccaatggtaatatatgattgttatttatttaatagaaattatattcatgacattttatttttaaaaataacttagacatcagcctagtgtaccctctctgttaaagtccagatgaggtccactgaaaccccagaagaattatctatggatgttcagagagccatgcaagatttattcagttctctggtagacttaagtgttttgtgactgcttttgttactgctttctctgctcctcacagttcaatccagatactaaatttggcttttttctcacattaatgacattgccatgacattgctaatataatgcatttattaataggctaaatgcagtggacaataagagaggaggtgggcttgtattgcaagattgtagtgaaacctgaactttagacaaaactcatttttagatttcctccagctatcacaccaccactgaggagctcactggcctttttagcttcacatcatttgacttgctcctttcctcatcatagtctctttttactcctttctttagttttccctaccttaagcccctaccctcctggaataaagcaaatattccccttatctcattcaaagcagctatttcctcggtttcctggcaatacatacctccttaaaagaaattcttcctgtcaaaggcaatttctttcataagtgggttgccagtgctagttgctaaaataataatgtgtttactttcttaaataacctatctgtggttatgatttaaagacatgggggcctcttcaaagcactcaccttagaagaactcatgtttctattgatgatgttgctcttatagatggattttgttttgttttgtttttattttgggttgctctttcattactactctggtgaggcacttaatttattcaaaaatggtaaagaagttttattattttaaagaacttcaattagcacttttattttaaagaacttcagttagacttttcaaaacaagtctataaggggtgactatttgactattccttttgaagttctatttctacagttttagtaaaaaccacaaggtgcagtggaagataaaatgtctttcctcaccaatagtgttgaattcactgggccatatgctattaggttggtgcaaaagtaatcgcagtttttgccattactttcaatggcaaaaactgtgattacttttgcaccaacctaatatctaacctattttgtttggttttatttttgtatagatttttaaaaattcaaataagaaaattatggctatatacaataaaaaagcaccatgtaataaatttacatatatgttatactatattctaggcactggcctactttacatttactgcctcttgtctcacaactctgtgaggtagatattattattcccattttacaaccaaagaaactgaagcacagagagttaaaacaaaagagagagagagagagagagaagcccagtctaactctaggcttatgctgccctggatcatctcagataacattccaattataacaatgctgaaatgtaattggtgagttgatctaataattcatgcaatgcctgcctcactgtgaagctttcactcattcaacctcttattaaatatattttgtgatatgaaaatacaactagtaaatatgtagtagcacatttacagcctctaaagttaatagtattgatcctgtcaatgttctgctctgttctgcttctctcatagtgtccataaatttattcccatttgttcccatttattcccagtgaaggttacttcactgtttttaaggcaccaggccttgatggacgttactgctttagactttaaaatcatcatcactctaataatcactgtagacttctttatatctaagtcctatttatttccattaaagtatactgcaacaaaaataacgtaccatctttatttaccatgtggcttagttaagatggtgatataactaccattgttatcagaaacactatctgaactagtaaaacactgtatcccatcaggaaataacttttgaaatcagattgcatgggtttgaaacccagctccactacatagaagcaagttacttaactgattggaacatcaggttctttatttatcaagtgggagcaatagtataattaggttgggtgcagtggctcaggcctgtaatactagcattttgggaagccgaggtgggcagattgcttgagctcaggagtttgagacaagcctgggcaacattgtgagactttgtcgctacaaaaaaaaaaaaaattacaaaaataagtcgggagtggtggcatgtgcctgtagtcccagctacttaggtggctgagtagaaggatgcttgagcccaggaggcggaggtggcagtgaatcaatatcttgccactgcactgcagcatgggtgacagagtgaccctgtctcaaaaaaaaaaaaaaaaaaaagaaaaagaaaagaaaaaaagtacaaatggttcataaggaatattgtaaggattatcttttctgttaacgccacaaaagaccaccagaataaactgatgaagaaggaaactgagtttatttcctgatcaccaccttagcagatgtcttagtagtcatagaaaggagaggccaaggtggatatttgtagacatagggaatctggacttaagtagtttaaggaaggtcttttaatgtattgtgtgaagtatgtaacataatagtttgggatgggtagacataataacgaagttctggaggttaattgataagcaaccagtttgtctagttaggcaatatataatagtcctatgaagcaggctgtttacccacgtgagcaacttaccctcctgagaatgaggctgtttgaacagtttattgtttgaatagatttatttcctagtagttcttgatgcatgaaatgaagttgtttatgacttttaagccttatcatagttctgataggtaatctgtgtggttgctggaagtctcagttctgaacaaatggcatgatccatataaaacacacagcacaatacctgctatataattagtatatccacaaatgttagccatttataactgcctcttgtgtatgatgtttcttaaatcagggcttgatagatgggagacctagcctaactctgacaagatgcaaaatttggtaaccagacagaacaatagagtggagaaagtggtcggggacggtcccagttgtgcttagtaggagggggtgcaagatggcagatagctcatggatggtcaggaggagggaagaagcagagatctaagcaagcaggcaaagtatgatcctctgggttcttccagctgaaaatattaaacagagattaaagtgagtaagctggaagatctaccagcaggccagataaatttaggattaggagctacacatgatttaaaagagctgaaagggaaagaggcaggacccttactccatactgctacattggacaaacaggtaaagcttccctcaagcctagatggtctagtcaccagatctattactgaaattttttgggaaatagtgaatatgaaataaaagtttgaccacagaaattaaagataaaatacaagatattagaactgtgtcaatgatcagagtcctactagcagcatagctgacccaaataattttagagatcttatctataatattctgtacagtgcttcatattataagaatattataataataaattacattcatatcattccattataatttcatatgttctcctccaaacttctgcaatgtagatatcggagcagttttactctaatttaggtgatgacaaaactgaagcttagagagtttagtcacatattttaaatggcagaatggggaggaaactacaggttttccagacacagatcttgttccaatatgtccaaatagtaattatgttactgaggtttgaggggaatgtgttacaattggatgacttgcaaactcattttcatatactctttccctttcccttctctgtcttttgctcatttttggttatagaaaaaatcaattgaagatatgaaaaaaatgttttttaaaaaggtatttctacacttctatttcatcttgtaataatgcagagatatgactggggagttgatctgataattcatacaatatgactcctcattgcaaacctttcatccattcaaccccttattaacaatatttttgtgacatgcagaatgctagattctggagaggcagagataaataaggtgaaccttccttctgttctacttttaaagaatcccctagtctattggatttgatagatttattgtgaaagagtataaaaaagtaaaagattaaggcatgtagaaggtacaaggccagggaagggggccgtatattctaatatgggattagggaaaagtagagaaattccttggcttcctgttcctattttgtccagcaccgctatctcccacctgagattcctacgacatatttccaatggaagccaagaagtatgggagcgttggaagtacatcctgcccaatgaccctctcaccccatccccaccaataatcagaagaaaacagaagaagcaaataattgatctgatagcaaatacaccaaagatgagtacggcatctccctggattttaaaataaagatgtttggagcagatgaataccaatctgattttttaaaaaattgaattacccaagtaattatgacatagaaacttacttttggaagatttaacacattgtaaatataaaccaacacacagaaacccatgcaaaatttagtgcttcattttacttcaggccccaagctgctcaattattatgaaacaatcactttttggttgcccaagttttgtttgcatggatgcatgggagaacgatgaaatttctctctctgaatatgaatgttaatgattgggaaacatagaaaccacacataattctgcaattctcatagctcttaaaatatatagaggacttgcattgcaagtctttattttaattagtgttattaatattcattgactgaggtagtaaaaggcaaccactggctcaatgagcagcagtccaacaagtcatgcaaactccagtgttgacagcctttgtttggagtcctgaatggattgtgtctatctaaatcactgtgtaatcatggatcctttgtgatttcacattctcatcttatagtcaatttttatttctctgatgtggcatgttgtgttcagtagcttatctgaaaacatcaatatggttttgaaaggataaaatcaaattgtaacagtttatgtttctgtaatgtgtgcatagcctagggaaaaagtgataaataggaatactatttcactgtattgctatgttacagacattggaaatatgattctgcctccatattctttccaaagtagatcagctggatttattttttatatatttataaatcaacagctaatagaccatgagaacagcattagtgtacatccagatgacagaagagattgtaaaagaagtggagaagactttctgactttccctgctttcgtgacagtaaatattgtcttcttgcttttatatgacataaaggtaatcttcctacttttataagatataaacacacaaagagatgttaacctcatgcatcatattttaaaatgttggcataagcctaaaggttttacatgtttcaaagagtctatctttatggtaaagtacttgagtaaccattctcaactttggctacacatttgaacttccaaagagttttttaaaaatattttcacctgtagacacagtcagacactttaatcagaatttctgtgacagaagctctcacacctatagttttttgagctcatgagataattccaatgtccagccaagattaagagccacagatatattatcatagaattaaaaaaataaactttcacttccttgcaagtattacaaattcagcatgtcaatatagtgttaactgttgccatgataaagcttatgatttcactggaataccagatttcaggctcttgatttggacatcaaatattcctttcaaattgatgaaaattgctattgccatctgccacttttactctcaaagttaattacatatacattgtgctctacaataatgtcaattttgctaatcccatttagatgtttacataaaagaaaacaaataataacttcataagacatgttgctaaaagggttatttggtctaaatatacataatttcaattcaagctgacattttatgcttagttttaatgaagtgatcccagggaaattggtattttcctatctgatacaacgatatatatatttgaatgcaagattaaggcacattttaatatgctttatttgtttctaatttttccaattaatttttttacaattaatgtcatttaaaacttttgatatagcattataaaagaatctcaggcagaaatcattagtattactaaattatttttattgcattattattactactttaatatagtactgaaagaactatgcagcttgagacttgtattctgtgaaatgaaactttgaattagccaactttgaaagtcctttccagttccaccatgtggagattatgagctttactctgcagcatataccaaagaatgtctaccatacatttcagatgagacctttgagattgcctaccttaatcttattatgtaaaagatataaaaactgaggtgaaaagtggtgaaattatcctttttatatcacaaagaacaaattgtcttgtctcaagtagaatagattattagccaagttctatctatttgttttgttttaagtacttatccccacttccatcatttgttccttgttcatgttgttgttcttgtttgttttgaattgtttctggaaataacagtgagttaaaaactctgccagctttatatatatatatatatatgtaatattatatataacatgttagatattatttataatatatagtataacatatagtataaaggtttttttacacaaaactttaaatgcattttgttgtctaaacaaaagaaattattgtattcacatgtgttaagatgtgcagttttttcattttatgtgtctgaaattagcatgagtttttcaaacatggtcacagctgttcatatagccattgcttcatctagattatgtgtactctttgtactgcatgtattgagtttaattgtcattcactattttttcaaaaatattacattattgttcaatattagaacaaaaagttattgtctgaagagaacaagatatgaaagaacagcaagaattaaattttatatgattaaacaaagatttgttattgggggcatcattacaatcctacatttgcctgttaatcaacagctgactgatttatatggcttttttcttatcatgtcagccaaggaccaggaatgttggcaccaccaaggatggtattataaatgtagaatcatgagttcataccagatctactgaatcagaatctgcattttaacaagatccgcacataattcatttgcaccttaaactttaaaaagcaggactttatagtaccaaggaagatatccacaagaggttgacactgttttagatttcttgagttatatgctaaatgtttgtccctcatatgataagcaatactatttaaaggcaaagaaagcttaaatacatggaagaaacttcaaatctacaggaaaatgatgtgactgattcataagtcgagcataacaatattgatagaaatctaagtccaaattcatttaaaagctttttctgtaagctctatttaagtattaaatggactctagtgataagaaagcattgtgctataatttgaccacatttttttctttcataatagtagataaaatcatatcttcccacagatggaacattaactttggtaaaatacagacaataataccagttcattgtaccacaaattcatcagaaataatgaaaatcataactcttgcttatataaatatatgcatttaagataactagataaactgacatagaaaagaactaatttgtgtcactttaatagtacagaaggagtcttctttgctgaatgactttattcagctttattgaggtatatttgacaactaaaagttatatatacttaaggtatacaacttgatgttttgatacacataaacattgtgaaatgatcaagttaacacgtctgccagctcacatctttatgatttttttgatgtggtgagaactcttaagatcaatttcttagtatattttaactacagtatacaatacagtattattaattatagtcaccatgctgtgcattagatctccagaagttattcatcccccataactgaaccattttaccctttgatgaatgactgtttacacaggaagaagaggaagaattaattaaaatattagccctatttaatttttatgctacattaaataatgacagtggaagttttctctaagtaaacatgatagctacattaacagtaaactaattcattataattttgacacataaaatgaatataaaggtaacatttgtgagtggatttttttaatcacaaagtaaagcttggtagaaatactttaagatgctgtatcgaaatatctgcttttagtttgacattttaaatcatttaattgttggcatttcgtgtaacatacaaaaaatgttgattgaaaaaatcttttttaaaaaatgatgctgagtagactttattcactgtagtccttgagtgaagccactggttgttggcttttggactgcttttagcctgtttttctagttgtacttctttgaggaggatgatgatctttaccttactcttggctttgcatgctcaaagtgattaggtttttttaatgaggcaggagaatggaaatttgaggaaaatggtagagagaaccctctctcatttaccaagatgactttctaagtttatttagtgatgagctacttggagatacaagtcaaatgatgaagttcatagaaatcttttgaatcttgccaccagaaagagatgacaataaatccaactacttttcccatgccttacatttttattttcttatatgcacagtatcttttgtattatagatgcttaataaatctttttcaaataaatgtatgctggaaaatgttgtaattgaggtaaatggacatttttagctggctatattgcagaagactttattgggtaggtgatcttttagacggttttaaaaaataatgaagatcttaactggcacacaatcaagtatctgttatatgccttcatcttccacattttattgtatttttttcactcccttgtgaaggaaactaatttcaacaatgctgtatgtgtcatgcattaacccattcataattagcaagaggtatctgattcagtttatattatggtactaattatctagctcttcagaatattttacataaaaaaataacctcaggtgaataaacttctgtttctgctccagaaaccttttgacattttttaataatctgtaatcacgttgacttaaaatgacatgacagaaatgcctgaatgttgacgagttgatgggagcaacaaacatctgcctgttaaatttgggatcaccacctacagcactacacatatcattgatccaagtgtaccttgattgattgcttgaaaagaaaaatctggacttatttggatttataagcaaagtcaaaaacatttttcaaaatgttaagttctaaaagtagtaataatgatggtgtagccccttactaatcagtgtgctctggggaccagcagcctctaaatcatctgggagcttttcggaaatgcagaaacttcaccctagacctagtgaattagaatctgcatttgaataaatctccaggtgatgctgaaatgggaaaagttgccttctccctctcacacggcgtgtgatggggctgtggcttgcttcttcagtgcccctctgctcaaatctctagggcagtatatggacggacgggcaggttgtggggctccgaccccacagcagtgtttagggccctagtgggagcgtgctaccgtgtgctcttttaattttgccatctataggcagcttgtgttaaccagctcaattagaccctctaccttgtcactaccttgtcacaaggacagaggactttctgtatccggggttcttggcttggtgtaccggaagagtcacatcacacttgggcttggagaatgagtgcaaggttttattgagtggaggtagctctcagcagatgggggaagccagaaaggagatggagtgggaaggttttcccctggagtccagcacctcagcggcctgggctgtctcctctgactgccccagccaaattccgcctcctcccactggtcaatggcttgctggcttgccggtgcctgctggtgcatccctctccatgtctagccgtccgtgccttcctccgctgacttgctcctctccacacccagctgtctgtttcatccagctgtctgtgtcttctcgggcagatctgctcttctggacgtccagcagcttgtgtgtctgccttctagagtctgggggtggtggagcgggggtggttataggcacaggatggcaggccagggcggtcttgggaaatccaacatttgggcaggaaatgcctgtcctcacccagggtctgtaggggtggagccctagccagggaccacgccctcttctacccagcacttcccttcccttcttccctgtcatttaaagggaccacgctcttaccttcccagcacttccatatcagtgactgtgcacattacagtttgagaaatgctggtagtccattccctttcctgatctccaaaacatagggaaattttagaggccaggatgcatttagtagattctgaatctaaaggaaacctaaatcattccttggaagtagacattgtttatagcatcctcaaatggaattaaaagcatatatgactagatttagaacagaaaaatctgttttacatatttcaaaaccctttggacccttgtctgtttatgttcctatgacttcttgagttatacatttttattaacaaatgataaaattatattcactaaatgaactcatttgtacctgttttaccagtttcagaatgttattttatatttcttaggtttttcttagacttgtagaaatcatgctgctttgttccctgcaggagttaaaataaaaatattagtaattatgcatatttaattttcagaatgccaactgattactcacagcagttataaaagggaaatgattttagatattcataaaacatttccttagtaaggggctttcaagtctgaagttgtgttattatggatatttctttttaaaataatcaggataaaaaatgcatttattaagatccctcttcttttctctttttcagatgtaagacaaaagtctaccctgatgaacttccaaacacaagtgtagtcattgtgtttcataatgaagcttggagcactctccttagaactgtttacagtgtgataaatcgttccccacactatctactctcagaggtcatcttggtagatgatgccagtgaaagaggtacaaactggttttttgtttttgtttttgtttttttgttttgttttgttttgtttttttgtattagaaagctttattatggccaaaaagataactaggcaatgatctatatttgcattataattttactagccctgccacagcctatcagattctcatcaagaacctcattaatgccaactctagaagcaaataactaattctttcactttctctcatgattctatatggttcttacctaaaatttcagccaaaatgactttcaaaaatatatcttttttccaactcaattgattatattattgagcattctcatatgattttatggatacttgacattaattaactaatgaaatctctattattttatatctaaggcagtaaatactgataggaattggccaccatttctgtgtgttgaatttccatcttggtagtatctctgctatttcttaaaacagtttcaaaaatttttcttataaattcttatacatgttacagattttctcaagttgacattagagaattacgtgaaaaatttagaagtgccagtaaaaattattaggatggaagaacgctctgggttaatacgtgcccgtcttcgaggagcagctgcttcaaaagggcaggtcataacttttcttgatgcacactgtgaatgcacgttaggatggctggagcctttgctggcaagaataaaggaagacaggtaagaatttatgtgttctgtctgcctgggttatgactgaacctcttaggacagttccagatgtccatcagaatttctcttccaagttgctatttttagaaggtttattttatagcttttcttaaaagcacgttttcccacttgcttgataaataagactgctgtattcatgctggacatagatagttgattaagaaatagtgaaataattcaaataataaaaacgtgttaaattactttttaggtgaaggaaataaatataatctaaaatagtataattgtgttataaagcacattttcaaagcacctttttgtgttctgacaaccaccctgtgaggtaggtactgtagatattcttatctataacttataatgaggaggaacaaagaagccacatctaacttgctcctgtcattggaagtgctgggaacaacaattcagctctttccagttctctgccagtgttctgtaaactacacgagcacccttagtcagtctagttcaaatccacctggaatgtcttaaaaatgcacacacacacatgcacacacacagcactgaaaaaattataattaaaaaaagaaacataagagcacagctataagaatatgtttaattatttcaacaatgtcaccttatacatacacattttgaaatctggaaaattgaataaataacacttatagaaattaagaatccttatacatacctgcaattccttctgttgttgatgaagtacaagcattttttagcaaatatttataaacactggtgataagagagtataatttctaaatacctagataactaacattgaatgccaactgatacaataacaaaacattacataacaccatacttgcatagtcatttcgtctatagtagaaaattccttctagaattgacatttttaattagacactcaagataggagctacttagtctgagctagtccagccacatcacttaaacagcaggatttggtacttgccaggaagatggatggaagctgtcagtaaaatgaagcacagcagttgaagaaagcagtaggaaccttttagtccatagagtgttgtacatggctaataacatttttccactctgtgtattgtacagtacccacaggacaatcagactggcaaagtaaaatgaacttaaaaatgaatttcctggcaaattttggtacattatgttgttttttttttccacatgtgtttcatattcaactgaatgagcttttaatgtttcaatacggtcatacataggctatttatttttttgatctaacaacataattgcactgtatttgcatatgatgaaccctattgtcttgacctgattataaagtttaaaactaccctaaatagacagtctgttcaagatttttagacctaatttcttctcctcacaagttaaatcattaaatctaataaaggaagtgagaaaaatgttgatttttctggggtccagagtcaccaagaaggttttccaaggctagaggagtcttgttgatcgcagataagttgaggctctggtcagttgtgtggaatataagacttcaattgaaaatgagtattggtgaaactggtgttacaaaacaagtatgaataatggacatttatgtgcttttcatatctagggatgattcagaagcttatttgtgtatttaccttctaccaaatatgaaaaaccaactctggtcttcagaattagctacaaccaatacaatttgagtaggcctgaacatttacttgtggaaatcacagaaggttggtcccataataaaataaatgaacaggcattagatcaagaattagagaaggcacaacatggattaaaagtgtacctaatgattttcccaaatgaaattttctaccatagaaagctaccattaagaacaccaacctttctcttactttaagaaaaatgggataggccaggtgcggtggctcacacctataatcccagcatttgggaggccaaggcaggtggatcacctgaggtcaggagttcgagaccaacctagccaacatggtgaaactctgtctctgctaaaaatacaaaaattagccaggtatgatggcaggcacgttgggaggctgaggcaggagaattgcttgaacctgggaggcagagtttgcactgatctgagatctccccactgcactccagcctgggtgacagggcaaggctctgtcaaaataaataaataaataaataaataaataaataaataaataaaacaccagagattaaagttgcttatctttccctatcttaagctatcatctagattatacatgtaaactcttaatttgaggacattttactcagaaatggtcatgaccctatcatctttcatcggaaacatttacttatactgacggattatgatttttgttgttgctgtttgttgatttctgtttgtttttcctagtaggtgttttctccatgaagatgttctcagaactctctaaactaacgtaccctacttgaaatgcaaactaccagatctaatttgccatcatcccttcttacctccctgaatgctatttcttttcaatggattatagctaaaatgatgcataatctcaaagcagctctactaatcatgctgtgggtggaggttttataaaaaatagaccctgctcatcttgctaagttagtacttagaatgcatttggaaataaacttgtttagatttcaaaagatagcataaagtaaactgtaaggaatatgtagtcaaaggaaataattccatggactaataggataaaatgaagctaaaggcatattaaagtaacaaaataattaaatttcctcatatcagctataatcagtttgaagaagataatgtaacattttaattatcatgtgtctataaattggttttaatttctctgcaggaaaacggttgtctgccctatcattgatgtgattagtgatgatacttttgaatatatggctgggtcagacatgacttatgggggttttaactggaaactgaatttccgctggtatcctgttccccaaagagaaatggacaggaggaaaggagacagaacattacctgtcaggtatgtagatcatatctcttgaagattatgtatatccccctaaaaattaaggaatattatagatttctgttctaatgtttaattatttaattgtatccttattattcaatatacatatacattatgacctttacataatcatataaggatcaatgacaatattaaatctaatttaaattagtataggcaaacttaagtattggcaaaaatgctaaatatcttttgaaagtttatgtattcttgtattcaaaatatatttactgtgaattttctatgtgacagaaatgtgctagccttgacacttcaagtaaatgtgtgtcttaccttaaagtatagatttataatagaaatgttctcaaaactgaaatagccaaaaatgttttggtaagtattctaaatataccacctttaaaaggttatcttccttatagattctataggtccatttggaaaatattaatgtattcaaaattatgaagggcttattatcccaaattacttcaaatactacttaagttgaaatcctgattagtaaaatatgcacttacttgtaataaaaaatatcatatacatctcgaattgtctgtataagcattacccactttattaacacaaaagtatcatcttcctacttaaacacattgtggacctcttacctgaaactaaaaatcgatttcctgaaaaatactttcggaagtattcactagtttagttctttaaagatgaatttggcaaatcatccttcctttggaacatgagagaaataccctaacattctagaaacatacactttaagtcctcacttagcattgtcaacaggttcttggaaactgcaactttaaacaaaataacaaaaacactgtcatcaatcttataatggaaggacattgaactaaaggatgttactcgaggaccttttgtttgtcatttcacttaaagttgcaacaacattaagtgaagacttactgtatgtaaaatccatgatctgaacaagaatgtctggtaacctactgaagggatgacttatctattgtcacctacttaattatataaagaattaattaaaattaaactctaaaaataggctaatggaagagaatggctaaaggtatttgttactgaacaattaaatattagggatgttaacttctaaagaagatctgttacatcaaagagaaaaataaaatgtgacttctaacatttgtataaagtcatgtaagttatcctgtcagtatttaaaatgtaacttagtagtcttaagtcttgtataatcttcaaattcaccaagtcttattgatacttacctttaacaaactgggaaaatatagtggctcatgttaccatcatttattagatattctattttcccaaattgttttcatttagtgttagctgatttttaaactttagattccgagtgaaaactatcagaatgcttgaccaatacacttacatatagataatgtttttattcatttgaaaatgctgtttataagaaggcatgtttatactcatttaaaaaaacacattggcaaaaaacatgctttatttatgttctcacagagtcaaacggaagataactaagaggtagccagcattcacagtaagaaattactgatctcattcataaaataaagatctatgtagaaatcaatcattattactcatctttcattaactaaaccaaaagatgaatcatctaacttcctatattttaaccataatttatgtggttgtattgcagtaatatgagatctgataaaatctcagtatattttgtttcctgcagtaacggcacatcattttattttctaacatgctgaggaagctgaagtgagagaaacagagaaacctcagtctttgctgaagtttctagatttttgtggcaaaaggttaattaattcatgggttcggttgtaacagcctgcaggtaattttcatcagcatagctgtaatgtgaacgttccttctacttgtaatctattgcttgaagatgtgatcatttttctcacattcatacaaatagataaatcattctagatgttgaagacaatttttttcctacttgattaacagaattctgaatagctaaagtgatgaaaatgaagctgaaattttagttttcttagtggaatgcttcatttaaaatgtcagttatgatagaactttgtagtcaccataattggctagtcatcatttagaaatacaatcatgcatctgcttacattgaaagccaagttgaacttgtgacctaaatcagttatactacatctaaagtaaagcttaacatggtcattcttatttttctgggctttggtattttcattttcataataaatggagtttgtgaaatacttgttaattttcatattataactatggaataatatacataattacgaatatatattttcctttaatcagtaatatatagtttcctttaatcagtaaactttccttgacatttaataatcaaattatatgacttttcaagaatatttcaattatatgtgcaacaaatagtactttttaaactggaggtcataaactaggaggttttgtgccaaatattctctgtagaagtgttttatttggcatacatagtgttttacattttcaaaaattaccaacactttaaaaatgagatattttaaataaaaatctggatttccatctactaataagtcagaagatcttgctacaatggaccaggattcttacctggcaccatcaggtggaatttaatagaaactgcccatgtagaaatggcatgaaaacttttcccaatctccacaactccttctaaattatgttcctgacactgaggctgagggtcatttgacatttgtcaatattcttgaaattgaagaaatatttctctgcacctgtgtcttgaggaaagggggaaaatatatttattgtaacaaatccactttatataattatctttatctggctataatcttttaaagttttgaccctggtcttagaggctactgcctgggaaatggctgagtttgaaactcatcaagcatatcacccctgtataactatgcatatacattacctaatagagtaggcaactagtagcaaagttacctgataatgcaaataatactctagatcatttaattaatttggggatgagttatgcattttttcctaacacatacaaatgggaggtgatttggtttaggctattgaaataagtttgattccatacaaaaacaaacatacaaactgttctatttgtattccatgcatacaaactattgggcgctgtgctaagttctgcacatacaagcatggataaggctacctatgctgtaaagttgctcactgtctggcactggccacaggtatgctcgatgagggaaagagtctagtgtaaatggtccaagtgtggatgtacaggaataattatgtctactactaaagtggtgtggacctctagaaaggagcctggcttaagtcttattgattgctttagtctcttaattatgccctgtaagtgaacctcaataaataattatgaagatattcatttccactttaatttcacactgattaaaatagattttttaaatgaaaaacctactggtaatttccaagtgaatttaacttttttcacccttcacatcttaccttatggactcttttacctttaatcatcattaatatttttaatatgactgccttcatttttacttcaagtgccatgttgagtatatttctaaagtaaaacaaaagagttttagatgttcttttaattctgatatagtaataaatcaaacataaatgttattggtttttatttcagacctattttacctaattttatattcctttttattgacattcagttgatttcatgcatttatttttcactcaattagaattaggagtttatgaagatcaaataaatcaaataacatcattagtatctctgattataattgtattttattgtgaaaaactcatagaatgttcacatatattatctcctctatcattctagtgtgatcatagaagaagcattgaaactagccttggaggatctagttttatttcaagctcctccaattgagaaattacctagtcttctcaactataaaatggaaaattattctccctgctttgcttaactcatgaagtgctataaaatattgaaatgagcaatgtctttgatatgaattaggttttaaatttatatctgataatgtaacatataaatattgcaaaataaatgtgacaagtacccaaaaggatgaagaagcagaacaccaatgagccatctcttttagaatttggttgtattttcttctaaggcttttctattcaatttctctacaatgtaaatttgatatatcatcaatatttttctatgccattatttttccccacataggttttaatggctgctaatgtctcaattacttacgatgtttctctattttttttgttgactaaagttcatcaagagtttgtttgcacttcaatttttttatcaattatttcttcacctagtgtttgcatacaaagtgattgctttagaattatgcatttgaatatgaaatttgttttaatattcctgacaccttctgccaatttaattcctccccaaaaatattatcactgaatcaatttataatttcactaagtataataaattaaaaacacaaatgttactctttaacatcttatacaaatataagacaaagtttcttatatttagtagtaacaaataatttacttcttaatttttatcagattgtattagacttttctcaatccaaccataatatacgtttggattgcaggaaagaaacagaaatagatatcaccaaagcctttaaaacacttctataaaataaaagatatgaaaacaacagcacagggaaaggtcaacgttgtgagcagaacaaagactgaaagaaataactaactttggaatgctcaactagtcaatgctcttgcttactcctgttaaaatctaatgtatgttgattgagagaagtaaaaaattatctcctcagataaaaatatttgaatctatattctatgaaagaaagagtacttttatattatattactttctaatagtttaggggataatttgggagactttcttagcagcctgttgggatgagaagaaaactagggtaatagagtgctaagttaaatattacatttatatactgaataattttgtcacatgaaccaaaatattttatgacatctgatcccagctggccccattgtttattttgatccctcgtaagcatgaaatgaaagtacaatgaaagattaaaatttgcaccaattactctacatccttgtggaagcttagggttttatcaggtcctaggaattattaaaaaggatttagggaaaaaaataactactcctttattggaaatatagatgtttaagcacaagtttaagtatttgattctcatgcttattggtaagtgggttctttggcagcaaaacaaatcatttgcccatactaagcagaacattatatttttcttattccttaaaaatgacacaaattgtttgtgtttcatcgactctgcaggattttagtaagcttccatgtctagagcctaagccagcataaagtcttaaagtaacaatttcttctctacagaaagccacatcttcatacccaaacacaggttcagatgattgtaatagtgtgcggtatccaccaaacttcccatttttatcagtaaaaactttaattacattcagcatttaattattcatcactctgatagaaaagcatttgtgcctctgcttcctttctctttcctctgctttctattttggttatagtgcatagaataaggaagaaaggagagaaactcatagcatttcatttcctttgggttcctaaacctacaaaatgattaacctaataaagccattagattttataatttaaaaaaatcagacgtgaagatttcagctattcatgctcatatttgtaaatgtaaaaaaaaccttatttttattacttatctttattaattttataatctatggaaaatgtaattaacacagatctaaatactaacagtgtagatattgtgttatttgaacattataaataatagcttagaactaagctgtggtctctgaaacattcttaggagtttttcctccaaggcccttgattatttgccaagtaagattaaatagaatcctgatgtatccaaagaaaaaaatagaaggaatgatgtttccagaactttgagagaaattgtttatgaagggcagtccaaaaattcacaggaaaacatggtacataaacatggagcttgaaatcaggaaacatgtactattttaatttattttattttattattattatttttttttttttgagatggagtctcgctctgtcacccaggctggagttacagtggcgccatcttggcctaccgcaagctccgcctcccggattcacgccattcccctgcctcagcctcccaagtagctgggactacaggtgcccgccaccatgcccggctaattttttgtatttttaatagagactgggtttcaccgtgttagccaggatggtctcgttctcctgacctcgtgatccgcctgcctcagcctcccaaagtgctgggattacaggcgtgagccaccactccccgctaggaaaaatgtatttctaattaactaccccaaatcttttgctgtataaggtatatggacgaatggaaaaagatagatagatagatagatagatagatagatagatagatagatagatagatagataatagataaggaaaggagaggagagaagaggagaggagaggaaaggaagaaagaaagaaagatgacttttttatccatgctaccaactagttaggggtccttgaacaagggacttaaacacattgcaactaaattttttgaccaaaactgtagggattttagagctctgaaatattacatatctgaaaattaattggacccagaaaacaataaaaatgaagcaacttataatcttggtaaacagagatgtttctccttttttgatagataatatctaaaatgtatactataagctttgtgctggtattgtttcaagactgttacatgtattaactcacatgatccacattttataggtgatgaaactgaggcacagagtttaagtgactcaatgacagtcaaacactgtggggctggggtttgaatccaatctagctatgaagtccagacttctaacaactaaatttggctgcctcttggggtctcattacctctatacagggtgattatcacagcgtgaaatacaggatatattgtcttcttggtgaaaatacagacattacattttagcattactgaataattaaatgtattctgtcacaatttctgttgatttaccaacttctggtgaaaaactccagcatttttccatgtcaaatgcatacttttttgagacttttactattttacatagttacaaagcttcatatcttaaattctaaaatactatcacaaactaggcactgtagcatgcacctgtcatcctgagacaggaagatagctggaggccaagagttcgagattatcctgggcagtatagtgagacccagtctcaaagtataactaaccaaataaataaataaaatactatcaaactcaacccctaaaactcctattagatgatagagcctttgaaaatcttgcaattagtgaaatcatctttgttactcatcaatttagcaggtgcgagcaaagaacatttttggaatttcagaaataaaattgcagataattttaactttcaaatagattgttctgtggctatagagatacattactcatttgtttgttattcagtaaatatccattaatagtctaatactattaaaccaatgtattgggtatgcttatagaagtggtgaaaagtacacaaataaatataatactatatacaataagaattggccagttccttgagatacacagtgataagggcttatagaagaaggtggaaggggaagagtatgtcttgattgagggagcagggggacggggcagtggtgttgaaggcaggctgcctagagtgtataacatttgtattagactaagaataatcaaatttgaacatataaggggagttttcaaagaaaaatccaggtgaccaatggatgtgaacaaatataccaaggcacaaaaatgtaaagcatttaccagtaacagctaaacactttacatgcagggaaatagttaaagggggttgagaggagctcgttgggtagccccattgtttattttgatccctcgtaatcaaatggctagattactgatgccaggataagaagctagatttatttccttaacatagatttttgaacatctattaacatttttagaggatcatcaatttagagaaattaatctggctatggtttttaggataaatttcagaagcagaagaatctagaggcatccagatcctctcagcatctaggcatcttagcatctaagaggaccccattattagcaaacatagaagactaaaagtatcactatgataacagagatgagtcaaaaatacttcagaaaaaaaaagaagtattttggaaataattgaattaggcataaaaaatgtggtttttcattttatattaagagactggaaagaaatataagacattaaaagagagacagataagtagcaaattttcaggtctatgatgtacacactgaacagagtcaaaggagttttttggaggaatcatctagtgagtaactgcaaaagcacaacttatgcagaggaaacaagtatggaaacacagattaggagtgaaccataaaggtgacagtgaaaggtatgtgatgaatgatctgatcttacccacacaaagagcatagaaagagaaaagtgcccctgagagacccttgggaggactaatttcagatgagagaagaaattattaaatgcatatatccacaaaataatattataatggtatattgcacccacgtgatagatatgaaactaagagcttgtccaaagtctgacagcaaggaaaaaggaggggaaggggatgtcaataagaatcataaaattaacaatcagattagtagaagggaaacctctacagaacaatgcaataggagctagaaacaaaaatgatttcaagcaggaagcctgatgtattgtgctatatactttcagaggaaaaagttaaggacaggttattggagttcaaaatcaatggggacctttcagaaagaagttattgtagaggcgggagcaggatctagcttctagttgaaggttaaaagttgctaagggggtatgtagaaagcatcctttcaagaaggttaccagggaagggaatagaaaatatatgtgtctggtttaacagagtagtaaggtggaatgaaaatgttttttggtttaggatagaacttaattcagcaggcttgtaagctcaagggaacaatctagaaatccaaggcataaaacataaatgttaatagtcgatgagcaagggcctgaaagagtagttaggagtctgttgaggccacaagcatgaatgctagaccacaatgagaggaaaggagctattcttttttatgagacaagaggagagaggaggccatgaggaagacacatttttaaacatgttgagctagagattgaaggagtttagatttcatgattgagataatttagatttcatgcatttccttgatccccagatggttgagaagagtccaaaacttttggaaagactcaggccaggtgtggtgactaacacctgtaatcccagcacgttgagaggccaaggtgggcaggtcatttgagcccaggagttcaagatcagcctgagcaacatagcaaaactctgtctctacaaaaaatacaaaaagatagctcggtatggtggtgcatgcccgtagtcccagctattctggaggctgaggtgggagaatcatctgagcctgggaagtcgaggctgcagggaaatctgattgcaccactacaccactctagcctgggtgtcagagtgagaccctgtctcaaaaaaagaaaaaaaaaactcagttaaaaataaggtaaacaaatagagagcaggattgttagcagtttgtgaattaagcagagaatcaataatgtggacttgtcctataaccagttaaccacatcttattactttcccagtgtcttaatagcagaagtaaatgaagtgaaaggtagattcacccaagcaccaaaatttaaaaaaaaaagcgagagagataattggaaattgcagaaaagcaagcacagagaaccaaagttcctaagctagtgttttgctgacatggcagagccttggaaatggattggaagaagggaagaagaaattcctgaaagttgttattaatgtgagactatggattaactaaggaaccataatcaccaataaaggataaaatgacttcttatgaaaataggaggggttaaagagtaagaagttatgctctgaggcaaatttcagtcagcatcttggatatgaggtagttctaaatggttttgaaacctaaagtgagggtatatagagagagaggagcccaaattaaatgaaggatagcaaggattttacttaaatgattaacatcaataacaacaacaacaaagataaattacctacccttattaactgttggttatgtattgagaactgtgttaagtgctttacttctgttaactcagttcatctttcctacttactatgtgtggtaggtagtgttcacagtcattgagctgactattcccctctcgttcaattgactgtttggttgcttggtttgacattgtttagacacaaccttgaaaagcaaataatttcagttaatttaaccataatcaagatttttcattttctagatgctctgaacacttaaggtgcacatgggcatatgtaaatattttattaggcatattacagggcagttaacttagaacagaacgtgttgcataacattggctatggctataggtattaaacattataaggcagagtctccaatctgagagagctaactgatattgcaaacacaaaaaaaactatccaggagtatctgtcttcagaaaatacaggagtttcttgaagaattgtaattttattttattatttttattattttcaagcataagtaaaagttatttgagtctttcttaatagtataaatagccacttatacatttctcacatagaagaatgatgaccaactgtaagccgaaattcaatacatgttatttaaattaaaatgtgccagtactttatcagtaagtagataagtagatgggcactctgaactgattattaaaaatgcatcacttaacaatattaagcatttggttacattatgataggataattgcagcaattttggttcctaattttatcaatcaaatagactctccagcactgtaatatgttatatagttattgccatagtgttccaaaacccacatcaggtgagggtcatggctacttcctaattaccatctgtttagctttgttagtgtttctcattataactcagaaggtcaatgatactgttcatgataggaacccagcaaggcgaaaagtaataaaatagctctgagactaagcaaggctctgctactccaactgatggacagttaattacctgagcataaaacagtgagagcactgggagaaatagagaactttgcaatatggtagatgtccaagtacaatattatttggtggtttttcaatgaacaattctgtttaattaaaacatgagcataacctttgtcagaggagaatgtaattttgacaaaagcaaaacatttggtttttaacagcctcacagactacttagatgagcattccaaatctaagtttctatagcagtttctcacccttggcagtacattagaagtacatagaaactttatataataccaaagtcgggccccaccccaagccaattaaatctaaatctgtggagggtggaaattaaacatgcccatctttttttttaaaggtggctcagatactgcttttgtgctttgaaggttacaaaccactatattacaactaacattcaaaagtcatcattgccattatggatctatttgtgaacaactacaatcttctttttaacctttaatttgcactgcttttatatggaaagacttgtgtagctcactcattaaccattgtctttaatttgtcttttaaattatcaactaattaatcttttaaaaacttcacatctgacttctcagctcccatggaggaattttgaacgtgaaaccaaaaggcatttattcctagaaaaaagttttagaatcccttcgaagtgtcctttcaaacctctgaataacagaaatcccataaatcctatgggatatatgtttttccatagaattagatgattaattctatcattttaattagtaaagagaagaataaacaattagatgtaaagcccttatgttaaaaaaaatacctttgtaactatcgctagatacttattttctataaacattttatagaatttaattttttttatttttaaataggctatggatcttttcatagtgaaaccatgtccacagatttctagagtttacataaaaatgatttacattatgtgacctaagttgacacctgatagtttcatgaccagctaaccacttcaaggacagtgcaaagggcagaaacctctcttcgctatgattttcagagggaatatagaagtaccagtcttccatggccagtgtcactttcatctatctatttgatcacctgtaaaaaaaaaaaacaaaaactaatatgagttttaaagaaaatgtgaaaaaaatgctatttcttaattttaaaacttcttacaccttgactttgtgtttttagtttgagattttttaaatatttagaatgtctcaaaaatacgtgctacagtctcattaaactccatacattgttttcaaaagatattcttttctttttgttttttttcaactaggacccctactatggctggtggcctattttctattgacagaaactactttgaagagataggaacttacgatgcaggaatggatatctggggtggagagaatcttgaaatgtcttttagggtaattgcattttattttattttttgatgctgaacatacaatgctgtagcatgcacataccagtcccagtaatttactgtcaaatcatttttgctgagtgatgcaaattactgatcaattggttatcttaattcacattttgatttgacagagtcctattgcatgcaatattttcttctaaatgggaaattataggtaatttttgttttcaaaaatattgtttttattcacagtaaaaatacattaggactttcaattgctgaaataaagaagggttttattttttaataacgtgttgctctataaaatcactttgtgtttttgaactgaaacttggaagtatttatgtaatctgaatttgcaactactgcctcaggttgttctcagaaaactttaagaatgaactgtggtcaaatgaatttggataattctgcaagtagtgtgaccattttcactaacattattgttggataagtcagtttgaataaagcaacttcatttaataaatggccttccatgtaaataaaaattgaggaataagtccttacgaatatgttattaggaaagtttaataataatttaaataatattttgttatattcaaaaaatttaaaaatgaacacataagttttctttcatgctaagaaattgataagcactaacatagtggttttgtttttcaaatcactgcttttttttctacctaaaattcagtgtaaactatttgtgagtgttttttgttattgttgttgttgttttttgagacagaatttccatcacccaggctggagtggtacagtggtgcaatttcagggctcactgcagcctagacctccagggctcgggtgatcctcccacctcagcctcccttgtggctgggactagaggtgtgcaacactactcctagctatttgtttttctattttttgtagagacagggttttgccatgttgcccagggtggtctcaaattcctgagctcaagcaatccacccccctctgcctcccaaagagttgcgattacaggcatgagccaccacacccagcttcagtgtaaaatatatgaaacattccatcttcgcccaaaatatttgtacaataaaattattagagtttagatgtatttatctatgaagtttaaaaattatgccttttaatttctcatttcaaaagtaaagtttgtttttcattatcataatataaatacgtgtgatgttgtgtaagaaaatgttaaaatttgagaatgagttaccttgaatttctctactgtagaattcagtggatcttggataaattattttaaaatcagtaggatggcctagttatattactattttgcctgtaaactttcctgatagccagatgtctgagacaaaccttagttaatggaattttattatttttgcatttgtctatatgcttatattctcatgaaacttgccaaaccaaactcagcaccacactcaggaatatcttcttgccttcaggtccatggacagtaactctttgcaggaattttgaggacatttgagaacccaaaattattacctgttatggttcttatggtgaaagaaataagaggtaacagaaaaagaaaagaaatcagtatattcagaagtttagaaataatttgcttctattcttagaagtaataatgagagaatgtactcattcattaactgatattcttcgggtgctatgctgggttacgtaagaaataaaatcaacacagaaataccgctactatataggatcctcttgctactttttctcttgtcttcctaaaattagaattcacctctttcctccctacctgttaagcttgattttctgccaatgtactcctcttacttttatcacatatctcccagattggcgggatgctctttatctaactggttgaaagtagaattcagaaagaatttagtggaataatatgataaacaaggaggacctgatcaggaaatgtaacagaggtataaatgtataaaaaggaagacttgaggatatgatagatgatgcagataccaagggtacagaaggaatgcagctaggggctgtaagaataatcaaatccctcaaaaatgacacaggaggttttctgtgattggttattgggattattaggaaataaaatacttatcagtgactattttaaaacaatatcaagtgttttaaaatgtattattatctttagtttccatatgactttaatagaaacaaaatatgtattttgctttttattagactcttaatttatgttttactttcttctctgtgacatgaatatgtttgcttaatggtttgtactgtagctgaggtagacattgataaggaaaaatgctagaatagtgcattgacaaaagattgagaccactcatctctctttaatttcatgacttgatgaaatgagaatatgttgagcatttataatcagagggtttgaatctaatatccagctcaatcattacacaacaaacatacattgagcaagtgatatgtttccaggtgctgactttacaaagatgagtaaagcatgatgcttctttgctctcaaagaactgcattcctatgacagagatgcgtaggtgttattgtcaagaaaatgtgataatttcctttataaatttatgtgtgaggttttttgtctctgtcatgtgagtataggtgaacataaactcaactgtaaaaaggtgattataataatagtgaagttattgtggttttgtagctgtggtctacataggttctagtctaagtaaagaagatagaaatatttagggcttgcaaaatgttaagattctgactcacctcaaggtattttaagccaaaccaaaggaatacattgcaaagacttatttgtaacatatcacttgatcgctgtacttaaagacatttgaaaattttatgaaagctgtagacttcctaaggaagatgtttccaaccttttaaagacaacagatttaaatacggtttcaaagtgtttaaaaatctcttgaaaccttaggagaaagatccttggcatataataatagtgactattagtatttatagtagctagtaagtggaatagctaagagttgacccgcagcattctgacaccagggactgtgctgttaaataccatactgttacctcctcattaaggttcatctctccataacataacgaacctaacagttgatggtattattaggagaaagaaagacgctaacatgcaaatacaagcttcctccacaattctgagatgcttctctcgtctataatcttatcttcctcttataggctatagcctctaatggaagataatacacattcaatagcagtgagaatatcaggtatatctaccagagaacagcagttaggtcttaatgcttctgaaagctgtttcaaatatttctccctactgcattacacaacaatcactgcaataacataaatcctaacagcactgtctaaacataagcattaattaattatgtttagacagtgttatgtatctgctggggatacagtaatgaacagaacagacaaaactttgtgctcttatggaacttagattttggagaaagagacagacaataaacaaaataaataaaatttattaaaatatcagttataggtgttaaagaaaaaatataaggaaggaaagattctatgaagtgttggattttggaggatacataggggttgaaattttagacaagaactgagaaattgatacccaaataaaatagtgataaaatgaaccaagaaaattatgaattaccatcaaaaagtatcctctatctttaaataataaccgtgtttcaggataagtatcaaccaacaagcatcaccaccaaaagtccttgtcttttataagcaatatcatggggagcagcattcccaagagtacagatcattttgcccattctaaaatgaagaaaactgccactatccaatcaactcagagcatgggaaaaaataaataaaggagcttgatgacagcaaaggacacagaaatctgtctcacagccatgaatggttacaagtatggactgggattcagatagcctgcattcaacacccagctctggcacttaccatctgtgtaagcttaggtaagatagcacatattctaagctttagtgtgtccatctctaaaacagaaagataacagtactttcctcatttttagagaaagattaaatgatattatgtatattgtgctgagtactccactcagcacatagtgtgtcattcatggcagctgttgtggtgattgttataagctgtgcaactctgggcaagtcataacattcctgagaatcacctaaaaacaatcttacctttaataatttggctttgatcatggttaatcacaagagagaatgtagagaaaaagtcatttaaacccagaaatgcaatatacattaaagtataattatactaagtgttagttgagatgtagttctaaggctcccctgctcaaaaaatatattaaattttaaaaaggaaaagaaaaaccacacacaaaaaaatactttttatacttccacaacatcattggagttaattactgacatctaagaatctagggtggaaaacatttttctacactcataaatcagttggaatgaaacagttgttaatttttaaaagtatgtatcatctagacttggagtaacaagtactagatttaccattctcctcgtcattcacctgaataaattaaaaaatggacaaaaatacatgaaataacactttcaagacattgaacagcagtcaccctgagagatgggaaacaaacaaggaaagccttacaattgcctcggcttactgccttgtgaaagtttctaggccttagtgataaaagggctagatactgacagactccatgacttgaggagatgaagctgagtgtttggggagaccaagcccgctggaatttggtgaacagagtaatggagtcctgggcagagcattgaagagatatacagaggtttctgtgggagtattcagctgtgtcttcacaagtgtgtgaggaaacaatccaagtctgaggaaagaaccttcagaaaaggttagaggtctcattgcccagtgatgactcaggaaagtcaatagtacctgtatcctccagacagattgattcatgaggtaaggggtagaggaaatattgagaaactacataacatacttcttaaaaacccatggatagtctggatgtggtggctcatgcctgtaatcccagcactttgagagatcgagcaggcagatcacctgaggttaggagttcaagaccagcctagccaacatggtgaaactctgtccttactaaaaatacaaaaaaaaaaaaaaaaaaaaattagctgggcatggtggtggactcctgtaatcccagcaactcgagaggctgaggtagaagaatcgcttgaacccaggaggcagaggttgcagtgagccgagatcatgacactgcactcccgtctggacaacagagcgagactctgtcaaaaacaaacaaacaaacaaaacccacagattaaagaacaagtaaaattaccactatttggaatgtaatgaaaatgaaaacatagcacatcaaaatgtgtagtgacactaaagcaaacttaggaattatttatagcactaaatgtctatatcagaaaagaaaaaaaaaaaaaagaggtaaaatcaatgaccttagcttccaccttcagaaactagaaaaagaagagtttttatgccaaagtatctaagaaaaaggaaataataaagataacagcagaaataaatgaaatataaaaggaatatatataatattccacatatatgatacctatatgataaaaaaaaatatatatatatggaaaagcaatgaaaccaaaatttgtttccttgagatcaataaaatagatgatattttagccaaatatgggaaaaatagagagatgacacaaattatcaattttggaaatcagaaaggtggcatgaccaccatgtattctacagatggctaaaaggattggaatggaacattatcattctcattatgccaataaacttgacaacttagataaaatggacaacttcattaaaagatacaaattatcaaagctcacagaaagaaaaaatagaccaaacagccctgtatctagtaaataaatgaaatttattctaaaaatttataatttttaatactttaaaaataatttttacaaaggaaactcaatggccagataacctaactggtgaactctaccaaatgttttgggtagaaatcagaagagttcgggccaggctcagtggctcatgcctgtaatcccaacactttgtgaggccgaggagggcagatcacctgaggtcaggagttggagaacagcctagccaacatgatgaaaccctgtctctactaaaaatacaaaaattaaccgggtgtggtggcgggcacctgtaatcccagctacttgggaggctgaaacaggagaatcgcttgaacccaagagggagaggttgcagtgagccaagactgcaccattgcactccagcctgggcaagaagagcaaaactctgtctcaaaacaaacaaacaaacaaatgcttccacaaaattgaaaggaggtagtacctcccaattcattctgtgagatcagcattacacagataccaaaacttgacaaagtcattacaaaaatagaaaactaaaaattaatattcctggtaaacattgatgcagaaattctaaataaaattagcaaatcaagtttctccgtatgtcaaataaataatatatctgattaagtagtgttcattgcagaaatgcaaggttggtttagcattcaaaaatccatcaaggtaattcaccgtatcaagaaactaaaaaaaattgattggtcatctgaatagagtcaagaaaagtatataacaaactcagtctactcctgaatttaaaaagaaaaccaaaaacaaacaaacaaaagccctgagcaaactatttatagaaaactcatcaacctgataaagggtttgagcaaaaaaacctacacatatttaatgttaaaacattgaatgctttccttctaagatcaggaataaataaagattttggatcttactacatctacttaacattatactggaagttttaggcacagcaacaaggtcggaagaataaattaagccatccatattagggaggaaaaattaagactataattccagaagacaagattatctacaaaatccaatggaatctacaaaagtattgctgaaacaaataagacagtcttcttatcaaggttgtagaatataagaacaatgtataaaagtcaactttatttctatacactagcaacaaacagcagaaaactgatattaaacattatctaaaataatgtaaaaaatatgaaaaagtgataaatctgacaaaagatgtgcaagacctctatgctaaaaactgctgtatattactgaaattaaagacctaaatgaatgaagataaatactattatttattaatagttagtagactcaatatgatattaagatgacaattctccctcagatcaatatagattcactgcaatagcaagtgtattgtatttacttactattgcatatcaatatagattcaatgcaatagttaagtgtattgtatttacttaactattgcattgaatctatattgataagcaatagtaaataaaacttattttgttaggtagaaattgacaagttgattctatccatatagatatacaagggatgtataatagctaaaaatgcattaataaagaaaaaagttagagaattaacaaagtaggatttaaaatgtattataaagctataataatcaagactgtgtgttattaacataaagacagacaaaggaacagaactgaaaatctggaaataaacttaacacatacgtggacaactgatttctaacaaatatgcaaaggctgtttagtagagaaagaatagtagtttcaaaaatattattagaacaactgaatgtctatgtgggggggaaaaacaactccaatccataacttataccatgaaaatattaattcaaaatgtaaaaatataaaattataaaagaaaacataggagaagaacttgtgtaaccattgattagacaaatattccttagatatgacaccaaaagtatgagtcataagagaatggattggtaaattagatatcattaaaatttaaaaacttgtgcttttcaggccgggcatggtggctcacgcctgtaatcccagcactttgggaggccaaggtgggcagatcacttaaggtcaggagtttgagagtagcctggccaacatggtgcaaccccatctctactaaaaatacaaaaattagctgggcgtggtcgtgggcgcctgtaatcccacctacttgggaggctgaggcaggagaatcacttcaacctgggaggcggagcttgcagtgagccgagatagtgccactgcactccagcctgagcaacaaagtgagacttcgtctcaaaaacaaacaaacaaacaaaaaaacttgtgcttttcaaagccactattaagagaaagagaagtgaaggcactgacagaaaaaaagaagttagcaaattatatatctgataatggatttgtatctagaaaaaaaaactctcaaaactcagtaataagaaaacattcaactcaataaaaaatgagcaaaataacttgaatagacacttcactaagaaaggtctacaaatggcaaataagcaattgagtaaatcctcagcagttagtggggaaatgaaatttaaaccacaatgagattacactatgcatttattagaaaaagaaaggttaagaaggctgaccatgttggtgataatatggaagaactgcacctgcaatgctggtggcgatgtacaatggtacactaaactccaaaaaacagttttagtactttttaaacactcttgagtatttactcagtggaaaggaaaatgtatattcatacaaagagttgtatgccaatattcatagcagctttatttgtaataccgaaagccagaaacaatccaaatgtccatcagcaggtcaatgaataaactatgctttgtccatacaaagaatgtgtgcaaactattaatgcaccctacaactttggtgaattttgtaataattatgctgaatgaaacaagccaggcaaaaagattacatactatatgacttcatttgtataaaattttagtaaatgcaaactaatctatgaaatcagataacttgtctggggacatgagattgaggtggcagagggaggattgcagggagggattaccaaggggagcatgaaaacttttagtggtaatgtatgtattcattatcttgattgtggtgacagcctcacaagtttcacctatgacaaaacttcttattgagtggtacaatttaaatatatgcagttcattatatgttagttatactttaataaagctgttaagaattaaaacacacacacacagagagagagacagagagagagagagaggcatactccaaagagaaacaaatgaaggaaaaatgtagttcaaagtatctacttaacagtaaacctctatactttaggttagattctcaatatatcatagtccagttacttttaaatatccctgttgatctgattataacagtctacctcccaggacaactgtattcattaaatgaagtaatactcattaaagctgtttataaataaactgtatggcaatattactttttattataattacccttaaaataagctcttttgtcagtaactaatattttaattaacaagatcgaatttacttcaagtaccccaattttcttttgcttgcaaatcacagtgaaaacaatagtgtatttacctgaagaatatagctaagtgaaatgtcttctcatgtgaaatccatgtatttccaatttgtacaagcaatgaagtggaaaagaaatgagagctgacataataaatagtggaaaaatgaaaagcaggggttcccattgaacagaatagtatggtaaatgagacaatgaaatttgtcaacctttaggggcttatagtatccagactttttaaaaatacttaaagaaagtaaagaattttctaagcaatgtctacacaattcaaattttgacaagtgaaaacatcagccgtaataatttattagaaatcattttagacaaaaatccagctgatttatttctcttagagttctttgcctttttgtaaacttaattcatacaaatctgatgaaagtaggttatttgtcagtgtgtaaaacttgactggtttttttttttggatcagtcatagaaaccaaactataatagaaatatggagatggttttgcaggatacttttctttaaatatgataaatcactctcttaatgataatatagagattattagcctttttaaaaaatcctatgaaatcataaactgacatcatgtgtgtgtagtctccacaaagaatgcagaccaatcttaatgatttggttcagcaaatgtttctcttgttccccatttggtgcaggctgaaccttaaacatattgaagaatagcttgaagttttagcttctgtgcctgcaactagtttttctgtcatctcggccaccactttgctttgaaccattgtttaaacatatattttcattcaaagaagggctttttaaatttaaaccacagaataaaaaatatttctagataagaggcaatgagacagtgctactaaagattgtcatatatatatttatatatatgtgtatatatatatatatatatttctaaagcacagggtgagtaggtgtcacagaataatatttcattatggttcctaatagaattctgtttatccaaaacaaatgtgttagaattttattttgaatattaactgctataaataactggctttgtatgctcctttagaaaaaaataagtgaacaacaggtaaattagacattaatcaagctttagaagaacattagcaaacattaacaaaacttgtattgctcttaaaattataatagcttaaggcatcgtaatttcaataactacattcctctattaatatttttggttcagaaaactggaatatgagaagagctttatattagcctttgatatgatgctttaccttgtaaacattcaatttggagacatgcttatagttttagaaacataaagcacttaaagttgtttagatgcactaaaacttggtattaatctctggttctcttttatattcatttaattatttcttaaactaattgaaaataattttgaggtggtcggtaccacccataattcgtttttaaagcataaccacttatttataccttttctattatttctaaaatcatcctaagagattactaacatgaaaattcacaattgaaatgattcaaaacaaagcaaccgagaggaaagatgaaaatgaagggcaagagaaataaagtaacaagaaaatgggataaactagtcacattgaataatcaataactttattcaaatattcctgacagctaaagtgaaaataaattagtaaataaaattgcactgaacctttttttttcttcagatgaaaggaactagattctgaaaggcattgcccagtagacacaaagcagttgatatgttagaccatgttttagcaaacatccactaatgcctttaaatggatagtgggtttcttgggtgcactaagagaaaattatcaattttattgctttccagtgatttgatctcataaaggaatatatcttgaagatagagtatcatttggggtttttctgtaaataaaacgtatctaaattcagtcaagcttaaatgttggtcaattcacatttgaattatgttagcattcttttctcttaataaaaatagaactcacatacacaagatgcagggatgtagatactaacattagtggctggtcatgaaaactatgatataaactttttctcctactcagacccatcacatttcttcacaggtttggttcacagggttgcttgtgaataatgttattagagaatggatttgcttggatacaacttggtaaagagattaaaatgtaataaagatacaaattgtctagatatttttggttatgctatttgttatctgtgcaacgcatagaataattggccattactggctgcaatgaaatatctatgctagcttgtaacagctgtcttggaactaaacaaactaaaaattttggagaagttaaatatgagctttgttaggcaatttcatgaggatttagaagatggtaaaacaaatcctagagttatgagaagataggtgaggtttgaactgagtgttaaagaactgacagaagttagctatgtcaggaataagaaaggcatttgaggaacagaataccacatctgtggaattagaatatgtgtcataaacctagccctcttgcattaataacattcatttcttctctttcatgacctcacaaaatctcatcatatgagtgtttctctggagaattgtaagcatatactgtattggtaaaccaacaaaaatactcgtctactatctaaccaatcatgaatactatctgtttattttattcatctatatatatatctatctaatttatgtgtatgtgagtctatgttagcataaaaactaaatatttatgagggcccaaaatgtaagtctctagtggtagttactgtagaagctatattgtaacaatgatgtatggataaaaattttacagtattagatgtctctataaaaataaatgctgaatggtactcgcaagacatcctgaatgagttggaactaggatagtaaaggaaattataaaattatggaaccctgaaagatggacaggaattaaatgcataaaaagaaaaagaaatcgaatgaaaattatacaaaaatagtaatgtataaagtatacattttcatttccattaataaataaagaagtgaatgatattttatagggcttatccagaaatacacattggaaatgttttgttggaaaatcaatctaattgagaaagtttttctgtcttcttgaatgataccattagatggaaataaaggtacacacaagaaaaataaacaattaacttctgaaccatgataaaaacacttttgaaaatattattctttaacagatacaaggatattttaaacatactaagcagaatgtccctgtatatagcaataagccaggaatacctggctttttagtgaatttcagtacattaagtaaccaacactcttattagagaccaatgtctaaaatgtcaactttgagaaacatacttcattgctgtggctttctgacccttctctgctcatatgaacagatattccacgtgcatgttacccttaaaagtctttataatctttctgatcccaaacataaaggacttaaattcagcggtttgaatttatggcaataaaaacagctatatgaagaatgttaatgtgctcagaattattgaacagacaagtttcatatccccttaaggccaaatttcactagagcctcccattaagtgtgcttaatcaaacaaaatgatgctgaaaattaagtcaattatcctgctgatttacatttgaaatgtccctgaaatattctaataaagaaatgtttaactttcttttaaatctaaatatatgctgccgtgaattgacttttagctatttattttacaaattagggtttcatttttcttacgtggaaagggaaagttaaagtaaataacttgtaaaaaaatagctttaaaattttaaaaagcatttatacagattgggtttgattaatgagctacaactgccattaaattcaaatgaaatgtgcaaataagtttaagtcaggaaatttactggttaattttaaaatgtttgtcagttcttgggcatactcagtccctggtctcggtttcctagaacttatgctagagggagaccatagacgataaatgagtaagcagaaatattattctgttaatttcagataaagtcaagtgcctagaagaaaataaaataaggtaaaatgttgtgaatgacagaggtggaggatgaagggtagagaactacattacctagagtggtcagagaaaccctcccaggggacatttgggctgataccagatgacaggaagcatctatctatgcaaggatttgcaggggggaacattcagcatagaaaaaaaatgataaatgcaaaaggccttatgcagctatgaagtgagctcagttctcctgttccaagtctataggatcacaaatagcctgaagaattgggagggttaggagagaggtcatcctctcagaataatgttttggttgactgatttgttcagcatacaattaatgtgtacctatttgccacatacaatcacacactacataattgtgttttggtcaacaacgacacatatacaatggtggtcccataggatactactgtatttttactatatcttttctatatgtagatatttttagatacacaaatacttaccattgtgttacagttgcccacagcattcattacagacacatgcttttcaagtttgtaagctgtaccatctaggtttgtataagaacattctgtaatgttcacatgataatgaaatcacctaatggtgcattcctcaaactgtatcccagtctttcagtgttgcatgtacaccgagtacagttacaaaagatgtacaagagatgttttctaagagattatattttgatgaaggcttacatttgaataatacataataaaataaataataataaaatcattttacaagtattgttataatggatctagtatagattaaatatataagaaggttttttctcattattttgtttcttatcttgaatgcattttgtaacatttgcattatacttcagatcacctctaagtatcagccaactataaatcaaccctcattttacctatcaatcagtataaatattcacatacctaaacctgcaatagaccctgtggatggcatatacgcaaggtgtggttcttgatttctttcactgtgtgggtatgtaagatagcaaatagcacctgataatgtacgaagttctaggtatcatttgaagatgcagatatatagtgcattaagttcaaaggagggaacgattgctgtggtctaagacattcatggaagaatttagaaataaaaaatttaagggtatatgtagtcttgtgaaaagaagcagaaaagcatggcctggaaatctgtgtactctcagtttacaaagttctctgctgctgtgatccttgatatagtttggctgtgtccccacccaaatctcatcttgaattgtagttcctgtagtccccacgtgtcatggaagggatccagtgggaagtagtttaatcatgggggtggttacccccatgctgctcttggcacttcttgcttggcatttctccttgctgctgccatgtgaagaaggtcatgtttgcttccccttccaccgtgattataagtttcctgaagccttacaagccatgctgaacagtgagtcaactaaacctctttctttataaattacccagtcttgggtatgtctttattagcagcatgagaatggactaatacagtaaattggtactgggggtaccaaaaagatacccaaaaatgtagaagtgactttggaactgggtaacaggcagaggttagaagagtttggagggatcagaagacaggaagatgtgggaaagtttggaagttcctagagacttgtttaatggctttgaacaaaatgctgatagtgatacggacaacaaagtccaggctgaggtggtctcagagatggggaacctgttgtgaactggagtaaaggtcactcttgctatgcaaagagagtggcagcattttttgcctgccctaaagatctgtggaactttgaacttgagagagataatttagggtatctggcagaagaaatttctaagccgcagaccatttaagaagaagcagagcctaaaagtttggaaaatttgcagcctgttgatgcaatagaaaagaaaaacccattttctgtggagaaattcaagcctgttgcagaaatttgcataagtaacaaggagccaaatattaaccaccaagacaatggggaaaaggtttccagggcatgtcagagaccttcacagcagcccttcccatcacaggcctggaggcctaggaaggaaaaatagtttagtgagttgagcctagggcctcccttgcttgtgtgcagccttgagacttggtgctctgcatcccagatgctctagctatgggtaaaaggcatcagtatacagttcaggccattgttttagggggtgcaagccccaagccttggcaacttccacatgctgttaggcctgtgggttcacagaagtcaagaattgaggttgggggacctctgcctaggtttcagaggatgtgtggaaatgcctagatgtccaggcagaggtatgctgcaggagtggagccctcatggagaccctcttgctagggcagtgtggaatggaaatgtggggtgcaagcccccacacagagtcccccctggacattgtctagtggatctgtgagaagagggccactgtcctccagaccccagaatggtagctccaccaacagcttgcactgtgtacctggaaaagccacagacaatcagccccaacccaggaaagctgacaggagagggactatcccctgcaaagccacaggaatggagctacccaaggccgtgggagcccatctcttgtatcagtgtgacctggatgtgagacatggagtcgaagaagatcactctgtaaccttaaggtttaatgactgccctgttggattttgggcttgcattgggcctgtagcttctttgtttgggccaatttctcccatttggaatgggtatatttacccagtgcctgtacccccattgtatctaggaggtaactaacttgcttttgattttacaggctcataggcagaaaggacttgccttgtcttagatgagactgtggactgtggattgtggatgcttttcttttcttttctttgttttcttttcttttctcttttctcttttgttttctctttttttttgatggagtctcactctgttgtacaggctggagtacagtggcacaatctcagctcactgcaacctccttttcctgggttcaagcaattctcatgcctcagcctcccaagtagctgggactacaggtgtgggccaccacatctggttaatttttgtattttgagtagaaacggaaaatgcaacatctgcatcttcaccatattggccaggcttgtcttgaactcctgacctcaggtgatccatccaccattgcctcccaaagtgctggcattaaaggcatgaaccaccaggccctgtcagactgtgacttttgagttaatgctgaaataggttaagattttgagttaatgctaaaatgagttaagatgcctcctcattgggaatgcatgattgcttttgaaatgtgatgacatgagatttggaaggggcggaatgatatgatttatgtgtgtcctcacccaaatctcatcttgaattgtagttcccataatcccctcatgttggagggatctggtgggaggcaatttaatcatgggggtggttagttgagtgctgctgttctcatgatggtgagtgattctcacaagatctgatggttttacaaagggcttttcccccttttgctgggtgcttcttgctgctaccatgtgaagaaggatgtgtttgcttccccttccaccatgagtgtacatttcctaaggccttcccagccatgctgaactgtgagtcaattaaacctctttcctttataaattacccagtcttgggcatgtctttattagcagcatgggaacagactaatacactcctactttgttctttgaggcatatctaagtttagagtagaacatctgatttcctgccttttgttttccctatggaagattacatgaatgaagtattactaaagcattacatgtgtatcttataaaactaagatttaaatggcaggattaataaagtatttattaaaaattcaacaaattgagcctattatttttatatacctatatctgatcccttaaagacatctaggacaaaattccaaatctgttgtttttgtatatgttcagttaggaaacctactgaacctcgctcgtcaaaattaatgcattcaaaattgaatctatgtattttttattaaagagccaactttaaatctctatggtaacgactgcaataaatgtgcaacatcttaagctatgattatattgtcacacttagtgatgtctatcttcattacatgactaccaatcgttttactgttgttctagtcaaccagaaatgtagttaaaaaaggaaaccaattatgagatttatttaaataagaccgaacaatttctgcaataacagattctagatactaggactgactctgagtgtgtgagataatgttgaggggagaatttcatccaactgtaaaaaattgagtggtaagtaccaatacgtaattactactgagaaattaagtataattgaaaagctagttgttgattttcagtactacccttaaaaattatattcaaccaaacaatatttacaacattttcaaaattccaaatttgatgcattaggaattctaaagatgttttataattgtcaaactaaccatgtggttacactgcaaatatgccaaaattgaaataaacatttttggtatggaattattagcatttctgtactgccaccatgatacacctgcatgtgataatatatttctgcatgccctactctatcatcaaagttttggcaacattttcccacttacttgcttactccatagcctagtaatatgtgatccctgaccaaaatattttttctctattttaagtggtcaaccaaattctatatttactttttaaaatcctatattttagttggtcaaccaactttatattccatattattaattggccaataaaagctatttgcatttgcgaaaaacatcataacttatggaattcctaaattaagataaaaatctatacaaaactttaagcgtactgtgtcccacactaatcctgtaatggtctatttggatagtaattagacctgatggaagactactgctccttcatcatttctctgaccctacaagagaagacctcaggaactgcaagatttcttttcatatttggggaacaaaatggaagctcttgattctataaagttatggaaagttaaagatgtaccaggagcagttggaaatgtgttgcagggttgaggcaaaggataaggaattaaatgggtgtatgaggattgattaatttgccaaggaagaaaatagggacagcaaaagagcaaggcatttccttaggtagcacctactttaggggtgggagaaagaagaaaaagtgattgctaagtcaaaactgtcagtgaagaacaaataaaatgtcacaaaaacttagaaagttatggtgattgtcaacagtgtcaaatgctacagagaagtcaggaagtaggaataatgtaagctcataaaaagtttcatgagcagtttcagatgatggattcaagatagtggaatataagatgataagataattggattgtgaaaacatgtagtgggggaaaaatctttttaagacatttgcccgcaaataagaaggaaaaatcatagtaactttaaggttaaatatgagcaaagtaattattttgtattttctatcatttcattttatcataaatttaaaataaaatatcatctattatattttagataggtaaaatatctaaaaatgaataaggaactagttttaaatatgcggtgatatctaaaaagaaaaagaaagggataattgatgagataaatacctacaggtattggacaaatggtatagcaataaagaatatctgtgtgacacttagtttacagtgcagtttcacactcattattttactatgtccttaccagaacactctagatgagttcttattatcatcttattctatagttgaaggttctgagcctcagataaattgtcatgtgcctagaaattggcagggctaaacatcaaactcacatctcctgactccaagtcaggaaccttaatacgagttcaggagaccaagggcaagggtgaacttcagagaagaggattgactttctttcctaaaatggaaagaagaaactaaggatatttgagacatttcgaggtagaaatgagtagaaaatcaggtgagctctttttgatctcaaggaaagtggaggcaagagattattttcagagaagatagaatttatatggagcttgataacaggtgaaaattttggattaatcacagcttcttcaacaagcatttgaatgagcatttgatgttctctatggagcaacttttaaatttcacaagaataacattttgaagtactagtgtaccaaggaaattatctttactggactttaagcatcatatctaaagaaataaactttgcactcccctctccttgtttgtgactgacaagttagcaaagcaatatgccaaatgttgctatttcatggttatttctttactcttctaaagtgtaatgtaaccttcattgactattaccaattaatttttttaataaaaaactgtcaaaagtagagtattaatttccttcttaggatgtttgtgggtttcttgaataagtacttgaggtgacattaacatggatatttttaggtgtttcacattggttcttgccaaactctatatagcaaaaaaaaaagtgcctgtaagatgagttttgagaggtactcatattttccattgacagcattagaattttagatatgccccctagggaaagtacttatttgaagcaaaacttacagctttaaaaaataatgtcttaggttcttgactagaaacaaaatgactctagctgattaaaagccaggagaaaggcatcctgtctatcacgatggtgggggtgagaaactctcaagtccccttcttgtaagcatgagagactgtttatttatttatttcactgtcaaatgcaaactgatgactagactttaactttaatatgcccagttttgacattcacaactagactggcctgtaagctactagagagctatgtattattattattctttttctatgccccagagcccagcattgtgcttgacaacacacaaagtaattggctaatatatatttgctgaatatatgccagccaggatcttagaaaaaaattctcaagaggagacaggttgtcctatttcctcaaatttatcacaattctctacatttgggacacacatgaccactttacaaattacacaggaaatttaattgaaactgaaattctgtaactccaattaggagaggtggacatttacagatggagagactgaaggaaaactttttctgagctaccaggttttcttttccactcaagttctttttatgtattgctggcatctgtgaaagagcaagagatgccatatattgcagctgggtacccaggtggtctactgatattcaaaggggactggtttggcatgaattctagggcagcgtcacgcagctgtcatgagccactctgtggctagaagcagcagatgttactgatatctgaaaggcagtcacatcagacatgggagaagaccaatgtaaaatgcaaggtatctgacctacatatcatttaagaaatcacacacattttccattcagttttcaaatttacatccacatacaatttttttcacagttgagagtaattgataggcttaattatacaacgaggaaaacaaaaattccaataattctacttttgtcttaataatcacttaaatatactgaaaatactttcaaagcctccaggatgtattataccttaacattattaattattaaaagatgaaaaagtgttactgtatcatatattatttttgtttcctttcttcatgagttactgtttgaaacaatttgtgctcataaaaaagcaatgcttgtttataatgtgaaaacctaaccattaatttcttaagcagaaccatcttatattatgtaggatttctaatatctgacagatggccttacattttttatttcttgcctgttatattcatacattttatttacacagagaacggaagatttgccacaatacaatcagaaccatgtgttgtattgttgatctaaaggacaattgggattttctgaaatatcagcagccctaataagatgtggagtaatgacatgtaacaatttttctgattccagaaaacacaaaagccataaagtgtggtgatcaatcctaaaggtcagaaaactccaaggcaaagaaagttgtcgaaaggcaaaaagtgacagtagattgtacattaggaaatgttggcatgagtattttgggggtagcttcactgtgtttttgagctgctaggaatgggtttctggttttgagaggagtgggagatgagattaaaggctccatctgtgatcaataccacttcaccatacctctcacacacaccggttcatgcacattttgttcttaaacacatcctctccttcaactctacattcagtctatacacacctttgcattctttcactctactttttcctctccctttccgcacccccactctgcccccaccagctgctccctcaaaagtcagttgctaggcctttggaaaagcaaaagataaagtatgattgagaggcatcctttaaaaaaacctacttcaaggtcaatttgctaattcctttagaaaatgagtaagtatgaaaaggatcattttgaatttggggctttcaggaacttcattactaaattaagacagaaagtacttgataagggaaaatacttgataattggacattttagaagcaaactgacattggtgggataaatacatgggatggattcaactcagcattgtctacgtttaatgccaactttaacatctccaaattaccctaataaggctatgacctgaaaaattctcctaaaggagaacaaaagtgctcttccattttttctcgttttaaaacatctgtgagctttctaaacgagaggaattcccatatttgagggggaaaaacacatttattgcctcataataagttttatagtctcagctcctttattctttctcttgttcatagaatcatatttttattatattcttttaatacaactaaagtaaaataagcttgcctaagtaggaaaagttttatttaaatttcggagggttatatcattcccatctaaaaatatgatctctacaagtggtttgtgtaccctaggtaaaaagactaatctaaatcataaatatatggccaaaaacacaaagccatcatcaacctcattccctcttcttctgcatgtgagttttctaaggactctccagattaaatgacttgttccaaattctacaatcagtttgtgtctatttcaagaacagaatgcagctttccaattttaaatgtgatgctttttttattttccatgcaaaatattttgtttaaaaaaaacattaaattatcaagtattggaaagaatcctcaggtgtgctgaatctccctctggcttctggcaggtgaccacttaaaggctacaataacttgatgtagaaaaatcttcatcttgagatgttatcattacctcagacttcaactctagccaccactcccaagtaacataaatctagattacactgtgaagttaaaaataggtcaagagtcaaccaaacaactaagaaggcattctctcaatcaaaatgacaatgaagaaaaagtggcaagtttcatatcaagaatgaggagaaaaatgcctactgtaacctttatgtctgttccatttgaatgactttcatgccttttgtgtttgtgcatgccagtttatcaaggatcatagtgccttcagcatctcaatgaaggcctttttagactttgtttcaattctaagaattacgggatttgtcatcaggctacttgaatatatggaaagtggagagttgatatactgatagggatttttttttattatttttgaagcaaacaggaatatggaacaaaatattttgaaaattaagtcaccagtatcttcaagttttccctttaccaaaattgagaaaataacagctgtttttcctgattccattacatggtagatacattttgtgtgccttgtgtaatttttctcatttttctttatcaatattaatagatcaatgatcaattattattgagcactgatatgagctaaactttttttagactttgcaaacactgagagaatggtatctttaatttctgatttttttactatatataaattatacttcgagatcgcaccactgcactccagcctgggcgacagagcgagactccgtctcaaaaaaaaaaaaaaaaattatacttcagtttcataatgtagaaacgtgatgctttttcttaaagagataacatgagtggggctataaggctaatatatacaaaatacacacacacatacacacatctatatgtgtgtgtgtgtatatacacacaagcacatacacacagcctcacatccacatacatatacatgaacatttatctagatgacaaactatagaattgagaactcaatggggtgatatagaggtaggtagatagtaagttctataaatcagtgaaaatttgagatcaatgaaacctatcatagtcaaaaactgtttacaggaagaaaacaaatgtgggctgtgcctgatagggaggacataataggtaagggaaagtacgtatattcttttatttttatgtttatttgtaattaacacataataactgtgtatatttgtaagatacattgtgttgttagatctgtgtatacattatagagacaatcaagtcaattaacatatccatcacctccccaacttatttttatatgtgtgatgagatgttaaaattatactatttaagcaattttgaaatacaaaatacatcatcattaactgtggtcaccctgcagtgcaatagatcactaaaacttattcttccagtctaactgaagttttttgtcctttgaccaacatcttctctttccccatctctccccgattccctgtaatctactttctctttctatgagattgactcttctagattcctcatgtaagtgaatttataaaatattaatctttctgtgcctggcttatttcacttagcataatgtgctccagttccatccatattatcacaaataacataattcccttccttttttcagctgtgtaacatgccattgtgcatatatatatatgtgtgtatatatgtatctgtatacatatagctacacacacacacacacacacacacacacacatatatatgtatctcacattttctttatccatccagccattgatggcaggtgctttggttgcatctgtatcttggctattctgagtaatgctgaaatccacatgagaatgcagatatctccttcatatatgaatttcaattcctttgaatatatacccagaagtgggattgctggatcatatcgtaattccagttttagcttattgaggaaccatcaaactatctcccaaaatagctgtacaaatatacatttccaccaacagtgtacaagggttcccttttctccacatcctcatgtggagagtgaggattcggagaataactgtgaaatataacacttattatcattcatcttttttataatagccattctaatagatgtgaggtgatatctcatgtggttttaatttccatgtctttaatgattagtgatgtttcacattttttcatagatgttagtgattcatatctttttttgagaattatctgttcagatcacttgcctattttgaaattgggttattaatatttttgctgttaagttgtttgaattccttgtttttgatactagctctttatcagacatatggtttgcatatattttctcccagtccatgagttgtctcctcactctgttgtttcctttgttatgcaagagctttttagtttgacacaatttaatttgtctctttttgcttttgttgcctatacttttggagtcctagccaagatatcattgcccagactaatatcatggagttttttccccatgttttatttgagtaactttacagtttcaagtcttatatttaagtctatattttatccaatttgagttgatgtttgtatatggtgtgaaatagtacagttttattcttttgcatgtggatatcaagttttcccaatgtcacatattaaagacattctctttccctcattatgtgttcttgccacctctgttgaaaatcaatttataaatacttaggtttatttctgggcttttgattctgttttactggtctatgtgtttgtttttatgccagtcccatgcttttttgatttataatagctttatagtgtattttgaaatcaggaaatgtgatgctcaagctttgctctttttgttcaaaatttctttgggtattcagagtcttttctgcttccatatgaacttaaggattattttttatatttctgtgaaaataacattgcaattttgataggttttgcatggaatctgtagattactttaggtaatatgaacattctaccaatattacctgaccatgggatatatttttatttatctatgtcttcaattttttagtcaatgttttataattttcaataaacacatctttcacctccttggctaaatttactcctaagtattttttatgttattgtaaatgggattgttattttccatttctttttaagatagctcattattaatgtgtagaaatacaagtgatttttgtattttgattttgtgacctacaaatttgtttatcagttctaacagtttttttggtggagcttttagggttttctgcatataagatcgtgtcatcagcaaacagagataatttcacttcttcttttcatatatgatgtctttagcttattcttgcctaaatgctctggctaggatttcaagtgctatgttgaatataagtggcaagattgggcattcttgttgctgaccttacaggacaagctttcagcatttcactgttgagtctgatattagctgtggccttatcatacatggcttttattgtattggggtacatttattctatacctagttttttgagagttttaaacataaagcgatattgaatttgtcaaatttttctgcttctactcagatgatcatgtgctttgggttcttcattttgttagacatgccttacaagaagtactaaaaggagttattcaacctaaaggaaaagatacccctaagtagaaacaaaaatatataaaaatatggtcagagtggatgcaggtgtgagagggtccagcagaaggaaacatggctgccagcatgtttgagtctattaacaagtttggcctggccttatagctgttgtaggaggcatggtgaactctgccttatacagtgtgcatgctggacacagagctgccatctttgactgattctgtggcatacaggacattgtggtacaggaagggactcactttctcatgccatgggtacagaaaccaattttctttaactgatgttcttgaccatgtaatgtgccagtcatcactggtagcaaagacttacagaatgtcaacatcatactttgtatcctcttctggcctgttgctagccagtttgcgcacatcttcaccagcatcggagaggactacaatgactctgtgctgccatccatcactaccaagaccctcaagtcagtggtggctcactttgatgcaggagaactgatcacccaaagagagctggtctccaggcaggtgagtgatgaccttacaggtcatctttgggctcatccacccacctttgggcaagcagccacctttggatggcatgtccttgacacatctgacctttgagaaggagttcacagaagcggtggaagccaaacaattggctcagcaggaagcagagagggccagatttgtggtggaaaaggctgagcatcagaagaaggcagccatcatctttgccgacggcaactccaagacagcagagctgatccccaactcactggccatggcggggacagtctgattgagctgtgtaagttggaagcagcgagacattgcattccagctctcatactctgggaacgtcacctacctgcctgtggggcagtccatgctcctccagctgccccagtgagggcccaccctgccttcacctctgagggccaactaggccacagcccagtgattcttaacaatgcttccttttgcccccaccccagattggatgatttccaaatgacctgttttctagttcatcaatccttcttctgcttgttctacttggctgttgaaaccctcttttgaattgttattattatattcttcagctcaataattcctgtttggtgttttctaatatttcctatctccgttttaacgttcagtttgctcatgtgttgcactccacacctcagtgagcatctttattactgttcttttgaactgcctataaagtaaattctatgtctccatttcatcaaggttggcttctagagatttatcttatcttttatttgaaatgtattttcctatttcttcattttccttgactctgtgggattcagtaccttagataaaagaaccacctctcccagtcttgctagactggtcttgcgttggagatattcctcccaattagtatagccggagattctaggtgcctcaaaacactttgtttgtccaacctgctttgcttttattggtccctgtattagtccgttctcacactgctagtaaagacatacccaagactgggtaatttataaaggaaagagatttaattgactcacagttccacatgactggggaggcctcacaatcatggtggaaggcaaaggaggaggaaagtgacatcttacatggaggcaggaaagagcgcttgtgtaggataatgcccctttataaaacatcggatctcatgagacttactatcacaagaacagcagcatgggggtaaccacccccatgattcaagtacctcccaccagattcctcccacaacatgtgggaatcatgagagctacaattcacgatgagatttgggtggagacagagccaaaccatattgttccacctctggcccctcccaaatgtgagcccctcatgtcctcacatttcaaaaccaatcatgccttcccaacagtcccccaaagtcttaactcatttcagcattaactcaaaagtccacagtccaaagtctcatctgagacaagccatgtcctttctgcctataagcctgtataatcaaaagcaagttaggtacttcctaaatacaatgggggtacagtcattcagaaaatacggctgttccaaataggagaaattggcccaaatgaagaggcctacaggcttcatgcaagtctgagatccagtggggcagtgaaatcttaaagctcccaaatgattccgttgactccatatctcacatccaggtcttgctgatgcaagaggtgggtttccatggtcttgcgcagctccaccattgtgattttgcaaggtacagggtacagctccactccttactgctttcacaggctggcacggagtgcctttggcttttccaggacatggtgcaagctgttggtggatctaccattctagggtctggaggacggtggccctcttctcacagatccactggacaatgcccaggggggactctgtgtgggggcttgcaccccacatttcccttccacactgctctagcaagaggttctccctgagggctgcacccctgtagcatacctctatctggacattcaggcattttcacacatcctctgaaacctaggcagaggttcccaaacctcaattctggacttctttgcacccacaagcccaacaccatgtgtaagccaccaaagtttggggcttgcaccctctaaagcaacagtctgagctctacatttgccccttttagccatggctgggatgcagagcaccaagtcccaagactgcataaagcaataaggccctgggctggcctatgaaaaatttttttgtcctaagtctccaggcttgtgatggtaccaatttactatattagtccattctcacactgctgataaagaaatacccgagactaggtgatttataaaggaaacgggtttaattgacttacagttccacatggctggggaggcctcacaaaatggcagaaggcaaaggaggagcaaaagcacatcttacaaagcagcaggcaagacagcttgtgtaggggaactcccctttataaaaccatcagatctcatgagacttactcactttcaagagaacagcacaggaaagacccacccccatgattcaattacctcccactgggttcctcccacaacacatgggaatcatgggagctgcaattcaaaatgtgatttgggtagggacacagccaaagcatatcaatccccaagaaattagtgattgccaagtcatgctattgccttgagagagttggaatagcacccagtctcttgggattcagctagagaggctacagtgttagaggtgtgttccagtttcttattttcttgcagagaagctgagagccaaagtttgtcccacttattctgtccttcaccaaggagacagcctgaagcagctgcctctgctcataatcagaatgctcactttgagtctagtgagagagatgctgaatatttccaagtttaaaagtcttttcttgttccctgtggtctaggagactcaggagtgcagagctctgtcaactcccatagctaggtgatttaagagccattctcttgggtaaaggctataaaagttggggcactcaatgcatgcacaagctactcccagtgagagtctgcatatctagatttactgccggggcaagtcagggaaaaatatgcagggagagcccactctcccattcaaacaagtggaagtctcacaccctcctagcaggggaagaatgtagtccagaattatcactgaaacaaagcagggaagaaggtgcagggaatgcctacttttccattcaggaatgaagaggtcctccagtctctctttaatgagagattgcagaaatttatctcaaaagcaagccaaggaaggaagcaaggggcatgcccactctcctgttaaggcaagccgaacttttacatctctcttgccggggtagactgagattacaggaatttatcttaggagcaagccagagaagaatgtacatacaggacatgccttcctttctgtttaagctggaggcggcttattctttattggctatgtaggttcccagatactggcttgttaaaaggccagaaccacaggaagctgataggaaagcctgagaccaaatttgggggaatttagaagctgggccaatcctcagtgctatagctgctaggagggctcatgttgtgtccagaattggtggattcttggtctcactgacttcaaaaatgaagctgcggacccttgcagtgagtgttacagttcttaaagatggtgtgtctggagtttattccttctgatgttcggacgtgtctagagtttcctccttctggtgcgttcatggtctcactggcttcaggagtgaagctgcaaccttcacagtgagtgttacagctcttaaaggtggcgcgtctggagttgtttgctctttccgtccagagctgttcgtccctcccggtgggttcgtggtctcgcgggcttcaggagtgaagctacagaccttctcggtgagcgttacagctcataaaggcagcccggacccaaagagtgagcagcagcaagatctatcgtgaagagcaaaagaacaaaccttccacagcgtggaaagggacctgagtaggttgccgcggctggcttgggtggccttttattcccttatctggccccacccacatcctactgattggtccattttacagagagctgatttgtccgtttcacagagagctgattgggctgttttcacagagtgctgattggtgcatttacaatactttagctagacacaaaatttctccaagtccccaccagattagctagacacagagcactgattggtgcgtttacaaaacctttagctagacacagagtgctgattggtgtgtttacaaaacctctagctagacacagagtgctgattggtgcatttacaatcctttagctagacagaaaagttctccaggtccccaccctacccagaagcccagctggcttcacctctcaatggcactcgctgggggactttgcggcacctagcctgggcactctggcagcccagagagagcttgtcccccagtcaagcccagcaggtgctggccggccacgctgggtgcggggcccaccgaacccatgcccacccagaacccggccggcccacgggtgctgcgtgcagccccagctcctgcccgcacctctccctccacacctcctggccagaccagggagctggctcccgccttggccagccccagagaggggcccccacagcacagcggcctgctgaagggcgccttgagctcagcaagagcggacgctgaggccgaggccgaggaggtgccgagagcaagcgaggactgctagcacgttgtcacctctcgatgtgattcaaacctttttgttttttccttttatgtttgagataaatcttctgatgccctctccctgtggttcatcaagcatggtgattgaagagccgagccctctgtaaagactgcaaaagttggcactttatgtgtcgtacaagcaagccccttacccctcaggaagaagctggtagttgagatttttcctctcaattgtaaggctctgtgctctgggtggagctagtgtatgagtgtatttctgctttcaatatccattttgatgtgagtatttctcagtagtctggcatgtacgggtctttcatctggattttggctttctcttggagagaactgactcatgtttaggtgtatactagatgtgtctgtgggatgagaggtagcccagagcctgctctttcaccatgttgctgacataccctcatatattatttcataattttaatttcccaaattgtatcaagttattaaattcctctctatttcactgccatcaccttgggcaaagtcattatcatctctgttctagattgttgcaataactcctcaataaatcactcatttactcaattccaattcattgccaaataaaagctaagtatctttatgtgaattagtttgccttaatcctcataacaatattattttaccaggtttgctgggctagattcttctagtttcattttattatctgagacccaaatcacagaaaaatgacataactgaggtcacccagctagtaagttgcagagctaggatataatatcaggagctatagcctctactcataatcattgtactatatggtctccattattatttgttttcaataagactatattaaaggatgacttcgtgccagaggtagtatgtttatgggttaggggaaagataaagattaatataaaaacaagcagctgcatgaatttggtacaacagctgtaaaattagaaacaatagtagcactggaactgacattgcaaagtggagcttatgaagtttatgaactttaattaaaatgtcactgatgtgggtgccaaaaatcatgaaaaggataaagtatgttcgttaattgtctcctagcaggggaaatagagtagataatcaaatgagcaatgggcattttacattttgattaagaaccttctccatcataagacatttataaaaatatctgagaacaaagacaagctttaattccctgtggataataggatagtttatattgtatacatggtcaaatttacttgaaagagataaaatataaaatattaatctgttgaaagcctagaaaataacaatctgatatactcagtgatacaaagtaattcagatatcacttgttcatgtgaatgagacatcatgttttattcagcttatacagtttgttcagacattgtaaaataatttcagggaataaaatgcggtattctaattagaagctaatagactattattttagactccacacagtgtacataactcctggacattgatgttgtaattttaaagaaacacaacatttttaagacctgaataaaattctttttaaaaagcaagaatcagcgagtaatctatagatgttgatttccctgagaaattatggcaataaaagttaaataatatccaagtatcattttacttcatcccatatcaagtgccaggcatagttccttgtttctttacacataaaatcttgttagagtcttggaagtagtcattattattcccactttccactgggaaagttaaggccttgaagacttaaataataattttcacaagtatacatagcatgtgacagagcctgtagaaaaattctgtttgcttatttcatagcccaagttcttaatgactgggtcataatgttccttctttcttttctcactgccttttaaaatgttgagggtacaataaaggaaattatcgaggtagtcattgtggactccactcaatttgagttctttctgctttaacatttatttttttcacattaccgtggagtctaaatatatgacatttatctggtcaatatttcataagttaaatgttttattcttgtattagcttagtattactatgagtagatattaacttagtattactatgagcctaattaatgcatagtgttatgcatttctaccttaatctttttatttttgtgcaaattttgaggagaggctttacctaggaaatgcaatatcagcatttatctacacattctgtgagcacagatggctgatgggagaagcactcacattatttcaagagtcagtagcctatggcatacaggcaaaacatgagccagtatccattgagttatggaacagttgccaccacttctttgtatctatcctcaatatatttaagaaatgcctttatctgtgagaatcaaagtcagacaggttttccttgtcttacaaatatcaatgcttgcagcattatacctgtatatgtacataaaaatgtcattacatgtcaggagaataacataaaatctgaactttcgtatatccttatctttgccaattaagatggaaaggagtgagaccattggaaccctactttaaaagatttcaaaccagatttcatttcctgttctgtgtgcacgttcaggatgtaggggaaaacaaaacaatatcttttccctgcctgtcacaaggtttatgaccaacactcttatgaaaaagacagacagattcacaaaaggaaatcatgacaaatttatttaacccaagttttatgtcaaatgagagccttcagaaatgaagacctaaagatccaagaattttcatccttaagcatttgtttcataactcaatgacacttttatccttaggatccaagaagaatggacagtcatatagaagtatgattggacaaaaattaagtgtgatctaatggaattaaaggaggcagggcacttagcaaggtctgtttgttcagattcttcttggcctgcaaatatagggcagaacccctgtgaaactagagtcttatgatcttcttttaggaaaagtaagtcagagaatttctttatggctatacttcagggtagaaaggtgggagaaggtcagaatggcctcctggctacggcagttttttcagttgccaacttgacatattttggagtattatgttcagagccctgatattggcagagaaccaataaacccacaacctatgggaggaccaagaagcaacagagtggaaataaagagccctgtgcatctaactcacacaaccatagtgctaatccatatttatagaaaggcaaatggagagtcatgaggacaactgtcagtcagtagtttatattaaacagggcttagtctgaatttagtggagtacagatttaaaatgacttttttccccccaattattgcttttatgctctgaagaatactcattttcagtccttaatgttatttagcactgattttatagctttgtaatcacttctcgttattgaaaattctttttattttatttatttatttatttatttatttatttttgcgatggagtctctctctgtcacccaggctggagtgcagtggcgcgaccttggctcaatgcaacctctgcctcccgggttcaagtgattctcctccctcagcctcccaagcagctgggattataggcacccaccaccatgtgcccagctaattttttatttttttatttttagtagagacgaggttttaccatgttggctaggctggtttcaaactcctgacctgagatgattggcccacctgggcctcccaaagtgctaggattacaggtgtgaggaaccatgcccagccattagagaaagctctaatgtccactgtaaagccttgatttttgtaggcacacatagctcacattctcttctctccctaggcccatgatgaaagaggagcttggaatgagagagggcaggggtttgtgggttgccttccccaatgggtagggtgaaatgggaaggctagaaaaacggcaggtcttttctgataagtttgatgatggcttgccgttgttggcttcatatggttccacttgctattggtggccttacccaggtgattatcttctatacatagttttactgttttcttaaaactgtgctcagcttcagcctttatttcttctcttttccaagggccttttggagaggaagatcttagtctctatttcacccaactgcctttctcaaagtgtgcctccttgctgatctgccatattgttagtcccatagctcattctttcttttctatgttccatgctctatagagcccagaaatgactgaggtcttgtccagatgctattaaagaccacttcctccaaggttcactgcatcactggacctatcaattctgctggaacaacctgtaaaataaaccccaaccatagcttcagaattcactagattgggagtggtctctcttttactagggtcatgtagctctctgaacacattcttctctgctctaaaggcagcaccaggataacgtgctaatttgctgtacaactgtccagctgggagagaaataccagtctctccattcagttagctcccttgtttgggtgaaggaggaaagaagctcttcatttatgagtattccataggaagggagggaaaagcctctttaccaaacaccttgcatttttcacaataaagagaagaccttaaattccgtctcatgtataacaagtcgtgtcatttcttctgaaattggagcacctttcctggtcacagaatgaatgttgagtactctactaaatcatgtctgagagagagagaggaatacaaataaacaagttacagattgtggtaagcaaagagggaactaaacagggttctcttagagaaaataactggggtggggctactttatttttattttatttttttaaagattctttttttttgttattatactttaagtctgggatacatgtgcagaatgtgtaggtttgttacataggtatacacctgccatggtggtttgctgcatccatcaacccgtcagcaattggagaagacctctctgatgaagtgatgtttcagctgagatgacaagtatggcaaagaggtagccaaggtgaagtgctgacagaattgtattccgggtacaggggaaggagatttgagaatttggtgtgtgaaaaggtatgtggtatgttattctagaatgtggcagaaggccagtatcaccagtgttttttgacagagagggagaataaggtatggtcttagaggccctgctaaaggattttgtttatattcacagtgcaatgagaaaccattcaaggatttaagcagggaagtaaaattaagtaattaaatttttaaaagaccactttgatttctcactacaaaacaaattgcagaaagcaacactgaaagcagcaagacaattaagagtctgttgaattgacagataagagatgctggtgattaggacaaggatggtggccgcggaaacagagagagggctcccacaaaattcatgtattgaagccttcaattactgcctcacatatggcctgtgaggagggaattgaagataaatgaggtcagaaaggtggggtcctaatttgataggactgatatccttataagaagagaaagaaataccagactgctctctccatgatgtaaggacacagcaaaaagatagtcatctacaagtcagcaagaacacccttatgaggaactgaccatgctggcaccttgatctttaacttcccagcctatagaactgtgagaaagagatttctgttgtttaagcctcccaggattttgttatggcagcgcaagcaaacgaaaacagatggctatatggagaattattttacagatagcactactaggatttaataatagattgcatatgcatacagatgatgaaagaaataagtcaatgatatgttctagttttatttagttatttattttactttacttgtgtatttattggtttgactatctgggtgaatgttggcaccatatactatcaattggaaaaaaaaaatagaaaaaaataagacctggctgacagaacaggggtgaatcaacaaaccaagtttgaacatttctgtttgtatgtttctgggacatacaagaggaggtatcaagtagatgtatggatacacaagtctggatcccagaaaagaggtctgggctgagatgtaaatttgagattgttggcatgcaggtcctatgtaaattaatagtaacaagtgagaccacccatgaaatgtataaagagagatgaaggccaacatttaaatataaatttaaagtaaaaatggataaacatataagaagaggaaaatcaggagactccaagaaaacagtcaacaagataataaatgcatcaagggatatttgttattttgaccagaggaattgtgaggagctacataaataaacagtattttttacagtaggtcaaaaacgaatgtaaattgaggaagggaaagaacatatatcactaaatacatatataatatcactaaattacataaatataatttatataaatatataatttatatataaatatatatgaaatatatataaattatatataatttatatatacatatataaattatatataaattatatataaattatatatacatatataaattatatattatatataaaattgtatatatttatatataaattgtatatataatttatatataaattgtatatataatttatatatacaatgtatatattaatttatatatacattgtatatataatttatatatacattgtatatacaatttatatatacattgtatatacaatttatatatacattgtatatacaatttatatataaattatattatttatatatagtatatataaatatatatactatatataaattatatatttatttatatattatattatttatatataaattatatattatttatatatacattatatataaattatatattatttatatatacattatatatacattatatattatttatatatacattatatattcattagaatcttaattgtctttctgctttcactgttgtttcctaagaacatgtatcgctaatatgctaaaattacataattcataattctaccgtaacaaaaatataaaatatatattacagatacaaatatattatatataaaatataaaatgtagataaaatatatattttatattatttaatggtaaaaggaaacagataggatatagatattaaacaattgattttttgtgtgttttataaatttttgaagctatttgaaagatagacgactttagaaggtattatgcaaagataggcataatctagtaatgagaaacgttaatatttcaggagaaaagcaagggaaatgactaaattagtgacatccttaagaaagatacaagggatataatggaggactgaaaaagaatattgatttatctgtgataggatagcgattaactgcctccattttaacaggaagaatgtaaaaatgtgcgtaatcacaagaaggttcatatatttcatgaagctaggaagatgaggaagttatcaatcaatgaaatactttttttttttttttttttgagacagagtctcactctcgcccaggctggagtgcagtggcgtgatctcagctcagtgcaacctccgcctcccgggttcacgccattctcctgcctcagcctccagagtagctgggactacaggcgcccgccaccatgcctggctaatttttttttttttttctatttttagtagagacagggtttcactgtgttagccaggatggtctcgatctcttgacctcgtgatccgcccacctcggcctcccaaagtgctgggattacaggcgtgagccaccgcgcccggcctgaaatacgttgattatttaagaatgagcttccctgtcttttaagggggaggaaggtttctattcttctcgtatattcatctgtatttcagtgtttgttggacctatttttctgctagcattacactgtttaaaaattataaaataaaaaaatagatttacatgaaatgcacaaaccattattgattattatgacttattatttatcatcttttatcttctgataaaaaaagtggttgtctcttactgctacccaagtccaatagcagctcttttctaagctaaatgttatctgaagggtcaggtgaaaagatagtttttttttctttctttctctcttttttttttttttttttgagatagagtttcgcttttgtcacccaggctggagtgcaatggcgcgtgatctcggctcactgcaacctctgcctcccgagttcaagcgattctcttgcctcagcctcctgagtagctgggactacaggcgtgtgtcaccacatccggctgatttttgtatttttagtagagacgggtttttgccatgttggtcaggctggtctcaaactcctgacctcacatgatctgcccacctcggcctcccaaagtggtgggattacaagtgtgagccaccgcacctggccagaaatggccagaaagatatttttctttcaaaaaaagtaactctacttaaatcagatgtatcaaatgaaaacaatgttagttacagtataaaaccatgttttccaaattttgtaaaacagcgactatgacttctatttattgtgacaagaaaacctgtagcatatatgttatatatatatataattgtatgtatagtattgtgtgtatgcacatatatagaaatagtataagctatgattatacaacataatttcatagaaatcagtattttatggctagtttgcataatacttagcctcaaatacacagtgaattctaggatactaagaaatatatggtatattttctaagaatttatagttttaaaggagtgataaggaagtgaataattgtaatcagtcctaaaagcatgcttaaaataaaaaaggtacacattactaaatctccccccagagctttctagaagaaatgatcttggtgaagatgagttttgaaggatatgtagaccttgagcacctataaaggtgccctaacacatcttaataataaatccaaaggcttaagatgcaaggtatatgaccagcttagaatgaatgatcgtttataattccagatggatggagagtaactgatttttctccaaatcaaatttagtttttgacaatggcatgtaacatgtacagattcattaatagcagatttgggtaccaaatctactaactagcaattaggttaactactagaaactagaaattaggtattctaataaagagacatacattaaatgtgtcttacctccataattccaatgctacaagtatttaaatatatcaagatcttccaaattcgcatcctttgccaaaagtaagtatagtgtaccagttctaaattttgcatcagatatttgcttgaaacatgtaaaatacgaagatttggcctaagcttcagttgcttcatctcatacaatattattgcattatttacaatgattgttccttttcccagatttggcaatgtggaggctccttggagattgttacttgctcccatgttggtcatgtttttcggaaggcaactccatacacttttcctggtggcactggtcatgtcatcaacaagaacaacaggagactggcagaagtttggatggatgaatttaaagatttcttctacatcatatccccaggtacacaattctgacatttttctttctctacaggagaaaataaaattgaaacatactgaatatgtgtttcattattgctgttattcttctagttaaaatattgtttattaccataatattgcagaaaacggcatatgagaaagttgtactatgaagtaaattttgatgtaaaataagaactgtatttcaaacacctaaatattatcttttttttttctcaacccaagtgttatgctggaaaattggagcaagccatacagagagatctatatttattattaactcgaattaagaatatttttaaaaatattttagtaggggaagattaaatgacttcatacagaaacaagatggaaaattatgcagatatttaaatttatatttctgaagaacatagtaaattatcaataaatatgtgtgaaaaataatatgagtaaaacgttttcatactttagttacagagaagtatatatattgaaatagaagtaaacataggctatcagtgggtggtaggattatgggtaattcttttccctatatttttatatattttctaatattcatacattacttattttaagaattgaaagtcattaaaaaggaaaaaaatgagaaaatcctattactgggtggtgggattattaatgattacattctgtataattttctagatttctgcaatagctacattacttaaaacaaaaaaagccaaaaactgaagcatttaaaaagggagaaaaataaggatacaaaaggactgtttttatataggccttatggtcattagtgtcattattgtcattattatgtaacccatcaggacaacaacaaaaatccaggcctacatcctctttctgtaatacaatctattagctggcttagaaaaggctatttgattttaattggcatgctctgatttttgaaggtatatttaagtgtcaatgaaaagagtcaaactctgtaaaacatttagagctttactctgaaccaaatttgagtgaacctggcccaaggcacagtctggagagttccagagaacatgtgcccaagatggttgggttataggttgatgttacacattttagagagacataagacacatcagtgaactcatatgagggatatattggtttggtcaagttattgtctaaatacctagactcaataggaaagagtgactgggttaagataggaggttgtggaaaccaaggttcttattatacagatgaagtatcattggtggccaccttagaggcaatagttggcaagtgtttcctattcaaacctttaaaaggtgctaaactctcagttaatcttctcaggtttgggagggactggaaggggaaaggtctagatgcagatttttcccctacaaaagatgtctttgcagggccatttcgaaatatggcaaagaaatatactttgggttccttctttatctgtcatatgtttttatgccagaatgagattggcaatgaagcggctacgttgtctggagtaaatactaggggtttgtcctctcatgccaagaaaatttaggacagggacacacacgaggagtttaggagtggaggttaaataggcagaagaaagaaaaaggaggacagccctctctctggtgagagagagggcttccgaaagggaaagaccaccagagtcggatgcgcgcgattttataggcaggcttgagggggctgatttactggggcccacagaatggttggatcaggtgcgccctttacatagagtgcgggaaggctggccaccccaccctaatcttattatgcaaatagactttccactccactggcgccatcttgtctgctccttactgtacatatggctgccaaagagaaaagggaagatggagtcgctgtttggaacatgattggcccagctgctagcatctatatctgcagttcaattttacaaactgctctttgttagaaaatgattttagggctgcttttcattaaaaaggaaaaccttactgaggactcctgtaccctcactgcctaagtaatttcatcttaactcctatatcagcgactaacccacattacacagggttaaataaacccatctaatgagattgtatggtcaatacggcatgataggaacttggacaagagaggaaaaggtccaagtttagtcctcataaggaaattcaaacttttttttttttttgagtcggagtctaactctgttgcccaggctggagtgcagtggcgtgatctcggctcactgcaaactctgcctcccggttcaagggattctcctgcctcagcctctccagtagctgggattacaggcacccgccaccatggccggctaatttttgtatttttactagaaacggagtttcaccatgttggccaggctggtctcgaactcctgacttccagtgatccgcctcagcctcgcggagtgctgtgattacaggcttgatccaccgcgcccgcaaaaacttttttatatataagtacctagaagagaaggagcagaaggagcagtatgaagtttcttattaagatccagcatcgctatataaagaatgggggcattgtatgtttaagtgtgtgattaggaaaaggactttttcacacgttttcaagcctcttctatgttaaaaagctattacgaggaacaccatttcatgcatagatgtatttccctttacagtagaaatctagtccatatgttcagagttgaattcagcaagagcatgtaatattcaaagcaaggcagtgacatttatataaccttttcattttcttttgatgatactttttgaattcaaatcattacttgtagaaatatataagttcaaatatgaataaaggagtaatggaggaaaaaagtgtgttatgtgtgattgcatgcaatgtacattcaggaatatgagtaattgagaataattgtaatcacatgtattatattcatccatgatgaatatttgtgaaaagtaatgtgctagtcttttgtataattttccactgaatgaaaaaggcagataaatgatggaaccatttctcaaattataatgaaatgaataactttagaatgtaaagcatgggaaaaaatgcctgctatctggaactaatgactttatgttgcacaatagggactgtttgtatatcctggaaagtgcagtttttacattacaataaataatatttggggttattgttttataaaatggatttatttaaatgtagaaaagtagtttgggaggcagaacaaggacttttggggaatgtgttgaagatatctaagaacttcctaaagggcgtttatgtttacgtgtgtctcagagacagtcagtgcagctaagcaatgtagaatccaccagcaatagtgtgggcagagggaggaaaccccaaacctgaaacacaaaacaatgaattgcttctccctgaaaaaggaagaatggacgcaggctagaaactagtactggatgtctaaaacaatttgagccctgggaagatttcagatcatccaaaaacagataaaacaggttgcattcaggaagtcagaaatctattatttttatgacaacaatttcagccattgttaatttaggctaaaacagcagtggtcattttaatttaaaatcaaaatcatacacttctttgctatcctctggaatttttgattttctgtttttcatcactttgggaatgggtgagtttgtaaagagagaatctggtgtgtgtgttcaggaaggaggggtgggagctacatgcattcacatccacagttagaactatatcctttactataatacacatgcacacacaaacacacacacacacacgcgtatttatgaaaaactctaaagagtttatgagtttatattgagcttctcagaacttccttaacatggtgaaataaataatacttgttctttctagaaactcctctatatatttgttaatttttccaatatgttttgtgagatttctactttttacatgtgggcttctactctgagattttattcttcacttaggcagtttctcaaacttcagtctttaagtgctgagcctttataacttgaattatgacaataacttacttactttcaatatactctataaaatatcacctgactactgtattggttggcttcaggaatgtttcagctctatctgtcttgaactgtctgggcattctttctctctttgtattccttgaagtttgataacatgggcaaaccatcatcacttcttaccatattgttttaatttttattacttgtctctatatccaaagtagttcagagacaactatttacagtgcctagcaactttcctgtcattttgtttaaaaaaattttgttgaataactggaagaatgaatgaatgaataatttttaaaagagagccacatttgtttctttctgctgaattatccatgggtgtctggtttataccagggagactcttcacaagaattgtggcaaataagcctttgtcccacctctctgatccagccctggataaggacccactgttaaaagagaggtgaagggtcttcctcataaatctcttttattattattattattattattttatactttgagttctgggatacatgtgcagaacatgcaggtttgttacataggtatacacgtgccatggtggtttgctgcacccattaacccgtcatctacgttaggcatttctcctaatgctatccctcccctaacccccaacccccaacaggccctggtgtgtgatgttcccctccctatgtccatgtgttctcattgttcacctcccactcatgagtgagaacatgcagtgtttggtgttctgttcctgcgttatatcattctgtaaccacacagcaggttctccttgcccactgcccagacatagctgatttatgaagacaggggaattgcaatagataaagactttaagtcacataaagctggctgtacaggagatcagagtttcattattactcaaatcagtctccctaaaaattcagggatcaaggtttttaaggataatttggtggggggggggtcaagaaatggggagtgctgattagtcagagatgaaatcatagggtattgaagtgggtttttcttgcagtcttctgttcctgggtgggatcacagaactggttgagccagattacccgtctgagtggtatcagctgttgcatcaaaatgtagggtctgcaaaatgtctgcagcaatgatcttaggttttacatcacaacagtgatataatccccaggagcattttggagaggttcagaatcttgtggcctctggctgcatgactcctaaaccataatttttcatcttgtggctaatttgttagtcctacaaaggcagactagtccctaggcaagaaggtggtttgtttcagaaagggctgttattttttttttttttagcgttacactaaattcactcccaaaattagtttggcctgcacccaggaatgaacaaggacagtttggaggttagaagcaagatggagttgggtaggtcagatccctttcactgttacaataaaggcagtttcaattcctctgagttttccataggaaaagaaaattcctttggtttacatatgtgcttagggttttatgatttcaccataatcataggtacacactgtaatataatcttaccctccagggctaatacaaaagtctaacaggcacaataaaagcagacaataaaattgtctaacagagcaacataatacaagagcccacaaaccaaaataaggttacttttatacattttggtatttatatttcttaagactcccaattaatttaaagttaaaaatgagatgtataaatagcttcatgtgtgaatacctttatctgagttttttcacaatatctactatatatcctaacagtcttggcctatgctcattagccgtttggtaatattgacaaagttggtagagtctatttatgtcttctaaatagatgtgtaaataaaaaatagacatactttgaaatagtgttcaagaatagatttttttttttcacatttgtttagtttgatttctggctgtcttcttaaggatgcaaatactatatagcatcaaatactatagcatcattgatttttaaagccctgtaggctgttaaagcctatggcagttttcacaagtaattgagctgtttcagcttgaaccaatctgattgtcctagcaaatcctttgaagtgaagttatgtaagcaaaaactgctcttcacagaataccacattataaaaagcaacattttcttttcctcttggtcacaggtaaaaagcttaagaactttaagatagactatagtcataatactttctgtatatttgatatgctggctgttttataaatagtggttttcttttgaggggaaggtagatctctagctgtagatcaacaggcatggtgattagaagcagcagtttttatataacacccaggttcttcttcctttacttgatggacactcttgttttgagcagaaacatattaaaattaaatttaaaggatcccaaaacataccttaaaaggtatttgtatgtgacttggaaaaatacattattttttctttggcaatattgtagtttgatctgtattccagttaaacacaaaccacacaattacagaagactccttgaacttactttgaaggttaactccctattcgttaaccttttaaaaatgcttaagaaaaatcaactcaccaaaggcagcctttgttagcagcatttttgcattgttattaaagtttaaagcctatattcatttccatctcttgaaatttctatctatgaaatactagtgtttttgacatgctgatattttgaaaaatacaatatttaataaccagctctttgaatgtggggcctaatttcttctgtaagtcatgaaaatgttccaggctgattttgcaaccacattttgtttccagcaaaatgtgcagtgtgaatatttttgtaataatctaggaatattagctattggttggattaacaggaattcatctgaaaatagtatagcacttctgaaaataaagtacatttgtacccatgagttttgaacttttattttttaatacatgctttttcagcagcagcagcagccatagtatcaatgagggattgtggtatgatgaggagaaaattctaaattattttaaagtgccatgttataataacacataatgcattatttgtgtgatgccctaaaatgctaaatattgaaaataaagaatgacagctatattcatcaactgcttttccttgctacaatcaattaaaacagttttggattctataattctttaaggcattaggtcaacatttattattggtccttttattggtattctatgggtttttatttgtatttttataataaggatactgccatgctctgtcttcagttgttaagtgcttattaagttcttgtttgttactatgtcaagtaggagggactatgaacacttttaaaatgttgtctttgccgttaaagtgtgaactatctacatgagcacatgtaattagtttaaatgaaaaataagattaaatgcttaatacatgggaaacacattttcaagaattaatatgattcttaggtgaactgcttacattttcctagattcctccttctcgcccacagtcttcaaatgaatctccaactcctttcttttccaccttctaattgctctcaaatccattcgtcttcatttccagattcaccttcatccagacaacctactgattatcctaatggggctctgtcctagtctgttttgtgttgctataacagaatatatgatgctgggtaatttataaagataaaaagtttgactcacaattctgcaggctgggaagtccaagatcaggcagcccatctggtgagggccttgtgccacttcaactcatggcagaaggtggaaggggaaatgggtatgtgcaaggagaccaaacatgagaagaaacaactcacttttgaagtaactaatccagtcttgtgagagcaagaactcactccatgagatggctttaatctattcatgagagatccactcccatgacccaaacacctcccactagggcatacctttcaacactgcaacattgggaattgaattcaacataaatttgggcaggaacaaacctcatccaaaccacagcagcctcccttctcaaagcttgcctactcctcttagagcgctgctggaggaccttcccaaaccaaattatcactggtctcttattttcctaacaaccttttaatgacttaacacaaagtcaaaagccatgaacatgccaaaaaggccctgtgagatccagtccttgcccaactttccagtcttttcttgtacactttcttcccaagaattccacatacctgccacgtggaactacattcattgggtctccaagcttaacatgctcccttttaccttgaaggttttctgtatgtctaaaaaagtatttgagtagttaatgaatactgccacctttgcttaaagtaccataatcatccacccctatcaattgggtttgatgtaattccccccagggactccagtggttcctgtaatttccctaatgtagcatttatgcatgtttcaagtatttcttacccccactaaatgatgtgaataaaaggactatatctgttttattgttttttgtttgattttgtctttagagcttactgagctcaaatctattatatttgtactattttataacctacgtcagaggcaaatgaaatatgtaagtcccaatcaccattaccatgtatccttcaaatctttttcttatgcatttacatacatatacagacacatattcatatatataaaaaaacagtattgttgtaactcctttacttctaccttaatattatgtcctgcagtgttttacatactatttgcttagaattattattccattttgtagagaaatagttttatattgcatggatatatcaaaacttatttaatcatgccaatattgataagcagttaggtaggtttcagttgtcccttactacaaaaaagttacagaaaccctcctgtaacaacttctttgtgaacccaagaggatatttctgagggatgtggaagcattaagaatgagagcactggaggcagactacctgggttaattcaaatcctgactctacttaatctctctttacctaatctctgcacttagtttgtttgctataaaatggggattataaaaatacggccttccacataaagttttttgagagttaaatgaaataagatatataaatcacttaagacaatgtctggcaagtatcaaacaattagctgttattattattcatatatattcatagaatattctaagaatatatattcatagaatattctatgaatatatatgaatgacaacacaaagtttacttaaatttattagatcaatggatatgtagatttatattttggtagatattgtcaaaaattcttaacttcttgaagtacttttttatcactctcaccaacaatgcttgagcacttactgtatactatcaacattctagattatcaatctttttgtttttgcatatatatgtgtatagacatatatgtacatatttatttatatttgtatagataattgcacagatatatcgggggtcctgccccgataatcacgtaggttcttttctattttcctaagcgtcgactggcttgagaaataaaaggacagagtacaaaagagagaaattttaaagctgggcgtccaggggagatatcacacataggtaggatccgtgatgccccacaagccacaaaaaccagcaagtttttattagggagtttcaaaaggggagggagtatacgaataggtgtgggtgacagacatcaagtacttaacagggtaatagaatatcacaaggcaagtggagacagggcgagatcacaggaccacaggaccaaagtgaaattaaaattgctaatgaagttttggcaccattgtcattgataacatcttatcaggacacagggttttgagatcaaccagtctgaccaaagtttattaggcgggaatttcctcttcctaataagcctgggagcgctatgggagactggagtttatttcacctctgcaatctcgaccataagagacaggtacgccctgggggggccagttcagagacctacccctaggtgcgcattctctttctcagggacgttccatgctgagaaaaggaattcagcgatatttctcccatttgattttgaaagaagagaaatatggctctgttctgccgggctcaccaggcggtcagagtttaaggttatctctcttattccctgaacaattgctgttatcctgttcttttttcagggtgcccacatttcatattgctcaaacacacatgctgtacaatttgtgtagttaacgcaattattacagggtcctgagacgatatacatccttctcggctgacaggattaagagattaaagcaaagacaggcataggaaatcacaagggtattgattggggaagtgataagtgtccatgaaatctttacaatttatgtttagagattgcagtaaagacaggcataagaaattacaaaagtattaatttggggaactaataaatgtccataaaatcttcgcaatccacattcttctgccatggcttcagccggtccctccgtttggggtccctgacttcccgcaacacagataatctgttttttttccccaattgctggtagcaatgaacatcttttgcaattttctaatgacattgggatttcttctgtaaagaaactagtcatcctttttattcgtatgctttgttcattttgccattgaatatttttgccttacttttatctattcatagatcttcatgtattctggtgataaattatttgtctgttatatacattgtcaaggattttctctgaggttattacatgtgtgtggtaatttgatcgatatacaaaaagatattttaaaagaatttaactgttgaagtaaagtctatcttagcctttatggcttttttggtttatacattgttaaaacaatctcccccaagtatagcacattttatgtgccccagaaatatttgttaaatgatttaggcttgagttgaacaaaattgatgttttgcttgtttgtttgatttttagtaaagtcagtggtctctccgggccataaccatgaacagaataccagaatcagatatctttccttatgaaaaggggctttgtttgtatacatggaacaaaaataaaattattagcttgacagttaaaattaaagttttaagtaaatctattaatgtgattatattacagtaattcttgaattgtatcttgaattgtattcatgaaatagaactaataagcagacggtataaatattatttgttgaatattacaaaaatattgaattgaagatgggtagaccattgcatcctcatcaactttgattagcatttcaacaattattttgaataattatgttctcaaaataattttatcataatgaaatctggatagtttccaactatttctaaagtgaatagaacttaagttctagcatatatgtacacatatgtgtatacatacacacacactatatatatatttatgcatatgtatatatatatatacacacacactagaacttaagttctattcactttagaaatagttggaaactatccagatttcatacatatacacactatatatatatatttatacatatatatacactagatatctatatacactatatttatatatgtatatatacacccagtagagatatatatatatatatatatacacacacacacaatatatatataaatacatatatttagatggagtctcactctgacgccaggctggagagcagtggtgtgatctcggctcactacaacctccacctcccgggttcaagcgattctcctgcctcagcctcccaagtagctgggactataggcatgcatcaccatgcccagctaatttttgtatttttagtagagatggagtttcaccatgttggccaggatgatgttgatttcctgacctggtgatctgcccaccttggcctcccaaagtgctgggattacaggtgtgagccatcatgcctggacctagtatatgttgattcacagaataagtactaccttctagggttcagataccatgatcatttatatatcttgcttctgattctccttcaaagaaaacatggatacctctagtctaatcatttttttttgtatatgcaaccaatacaatagtctgaaattttatattaataaattctaccccaattggattggatgggtccttattactttccattaccctaaacctgctgaattagtcaaggtaggaaattacaaaatttttcaaattggtacaaatgatcaagaacacttatgaaaaatgcatggatttttggtcagtagttggctgagtttttgtttgatgtaggagtactacgtctgaattaaatattattcaagtacatacggaggctttattataactcctttcatctttcaacctactcttcagagtacctcagttttactagttaaatctaaggtaactaaaattgaatagcttaaaattatatgagtaattacactaaatttcaattctaatttcttaacaaaattgaagagatcactctgacacttagtagcagtcatttatataatgttattggtgtaggtggttacacattgcagatttcttatctctcatactctcagctaagtcccccaaattagatactctggtggattgcatttgtttggatttatactcattgtcttagtctgattgtgttgctataaaggaatacctgatgatgagtaatttaaaaagaaaaaaggtttatttggctcacagctctgcaggctgtacaagaagcatggcatcagaatctgcctggcttctgataaggggctcaggctgcttccactcacggtggaaggtaaaggggagccagcatgttcagagatcttgtagggaaagaaaggaagcaagagtgagggagatgggaagtgccagtttccttttaacaactagctctcagggaaactaattgagtgagaactcagtcattactgcaaggatggcaccaagccattcatgagggacataccttccttcacttcccattaggcccctacttccaacattggggatcatatttcagtatgaggtttggagtgtcaaatatccaaactatagtactcatctttgcctggattccaatgttgaaacacactcttctttgcctaaattcctatgttatactcattttttggctattttaaatataatttgagttcacatctggaatgacccagctacatatactcttaggaaagtgatgcaagaatggcttaaagaattaagaaacccagtcttttctctaccaaataataatataagatggataaatttctcagatatgctaaattgtccctttaaaatagtcacttataaaaacaaaacaaacaaacaaacataccacaaacttttttacaggacattaaactctcaatgacagattatctcaggaccctaataatttacattcccttggtagccgttcttcctcaggatattaatacaaattatctagaaaataaaaattctatacttattagatatctttatcaactggaattatgagtttgagagcattgcagtaaatcttcaatagggaagaatgctagacaatggatccaagctgggatgaaaagttgcatcagggaggcagggctagggctttaaaaacagaaggggaaacaatttctgaaataagaagtttatttaacaaataagccttctgcctgattttatcagaagcactattaatgtggaattcttgatgcctaaaggctggtgcataactgccttgctatgaaatatctggtgtgaaaggtctacttaagacacatacacacacgtatacatgattcgttaacacatcctcagtgtggtaggtactaattgtatattaattgcctaaaaatgtttatgttttaattacaggaaacattcaccaaaattaaatgattgttatattttacaaattgatttaactggagtttcaaaataatgaaagacttattgttggttacttcagttcagcaagtgaattgtaaattacatataatatttgcacactgaattaagatatattctaagcactcagggacactgataaaatgtatcaaaccggatcacaaggtcaggagttccagaccagactgaccaacatggtcaaaccctatctccactaaaaatacaaaaattagctgggcgtggtggcacaagcctgtaatcccagctactcagaaggctgaggcagtagaatcgcttgaaccctggaggcaggagttgcagtgagctgagatcgcgccactgcactccagcctgggtgacagagtgagattcagtctcaaaaaaattaaaaaaaaatttaaaaatcaaacagttaaatgtttataatttatatcgttgaaaataagataaatgaagttagaatgatactattattattactgaaaggtgttgtgtcagaattgtcattagtaagtgagctgtattatgccattttaactttctaattgttttgttttataaactttgcacattcttagtgtaacatctgtcgttaacaaaaacagagcaatacatttgaaaattgtgatcaactaggaattttgtacaacttaaaaatttagaaaattctgtcattttagcatgatttaattatgttttcaacaaaaattttttattaaaattaaggaatatagattacaagttcctaagttttcaatttttcaaagtgaacacaaaatcaaatataactaaatataaaactagctgtctcagtccattttcttttgctgtaacacaatacccgagagtgggtaaattataaagaaatgaagtttatttagctcagggttatggagattatgggaagtccaaaagcatagtgttggcctctgttgagggccttcttgctgcatcatagcatggcagagggcaagggaatgctcgtcagctcaggtctcttttcttcttcttttgccccaagtcccagtgtgggggtcttaccctgatgactttatctaatcatagttacctcccaaaggcccccctccaatcagcatataaatttgtggattaattttccaacacatgaaatttgggtgacacatttaacacattcagcctttgcctatgttatataaacaacagtgaaaggaatggagctttgacttgaaaatacaggtgggccaggtgcggtggctgatgcctgtaatcccagcactttgggaggccaaggcaggcagatcacttgaggtcaggaattcaagagcagcctggccaacatggtgaaaccccgactctactaaaaatacaaaagttagctgggcgtggtggtatgcacctgtagtcccagctactcaggaggctgaggcaggagaatctcttgaacctgggaggcagaggttgcagtaagctgagactgtgccactgtactccagcgtgagtgacaaagcgagacatctcaaaaaaaaaaaaaaaagaagaatggtgtagggtttttactaaaaggagctcttatgaggaagagcttagacatttgtacagattgagaagataagaaaatagatacaattttaaattctagatcaataagctttccagaaaatgttgtatttggaattgatttttagtgaagtaagctacaaattgagtaatatctagaaatattcaaaggctagatgttaatcttttagcgatgttctagtgagaattgaataagaagctggatttgatttcttatccaaactttctaactctaaaattctaccatcatagaaacttatatatcaatgaataaaatcacattatattttttctaatagactatattaaaatggaaagaaaatggatttcgactcagcacgagaatcttctaataaaaagcttttcaaccatgggacaggaatctttgaaagaaggcagctatacatccctgtttccctgggactcctggtttatgcttgtttctggagataatgatatatagctcctccattcactcaccacagtgtcctgatttttgaacaataaattacatagtcattctacttataaggcattgagcacactgaccctggaggtaactctctctagaatggactaagtggactgtcaaggataacaatcattctgacattgaacaggacatagactcttattcatccagattcttgtcctaccaaaatctaaaaaaaaaaaaaattatataagtcatttaggcttttgcagactatcagtttgtagataactgctctacctcaataaatttcttgatacacaagacaaatgcctttctttaaaatactacccaaaaagaggtaattaattaaaaatacgctatctctttggagataaaattatatcactgagttttgaaatttttttggaaatgtatttgctctcattttcttattaatttgtgtgattgattatccctggctttatgataataagaagtcaagttctaaatggaatactaatatttctaagtttaaagtttgtgatacctcaaagtatctgcaaacatttctacaggaatttaaatattccaaaacgccttaaaaaacttaatgaatattacaatgcaatttagttcatgatataccattagaaagaaggaaggagtgatgaattagtaatttcacagattaaaccacaggatgtggtagcttaaagaaatttagaaattattagattagtctgggtgcagtggttcacgcctgtaatcccagcactttgggaggctgaggcaagtgcatcacctgaggtcaggagttcgagactaacctggccaacatagtaaaaccccatctctactaaaatacaaaaattagccaggcatggtggcatacgcctgtaatcccagctacttgggaagctgaggcaggagaattgcttgaacccaggaggcagaggttgaagtgagccaagattgcaccattccactccagcctggatgacagaatgaaactccatttcaaaaaaaaaaaaaaaatcgttagattaaaatatgatctgaaaaacagaaaacggccaagattagttgtttcagttattcatggaatcacccaatggttaaacatggttgtacatgcctctacattttgtctgtattttaagtatacacacgcgcgcgcacacacacgcacacacatatatatacaaatatatatacacacatatgtatacagagagcatatgataatcatccaatgaactggtaagtaaagactaattgaatattcattgtactggtaaagttcaaaatgaaggctaaatagagctatttcttttcaccacagtttttgtttacttaagtgcaagtgaggtacattaagaaaataaaaactcaacggaaaccacacataacccacgttaattgtttatatttaaacttatctgtgtaaagtatggggaaattaagaaaatagaataggaatctgagaagttaaaagtacataaaataaatgtatgcggacatttgaacaacaggagcttttgtttcacatttaaaagcatagggaaaatgaatactaatacataattcaaacaaatgagtatacaaattactgaacaattctatagtgaatgttactggaagaattggctagcattccttttgatcaatccttaatataggccaagtgtagtggcttacgcctgtaatcccagcattttgggaggccgaggtgggtggatcacttgaggtcatcagtaaaagaccagcctgggcaacgtggtgaaaccccatctctactaaacataaaaaattagctgggcatggtggtatgtgcctgtaatcccagctacttgggaagctgaggcaggagaatcgcttgaacccaggaggcagaagtcgcagtgagccgagatcacaccactgcactccagcctgggtgacaaagcaagactctgaaaaaaaaaaaaagaaaaatatttcttaataatgtgatcccattttaactgaaatgttgctttgatgatactttattctaaaaatatcagttaaattgagcattagttgaacaataagcattatatcgaactagaaatattactcttttcattcagtaacatattttgatttattttgtttgtagtagttattttttcatcatttttatatacagtaatttaaactttcacttcataaaaaatgtaatcttatttgacttcttagttatagcagacataaaagaaaaactagaaacactaagtgctgacatatatatacatatccctatatattatgtatattatgcatatatatatccctcatatatcatgagtcctaattttgagtaacttatgtaataacagactattatttctatggatactgtggatctgactcttaaaaaatggacatttttaagggtagctatttaccaagatgaggtttttctctgccaaatgattaagtgtacaatcagaacatatttatcctttaaagttaaagttaatggcttaccaatctagaatctgcacctttaacaatgaaaatataatttcttcattgtcaagggagaataaggaaacttggaagtcagtattaaagagcaaaagaaccacctcctaagacattacatttactaagttctattttcttccattatgctttcccatgtttagagtccttatgtattattaacatggaagtaaacagagaaagtaagcaattaattgatgggcttcttatcagccttctgagtataaattcagtagggatgttgcccagaaatgtttatttttgttaggggctacattgtgctcacagaagtctttttttccactgctgtcagtaaagtagtaaagggtggtggctgtgtgggaaaaatttccaatgcatgatgtacatgaacaatagcataaaagttgtgttttattgtagagtcactgatgtcctccatgactgaccttctccattctcacagtcccaggccttcttaatcatctttcagggatcactctagcctgccttacgcatggaccagaaaggctgaagaaggctctttcttttttctactttcagatgccatcttattctggtattgacagccagatctttctctgtataaacctaatcatccaaaatgctaattgacaatgaactttatcccaaatcagactcctagggacagtaacattgaaaagatcttcttttcaccttgtagtaacttttccaataagaattacttgatattcagattttttattttctctggtatttattggcctcattctggaaaatcctcaaatataggtgggaaaggcaatacacaggaaccatcttgggaaatgtgttagcaactggcatcacaagggtactttgctgagttgcccaggaaaatggaaagatgagaggggatacaaggatctgcagtaggcagttaagggaaagtagaacagggaggagtagaggtacaggaggaaaaaaagaccatggtgttgtaattcaggggtcagcctggctacatcatgatggacactaaaactagatgaactaagatttggaacaatagtagctgtctttcacaggtggagctttggtcatgtgactcatggtctttctttctcctatcctataatctttgtcaagtgatccctatattcccgtagctgctttcaatgaattgcattctaccatcttttaaaaatgcaatttatttgaatataaccaataactgctattccttttcatccctttgtctgtaaattaagactttaacagaaaaaaaatttaacttttttgatcaagcatgtattaatacagaaataaagtcataattcaatactagcaatgtaaccttgggcaaattacctaatatctttacactctagtttctacctctgcaaagtagggattttaatatttaccacagagaacatttgtgagtattaatgaaataaagtatgtaaagatattgaaactgtatctgagacacactaaagacttactgaattgtaaataatatattaaaaatatctggagaaaataaggaagcactggctaaggatcaaatatttgatatatgtgtgtatatcgtattatgtttaaaagccattatttaaaatgtcattaagtaacatatatgttacatttttgtgcataataaaatgacacattcatttatataagcatatatttctggatttctttaaggtgatgtttcttaacctggggcagggataacaaactgaaaatctgataaagtctgtgaaattattcctaggtatatacatatttgcccaacttgatttacacaaatttggcattcatggaagctttggttcccatttatggaattcacaggagtctaagaccaaaggcctaggattctaaaggcaagaaagtaacttggaaattttgagtttgagtttactttctaaaatatgtacttttttttttttttttttttttttttttttggtattctgggatactgacctaacctcacaggcattaaatattttcatttaaattggcagttgtaaaggattatttctaattccaacttcaccttctatattcttatgaaataactagcttctccaatccttttgaaatacaagaccattttctcccacttgatcatgctggtatgagtgggatgatttagcagcactcactaaagaggtgcatcttcctctgactctggccttttaaactgggacatggcactaggagcaagagccaaaagtagaaaagacaagaggcttgctcacagagactaaaaggacaattgaataaggatgtaactgtaaactacatatcagtggcagccttggtttgaaggcgtctgactcagagtgggaaacagcttttaagtgtgttaatatcattttgtttatatttgacttttagtcctttgtatttttaatccctgactctgtcttcaaaactagtggtagtcaggttgtgttgtttgtcttggttctagttttctcttactatataacaaattaccccaaaacttagtggcttaaaataacattttattatatggcaggattctgtgggtaaggagcttaggctggactcgactggatgatttctctcccgaagccattgactaaagtccctcagtggtattcagctggcaaatgggctgttctgcaggatccaagatggctttacttacatgtctggcattttgatgtgacggctggaagacttggctgacctagaatggtcaactgaaatgtttatctgtgacttctccagaatagtaatctcggggtactcagataactttaaaggaacctggcttcccctagagcaaatgtttcaaggggcctacacaggagcacaagaattcttttgagctcatctcagaaattctaaaatgactcagattcaaggagatggattataaacgccatgtttcaaaggaaggagtagcagctgagcataatgacttctgcctgtcatcctagatacttgagaggctgaggcaggaggattcccggagctcaggagcttgaggctacagtgagctgtaattgtgccattgcacctcactgcctagtgagatcctgtctttaaaaaataaaaaaggagaggagtagcaaagtatttgtgtccatctttaacctaccacagtttttccccctaaactttgagtaaagagggttgagttctcagtttattgcacattaacattttggtccctaaatagcttatttatttgtttgctttatcccccattatagacaactattgcattttgtttaatatgtatattttatttgaatgttttactgaaaaatgtgtattgtttggggttgatttattttggattagcatgaatggcattgagttatgtatcttactactcttctttttatcatacaactttacgtggttaaaattaattccttgtttctaagtgtgcatctttgtgttgcaaagtcctcagtagtgggaatccactgcattttaactattcacccttccagtgatagttacccagagtatctccaacttcctgttaccattagtttcaacaaataacatcaataattgtctgtgttcaggcactattctaggtaaaagcagcatacgtattcttatggacatatgtccataagaatggggaaggaggatttctttctatgagcaaaagttctgagtcatagaagtttgtcagacggttttgcagcatcccagcaagtattatctcccaggtgccaattaactttgtccatggtgtttattttattaaacaagattcattttaaaaaattttaaatacccatcctattttggatatataatacattcacatgattccaaagtaaaaacaatatagcaaggtcaacatttagaaatcttagtcccatcctatctctacctactccactcttttcccacaccttgtattcatttcttctctattgttccaatgagaattcctcgattttgttgaaattgatttttttttgtcttttggtttatgctcttgaattttttttagaacatatttttagggtttttaaattattttaacattttggttcttcgtctttttattattttattgtctttaatagtctcaattaagtcttgtttctaataattttaaaattacatgcaaagggtataattttgttttattattttttactagataaaatctcaactttgtccactggaggatattcagcaatacaacatgtgatgatttcgtatatttatattgtgatatatttaacttactaattttgagaagcttcttgtgaattagttggcaaatgctacctccacatcttttatgaagctttggtccatggggatagggtaggttgatttgcatgaggagtccatggttttcctgaaaagaaggaatcatttctctccaagtttcaggtttaaagtgttaaattagggtagctacaaggaaagtaggttgcagagaaaatagggagaaccagtgagccagtcttgcctctaaatcagaaaagtggaaatagaaagagtggtcctggtgcacagagcaaaagatgaggtcactgattataactgagagcctccaggaccagatgctcaccggcaggagtgtggttgcttggcaccagccagtgagtctatttataataggtggaaattcttctgcctcaccacagtggtctggagatggtcctgagaagctccagaagtagtatgtgtttttcagtgaagagacgcaaccttatttgtaagatgtctcaccctgttaataagtttgccttgttttcttttgtttgttcatgggagacccagccttcattcttccctgagctctgcatgcagtggcactgtttcactgtagctggaatctctatcatctcatctccatgaggccaaaccttggggcatcctagttccctgtgtgagtggctcagtgagaaagtaaaaaaaaaaaatgcttcatattagagagccggggccagtttgaacaggaacatccttatccctgaacctaaacctatgcctaaaaaatgatgaggccctcctcacaggagaggaaaataccacctgttttcatggtcatcccaaacagaaaactttgcttctgttctcaatgtgaaatgattattcaaagccatcttaagctctgttaccagaattctccaccacttccacattaaaggaactagatcgggttcctccagattaaggccctcaaatacactagaatatgttaaggtaaatgaggtgaggccttggaatggcatagatcttgctactactgctactggggtactacaatctcggaactgagttatatcatttgtacttgtactttttacttatattaatcatgtgtccccctaattataggtatttagatttttcttttaaccttttttctttttttaaattttaattattgtggatacataataattgtatactttgatggggtacgtgtgatgctttagtatagtcatataatgtatgtcacaaacaagagtaattgaggcatccatcacctcatgcattgtaactcatttttaaaactagatacttttatttaattatatataatcaagcatgtatttcattttttaattttactctttcaatatggtatataactagcttaggcatatagagatcagctgtgagggtaactcattcactaattctgggttctcacattagcaaaatgagcaccacttgggaacttattagacccacactccgagggcggggcccaggaagctgtgtttaataagcccaccaggtgattctacatgctctaaatttggagaaccactgtgctcatccccttgtattcagtatgtgttgtcatcatctgtgcttattagtcaggcacagtctaaggccccattccaggcccacagcatcagaatctgcattttaacaagatctctggtgattcttgtggacagttgagaaaaactagtctgataaaaattgcttgttctcatttttatctgctctggttggccctgtctggtgttgcccttctggcctctgtaataaatgcacaggtttttccaacattgaatcctttaattctaaaatcactgagcttcaaaatatgattactttatatagaaggggatttctgcaaaaaaaaaaaaaaaatacaagttaaatctgaatgtcagatcaacaataaataatattttaatgtatatatgtttcatgtgacatttgatacttggaacatagttgtacaaataaattattacttgttgatgtgaaatccaaatttaactgggaattctgtatttttatttgctacatctggaaattctacatatatatattaattatctcctaggagaaccagtaatttctgccaacatcaatatgaatatttgctaaaacagccctgtcttgttacataacaatttttccgttcctttggaaaaaaatggaatctgaaattctgatctctacttctaataagccagaatctatatccctttttatacttacaaaagataaaatcgagcttagccttattatcttaaataagaactgacctaagaatcaaaatagtctgctatctgaagctagtaagagggaaggacaaaaacaaaaatcatttttgagaagcattgtctaacacataaaaattagtatcaactaattctctgcagtaagttaaatttttcaggtgttgaggtcacattttacaactaagtcattttggttcgtccatcaggagttcctatggatgcaaatttgatactttctgctggattatttcttagaggtctgatatggttaggctttgtctccccaacccagatctcatcttgaattgaaatccctataatccccacaggtcaaggaagggaccaggtggaggtaattgaatcatggggcagtttcccccatgctgttctcactatcactatcccataatagtgagtgagatctcacgagatctgacggttttataaggggctcttcctccttcgttcctttgttcggcatttctccttcctgtcgccttgtgaaggtcgcctttgccttccaccatggttgaaagtttcctgaggtgtgcccagaatgctgaactgtgagtcaactaaacctccctcctttgcaaatacccagtctcaggtagttatttatagtagtatggaaacagactaatataaggtccctctggtcttggaggttaactggtaacacctgttctgacttattgtttttaagttaaaattgtctgctatgatccaagttggggatttgcaggttaacacaggtttggtgacagaggggaactaattcacttccctaaagaaacctcttgttggtcatccttgggcccaactctatgtagatatgaagtgcacttttatttggatggagtactctttaattttaataatacattctgaagcctgtcctgcttatctggtttccagaacttacataagtgaccttaatcaacaatatcacattactgcaatttaaactcttacacaggaatactactgatacatgctttgtattttctaccaaaagtcttacagaagacaatttaagggatacactgctaacaatgtactcctgtacatttaaagacaatcattggatcaaattagaataccagagagctgtaaatttgatattaccttggaagaatcttcctttctaaattagctttttaagttttcccttcaaattttatcaattgtcatacaagatataatttcatacattttgattttcactttatattttgttaacctcactctcctattttatacacttgtatttgttatatttttaaaaggagcatagtatatagcacttctgtttttttattataaaaacattgatatgataaaatgcagtttaaagaattacacgaaaatgaatatctttgtccccagcatgctgttttaaaaactaggtactgattgtaccttaaaagcaccttttctgcatcttaattgtatcatgttgatcatcctgctgctagggttaagtgctatcttgaagattgtaataaactttcttttgctttctttccttattgagtttatcacacatatgtttgcttgcttttgatcttttatataactggactttatattgcactgagatttattttttgctcaacattgtttttgatactcatccacactgattcattttcactggcatataatgttctatggtgttacggtatcataatttatttttccctgctgccaattatggatatttgcattgtctcaaactatatgttattgtaaatgatgctgctgtgatcattatttttcatgttttctggtgcatagctaccagagattctctggggcttggtactgaaagtgtgcggtccagggactagcaacatcagcatcacctggatcttgttaaaaaatgctccaccctacatctactgaatcaaaatctgtatttcaaccaatcattccacggcatatacctacaggtagaattgctgaacatgtttgatttcacaagataatgcccagtgtttttctaaagttgtgccaacattacaacccacaaagtcctccttgctccaacattttctcccacagtggcattctcaggctttaaaagtgtaatgtgaaaatgagaagatgatcttgttaaaaatgtttgtatcaattctgtctgtaaatgcaattgatgtgcttctgtgcagccatcttgttcatgacattaagcatcaattatttttcagaccatcaatatttcttcctcttaaaagactgctcacaatttcgttcatgttttatttgtattttatcttttccttattgaccttaaggtattctatatactttgtactactactttgttggcttatagatgttgaaagtgtttttacccagtttgtggtttgcaatttggttccttttttctttttgttgagatgaatctagctctgtcacccaggctagagtgcaatggcgcaatctcggctcactacaacctctgcctccctggttcaagagattctcctgcctccacctcccaagtagttgggactacaggtgcttgccacaatgccaggctaatttttgtattagtagagacagggtttcaccatattggtcaggctggtcttgaactcctgacctcaggtgatctacccgcctcggcctcccaaagtgctgggattacaggcgtaagccaccatgcccagcctgaaattttattctttatgatgttgttgattaaagttatttttaaaacatagtcaaatttatcagttttttacgtggttatcagtgttttgtgctttgcttttgccagttcggtttctctggacatctagttttacacattttggaaacagaagacatggtgaatttcttatactgcaacccacttcatatcccagcagctatagttgggatgtttgtcccctcaaacttcatcttgaaatttgatcccagtgttggaggtagagcctaatgggaggtgtttgggtcatgggggtgtatccctcatgaatggatgaaatgtccttcctaggggaggggtgtgagtgagttctcactctgttagttcctgagagagctggttgttaaaaaaaagccctggcaccacacctctgcctctttccttctttctctctctcctgtgatctctgtgcagaatggctccctttcaccttctgccatggttgaaaacagcctgaggccctcaccagaaatagattctggtgtaatgccttcctacagcccacagaaccatgagccaagtaaacctcttttctttgtaaattacctggcctcaggtatttctttataaaaatattaaatagactaagacatcagccaattagttcccagtagaagtactatacacacaaggaaataatagccaaatgggaaatatcaccttatggtagccaggcagatgatatgcacccatcctcaaagcaaggagacacaatctcatctaggaacccaggctagtaaattttaaaaatgcattttaaatacagagagaatgaccagcacatgttttctaaccacaagggagcagcaagtggtggaggggctaaagcctctattcctgattgtcgagtccaggaaatccattcgttagtataacaccctcaatgaatgtttgggaactgagaccagtcaaatttgcagtgccttcttccacagccagggaacgagagaaccacaaaggcaatgaaacaaatataagtgttctcatgttcctttacctgttggccaaagctaaatatggtaagacagacagatagtaatcaccttgctccctaatttatatacagctgatttctcttttctctcttaactgacgaggctgtgtggttaactaagagaagcttctctgattcccagcttgataatgctcctcccctgctccttctgattatccagggaccagtgatttggccattcagcacttgcttccagaaatctctgaaacagatcttaataggatattaacatttcactcagaccacgctacaccatggatcaaaaattcatagttctaaacccaagtttacagtgggttccattatgctgtctaatatagtgaacctgaaactgcaccagttcaaataacaaaatgaataatgttctaaatttaaacaacataacccttcctcacattaataagtttctactgactgttctaaaattccctttgatatcatgtaaattcaaaggaattgtagtacaacttaattttcattcacaatttatgatttccctagtctcagctggaagagtgataaggacaaaagatataggagtaaacttgaagtaattaatatgcctggacactgttttgtatgtttataaacattatgaggactttaaaacttacagctcattatacatattccctttataatatcccctttaaaatattgtgccatattattaaaatgctatgcaaaataaaaatttaatcaaggcagtggctatacatgagataaaagtaatacaagctttagagaagggggaaatatgtggcaacaagctgaaaagattatcgtctgaaataatctccactaaaaaaaatctattcagtaactacatttttttttaactgttcccctatgtctattaaaagcactcttcattgcaagtaacaagctgcctggtttggagtgtggtagaattatagctcactgcaacctccaactcctgagctcaagccatcttcccacctcagcctctccagtagctggcatcacaggtatatgccaccatgcccacacaattttttttttttaaaatgtagagactgggtctcgccatgttgctcaggctggtctcaaactcttagccacaagttctaccttagccttccaaagtgctaggatgacaggtgtgaggcactgtgcctgtcatgaaattttcatgaaaataaatttctggggagttagttcagaagaaggtaaagctatctaattttgacaaggtaatgttaatatactattttatgtagttttgatatgtgagtttattaataaccaggatacattacatgtgggcatctgtctcagagtagtgagtactaattttaaatgactttttaaacttttttttttcttcacaaccccatatatctagctcttggaataagctgatagccacttcttgctacagaaatagaaaactgtaaatgtgttatttgtgaaagacacaagagctctggaagcaaatgcccaaggcagtctttattaaggaataaattcatttgactggtttgaataatttgaatagcaatgtgctgtctccacgtgatctatttcaggctttaatgctgttgtactgggttgaataatttacagaaaacatttgaagctattagctctggcattcaaaataccatgcttctcatacatggatagcaatccagacacacttagcctctgtatctttatatacccttatgaccttgtcttttatctcaaaaaagtaaaaaggaaaaactggaggagaaaagaattgaggttgtccttgagtacatgtgttttataagagacagagagattgtgttttctacctctgctgagcctaaaaataacaaacataaatgctgaccttgaggccagaatgttcaaagcttggtttttacaagagttccctagttttgataaattcttgaatctcagtgagtctcctcagcaacatctgtaaaatgggaactgattctgccccttgctatcccacaaaaaaaaattgagtatctaaccaggtaagatgttaaaaagacatgatgggtggtctataaagccctcctgcatggtttaaaatgaaattaaaaaaataatattctttatgggacccatttgtctacacactgaatgctgaaaccacaagttgaggaacctctttataagacacctacctcttctagtttttcacccagcaacaaatctctccagaacatgaatctgtcttccggctatgtgagctggttgccctgtttacaaacttgccagtagctgtggccagtgcctcctctttcccagagaaatgttactgattgagcaaagttatgaaatgatatttaactcaatcctaaaggcaaatgctgaaaagccatcagttttcttatgtgataaaagcaaatgaatgaagaataagaaatctatcttctcatgtacatattttcactactttcagttatctgaatgttttgtcgtagaaacacaaaaaacccataggtgtatgcctcttggaagcttccctacacatcatatctccttttcctaatttttcctaagtagaattaatcacttcattctcagtgtttctggagaatgcttctgtagagttaccttggttttcaaatgtcacatggctttagaatgaccttttgatgagcctaccttccccccaattaaggaatgatttctaggagccccatctttttctttctgtattgccaggacctccttagccctgcacctgtgactcagtagagcctaaggacacctagaggttagaaaataaatacaagaattttcagtgattatcactgatattggagttatagttgtattcgaaactatatataaatgtatacatatatgtaaaaaatacataaatgtttttctaagtagagacatgttttataaaagaaatatgaattattaaaatagttaaatattttattgattatacaaagtgattctgtagccagagattctagtcctgcgttaaagaacatgtataactcttttatctagaaagctttattctttgaaagtaggaaactcaattacattattgggtttgaaataatgatgtttctcattcgccatttgttgaacaaaataattgatgaaagcaaaaacaaattgcacatcttcaattgtgtaaaacattttcaatgacttgtctttcccctattttatattaatttttaattcacttgaaatagcaatgaattctttatacctgtttataaaaatggtgaaaatgtttcaaaatatcagttgggcaatgactaatagcaattataaatgcacagctcttgctattgtaaagggagttggcagcttatccctcctcctagacaaattaaaatgatgactatttctccctgttaagagaaaatgtagtagttctactaaatctgcaagtggcagctcgtgcttcatttgagactaggcttttgtttttaacaaatgaaaataatccagtgtctttgcttggatactaatcgtggaagataatgtcaaactggcctatttctacaattgtcgtaacttgcaaagcttcacagacagctgagttcattatgttgaagttgtcaatcacacaggcagtcgtttatattccttttgaactctgttatgttacctcatggatgactttttttctcttctcttttatatgatgttaaaacattccattctatctcctttacaattgacattctagaaaatacccataagattttctttgccttaacagagaaatacaatactttgttcattcaactaatgttagagatatgattccttaggctaatctcaaacttttgaaatcccattttactattacattgagaatttctttctacctgccttattaaaaactataggatgcaatagcattcgacaccctgtaaattcattataaattcacatagcattcaccaagataactcatttatatctatgaaatcaatagacagcctttaaactaaactggaactgaaagtattatcaatactacagaaatttttaagctgtaaatatgatggagagagcaatgttgaatagctgatgtgggtttttagttctgatcatctaacctccactacatcaaaacagttttgtggggtccccatttcagacaaaggcagtaaccacttatttgcttgcatcagaaaacttgccatcattcttctcagttacaaactttctagcaatcactacagtttgttgtttctaacgccagaatattcctggactttgtgtatatctctccgttctcactacataggtttgggcaatcaacattgatacttggtttattataatacaccttgcatcctccaatcttctctccactccaattccttttccatgtaacagccagagtgattcattttccacctgtttccttaattcacacccagttgccctttgagataaatttcaggctgctgcttaactcttccagtgatattaaatttctcatttttggttcctagacagcatcatactcttaattctctgcagggacaaactgtgatccttctggcagaaaaactacattttcccactagtcttcttttaccctagctaacttatgctcagcataaaagtctcttcactcagaaaaactattatgagctcctacaagtattttcagaagacttcctatatgttctcttgtacattttcattctacaccctacttttcaactgcatcctaattgtttatttacttgtctttatttacttctatgtggtagcattaaagaagatttggggtataatattttcttcaactgttgaagaaaaaaaagacgagtcacgatttgacagcaaaaggcattattaatatacatttcatcataactcgaatttattgacaaatgagcagaactatctaattttcttccagctcaggactttcaactccttagccctatccaagtatctaaaataatgtcattattacaaaggcattgcagttcttttatattgttccaaatgtgttttctccccttttcagggggtggggaattttctgctttctggacaaataaaatccacttttctctcacaatcaagtttcctgttgtataggtgagttattacactgccaaaacaccaaggatattaaatacaatagactcctgggacccttctctgtaatggccctttgttgttcttctaggtagaggaaaaaacaacgtatatacattgaacattttttgttagaagttatatttatgcttcattaattataacgcgtaatattatagggattaatcaaaattatttatccaaaccctcattactaggattctcggttatgtaaatctgttataaacagcataacaatgaatatttttaaagtaaatgtttgcccattcttaacatgtaaattactagaagttaaactgctggaataagtaacaaatataaccaaaagaagcaagtttcctcttgatttggcaactttatctcttatatttccactaagtctaaatttatgtattttttttagtgtttacaccttaggtatttacttggtactttgttagaaatcttttaggaattcaaaggtgactaatatataaaaatgcatatacctattaggattagtgacaaatacagaataccaaaagactgaatccacgtgaattgtggattagagaaataatccagtgtcatccacatataaaatttcctagcacacctacaagtctagttgattaaataagctccttgctttgtttgggattaaaagaacagactgtgtggggcaatccaaatggttaatggtagagatattttaaataatcattgcagtttatgaagaccagagccacagactgtctggtcttttgaaagtggtcctagcctaacctactcagtgatcatcaggaataccacaggcctttcccaatccagagaattagaaaccatgcccatcagtgaggactactgcattcacgtcagagatattcttggcttccagctcattcatgagaccacaggggccaatttaaatttcaaatcatcaatagggctcatttcatttagaatctcctatgaagcatggaaagaaatgcaaagttactgtgttggcaaagcattttatttaaagtatggttatatttaaataatccttttataatttaattttgaattcagaaatcctggaaaatgtccattaagcaaataataaaaccacaggtcttttttactataattataaaattagtttcacaaaggtcaaatttattttcttagtaaaagccctttgtagtaatagtaattataacttggaatttgattgtggttgtttaaagttttaatgtcctaatgcttattaaggaaatctacagtgaaattactactagttaacttagcactctctctgcagtgggacttcttgactacaaggtccttttggtacacaactgggtaaaccactgagataagaatcctaatttgttcagaatattagacttttttctggttcaattttttgaataatatctaagcagaagttattataatcagagtaacttttcaaatataccatctccaattattaatataatttttaaattgttaaattatttctctataaaaaaatatacatgtatgcctgttaaaataggcctgatatggctggcagtttctggtaaagtgccaggccccacataacaggtattccaagttagaggcaaggtttaaattgaaatgcttagttaataatttgtaaaatggaatatagtgatgcaggctcatgttagttcaatatgaagagacattgtaataccacaccaagtaaacttaaaatgtggtcttactgattacagagtaatatatgttcactgtagaaacctttctaaaaagtacttatgaatgataattgctttattggtaaattatgatgaggaaggaacaggattaagtgaagcttttagctatatttcaaatattttattttttaaaaagacagaaaactctgaagctaatatgttaaaataattgactttgttacatctagatcatgggtatatagtttaatttctccatttttgaaatgttttaaaatttaaaataaaatattttaaaacccataagcataccacatagtgataattattaacattttagtgcttagcatttcagcttttgttgtatgaatatttaaatgtacattttgttataaatatggaattataattgttaaatatttttgagcaatgtattttacatttttccataggccatatacagtaaatattaattgcccaagtcaaaataaaaatataaacacaaatctaaatttaacattcttttgggaagaaagaattgcaattttatgcatacataaagaccaggtggtctttatgtctgaagaacaagagaaaattgggggtattataaaaaagaatgttgtcggtggttggagagaaagctcatttatattagtaaagctttggggaactggcaagcttaactggtgggtgatggcagcaagcaaaattagttcctagacttgcagcaagttatctcagtagttatagataaaactggtctcaggttataacaggcagtttcagcagccagacttgcagagaatttcttttctagagcaatgctgtgtgccctgagtaccttgtccccctggcctctagactctgatttagttgagtatgataaaaataatccaatttgcatgatcaactttcacataatatatttttaacagcacactattccattaggcattttagctagctttttaaaagtagaagctgagttaattcctgcaatattggtttaagtattaccaaagtgttctacagtgtttgtaccaaattaaatacagaataaccaatttaaaatcttagtcaactttataggtgaaaagtctttcattgttttttttccctacttttttttccaatatgtggagttgtttcattgccagcgttttgaatagaaacactttcattgaggaattatgttttaaggctacctaagatttgtttcaattagggatggccagataggcagacatggaaattactatcttgaaggaggagttttactgtactcacagattcctggaaacaggaggcatgacacaccatgcagggccacatgaggcagccccacggtcagtcaggaggcagagggaggtggtaaaatgtgggcaagagcccctattgtggtttccatgagaagaaatgagcaatgaccaggtttaggatcagctagtttgaataatttccgtaggcataaggatagttcctagttgtctggtaccagggcctgggaaatttaggtctggtggataatggcctggaatttgagagccctatagagaagggtagttaaggtgtgggctctgtcatggttgctttgcatttgaaaggcaggctccctcatgagttgtctactatatctaggaattgactaacaagggtctgcagggccttatacctcaaattatcagaacatagaaaatagaaaaacatggttaatgcaaattggttttaaatatgatatttctaaatcctgagcagaggtgcataatgcactttggagaaaagaaattagaccaaagacaatacggttgtaaaaattctttattaactcattaggcaaatgtttaccaagcatctactacatattaggcattcaatcatgggcaaaatcagatccgcatcctgctcttacactctgaatttcattttcaaatacattatactggtgtggatttctcatagtttctattaaaatatttcaaaaccaagagtaactaatatgcagttggtatatctatcattatcttctgtcttctacataggatggtttctccagactttcaggtttcccttagtcttaactgtaataatactgttgtatcattggttgtttctaatttggaggaactttggataagtaacaaatttttctttcagtgactcaaaaaaatagtgggtgtactttaggttagaattaaccctgtgatgtgctttagtacttgccaccctctgttaataagaactgtgttggccaaatgtgatatttgaagtatactcgttatttggaaggaaattgctggaattttaaaatgtagttcttatagagacatgtttgattggaaataattaaatgaacataaggaatagcatttgctgtgaagttttacaaagagttttaatattgaattgtgctcagttcacacacggaaatgggtgtctactttagtgacaatggatagtaaatgattaggtttttttcaattatttaaattctgatttccaaggaatcatttgaacagcttttagtagtaaaaaactttattttgataatcaattttggttcctgagctttctctctctgtatatgacagattttctcaaattgatggcttattttgcagtgagtggctggaaaggattttatgttcaaactgctagaggtttatcagcaggtgaaatatactgtcagttgcaatgcatgttttgtaaatatatattttatgttttctaccacagaggtattttgcaggtgtattaggtcatattacacaaactgatttttaaaaatgtctattctaattctgtcttcaaaatggtagaatggaaagaatcacaatgttgtatatggctttcaaataatagactctgacatttcctaagacagccaggcatagtattatttccattggctgtgcagatctctattgctccaactctctaacttggtcaaaatatgtttccctcattctttatgttctacttgcatcttccttaatcctcttttctcatccttcttcatttatttacttatttaccttttagagacaagatctcactatgttacgcagagggcctaggactcttgagctcaaatgatcatcccacttcagcctttcctgtagctgggaactacaggtgcatgccactgtgcctggccctcctcattgataaaacatacatatattctccaaatgcaatgcaggaaaattgtttggctcttaatgtcacttcacactgagttttcttgatgatgacttcaatttaataaaatgtttttttgattcatttctttattattccgtgtgttgcctgatataatatattgctgttgatggtaaaaaggaatttttctaagtctcttcttccttttcttccatagctgaagaaaaatcattataccatcatcctaaatttagattcagaactagtcccacattaaattcatatgacaaagtccatgggacaaaaataaatatgtaaatgtaattgagttattgcctaacctaaaaagattagtgtaaaaatacatagtatcctcccttggtaatgatctaatattgaacaactaatagtttaccaaatatccttaacacgtttataagattttatccttccaataatagttaagttaggcagtcacagatatctttgttctttgtgtgtatgagtgtgtgtgtgtgtgtgtgtgtgccagtgcgctgcgcacgcctgtatgtgtgtgtagtatgtgcatgtatgtgtacatttatgcatatattcatatataatacatagatattttattcataaagataaaatttcaagtcatagacttttgaactgacccaagaaggcacacatataaagtaacatatcaagggctagaactcaacatttgtgtatcttgatttaaagtctgcactagctttttttcctttctaataaaatatacaggcatgtacaaaggaaaaaaataaagatcacccacaatgcctgtatgaaaaggtgttcacttacccagcaaatatattttaaattcctactatgccactttgctactagagagagccatagtgaaacaggtttaaaaaaatctatgctcttgtatagagttcacattctagtggcaatgatttaaatcgctaaaatgtgcaatatacattaagtgataatgtgatggaaaaaaatgaaactgctgagatggaggtgtggaatgcagtgttaaaagatccataatcagggaaggccttgttgggaaaataatgtttaagcaaaagactttgttacaaaaaaagatagtatattccagacataggtgggactgtcatgcttgaaaaatatcaaggagacccatgtgactgcagcaaagtgagaagttgtggaacatgaggtcagacagttggggaagaaggaggagaggaaaagaggcacataggccactaacatagggctttgtaggacacagcaagtactctggcatatttttctgagaaaattatctcctgttctggaaaaaggagtgacatgatgtaacttaagttgtaagaaatcactctgaatcctctatggaaaatagactgtaaatagctgagggtataacatcaagagcagttggtcttattgtgataatccaggtgagagattatgataatagtaacagatgtcatgaaatgattgtattcgagatatatttcccaaagatagagccaagagtgtttgcaggttgaacagatatgtgttgtaaaacaaaacatttaaatatgactcaaagttttgagcctgaacaaacagaaggaagattgggatagaaagacttggggaggagactggtttaggaagaagattgagtctagttttggatgtgttcagtttgagatgtattcatataataaaaactcaatgtcttcatttgagtggagtccagggtttaggaaaaaagttcaggctggagatataaatttgggatccatcaatgtttagataattttaaggtcagggcacactggatgagctcaccaagagaatggaggtaggaaaaaatgatctaataagggttgagtactgaggtaattcaaagatactaacaataaaagagttaattcacctctcaaaatgtgattgagttcttaagtcagcacataagaaagacaaactgtaaacattaatcttaaactccttaaatctcctctaaatttcagtatatgtggcttggtttataccagaggttaactatggccatagaacaaatcgaggctgctgtctgcttttgttttgtttttttatggcctatgaactaagaattcgttttacatttctaaatgattttttaaaatcaaattaagtatattatatcaaaattctatcaaattcagatttcagtgttcataaaaaaaactttaattacaacacacatgcttatttgtttctgtgttatgtatgactgtctcaactctacaacagcaaagttgaataagtacaacagagactatatgtctcacaaacgctatttgctctccggccctttacagacaaatttgccaaccactggtttatacaattttatacagttgtatctatatgtacagtaaagtgtattatataattaagagtgtgcgtgtgtgtgtgtgtgtgtgtgtgcgagatttcttagggtatttaagctttaaaatatttaaagcatttttttcttatggagctcactgtttcatttgcctgaggtaagctcactgttcttagtaccatatttgaacatctgtttaccaagtacattgcaagcattgtatttagtatgaatttgccacgcccattttagagacaaagtcaaggatcagagaggtcaaaacattatgagaatacaaacttgggtggatctgggttttacatctgggatctcttttactttaccacaaaccctgtcctgccctttggagctaaacatgggggcatcagctctcgttccagccaggtctcaaggaagataccagagacttggaggatattctgagatttagatttgaaaactcagtgaaattagttttaaaaagaaaatgttaaggaattgttacctgcctcaagagatgggagctatctgtttagggaaggggaacaacttagtaaatatatatatttgcttattcataaacttgttttaagaaagtggttgttactggagataaaatggtgaatgacacattaggaaaattttcaaactggcaagcaaacaagcaacttcattatgcaagagatacaaataggatgtgatctcataagactactattatacaatagagtgctagagcttttatttcttaaagagtatatttgagtattcattactaatgtttgaaacttacatcaagtcagtcaataaactacaggcatgcccctgtccagcatgccttttgttgcacagtttttttgacttgaaacttacctatgttgatcttgaagatccaagatcttcttgaatatgtgatctcaaatcatggctgtaacattgatatatacagtgaattaagttcatccctaactactgatataatcagaaaaggacaagagtccttccagggattttggttgaatgaaatgaggtaatagattaagaaaatatttaaaaaactttatgagctattcaagcttgggaagatagctgctctgactgtttttactgtgactaattgaacccctaagaagaacattttgcattttgagaggatatgtgattctgtcacttgtgtctatttatagatagaatatttcagcaagtggcaccttagtggcttggaaatatgaatacagctcaaaagggacactcttttctctctccttgtgagtcttatgacccattacttgatagaatatgtttctaagaaggattttatgtattctgtctctatgatctttacagattccttagtagatagtgtcattaacctcagatctagaattttctgcttttaaaacacaaaagactgtttgcaaattgcataatcacatagtaggcatttactaaatttaaagaaaattaatgctacatagttaacaaatagaaggagatcttgcctgttgactcgcctgacaaagacttccagcaaaccattatgttgttgttctgtcatccttttatcttccaactaacaaataacattctgacagtgttaaaggatatcagaatttttctgcagaaaacagccctgagctgacatcaatgctttcacaaaggaataaaataaaactgtgaagatattagcttgacatcatggggaaaaaattgttgaaatggatttacatctaaatccattatcccatttaatctttgcaaaagaccctgtgatgtaagtgttgtcttcgtttttcctatgaagattccagctcaaggtggtttaataatgcctgtggatacataattaagaaattgtggagaaacaagacctaggtcttattctagtttttgttccctttaaatgatacaatcttgcaatactaccacccccacaaccagaaaatctaaattctcttatttctagagcatctcattatgccatcactattaatcatgaattgctcaggtaagaattagtgcgaatagaatttgagaaaggtatattttgaattctagatggagggagagagaaggaaagattaattttgagcttttagaagagttaactggtaattgttgatgggatctatgcccactggaggacaccttaggactcctccaagcactgtgtggctaaaaatagggtcaaaaatataagaaactcagaatatgtggctgttgctaaaaaacaaactccacatgctttacaactttatccctaattagaaatgccttaggatccactatatggggaattgagacaacaaggacagaaattcttaggagcagcttttgtatatctcctaaataaggctttgaaaaagaccttagataaataagtgcttcactcctaaagatattgttgattaatgagtgattcatacttgccactgctattctttcttgacctcttagtagctggaaagttcataataatcctgaaacatgtagaacaaaagaccgatggtccctgagatcaagaataacctcacaaaaggattcaagctcaccaaatggttcaacagttttccatgttccccaggttgaaggtttcctccttagaaaaagcagccataatctaggaaagttgttgctcaagagaactttctgtgataatgaaaatgttctataaatttgcactgttcactatagtagtcactagctatacctggcttctgagtgcgtaaaatgtgcctagattgattaaagaactgagttttaaattttatttactttaaatttaaatgtaattattcggacagcacacttctagaaaaaagaaagggtgatatgctagacccagagcataccctaaaattgaattgcttttgagacccactgaggaatgtttgagtgacacaaactcctaataattatagaaattcagcctcttctgggaactccacctaattctggattggagatccttggagataactcataactataggctcaggtacaaatgctcatttctattgtaaagactttcaggtgagaatttccagacaatggtctcattcacttctttagcaatcagtaggaccttttactgtaatattctcaagagaataaaagctaaagaaaatatttgtagatattatctttcctctttctactgcatccaaattatactaaatctctattcaaaatttccattttagcctatagtaacattccattcctataactgaagctcatatattaatatttttattacagtccagcatcatacaaagtatagaacctttagttctgagactcaggttcaagcctagctccagtctttactgtccctctgaattgagggtaaccatttaaccttgctcagttttaatattatctgtaaaagggaaatgatatatatatatgtcttttacagaattattgaaggaattaaataagataaatatttatgtatttattttaaataagagaaataaatgctttccaaaactaaataaataaaatgctaggaaaatgtcaacaaatataattactgtcaaccatctgtcctctctctcacagactgaaccttcttcccatttctaaagttatatcctgatacagtttggctgtgtccctacccaagtctcatcttgaattgtggctcccataattctcacatgttgtgggagggagccagtgggagataattgaatcgtgggcgtggtttccccatactgttctcatggtagtgaataagtctcacgagatctgatgattttataaggagtttcctcttttgcttggctctcattttcccttgtctgccaccatgtaaagtgtaccttttgccttctgccatgattgtgagtcctccccagctatgtggaactgtaagtccattaaatgtctttcctttataaattacccagtctcagatatgtctttattagcagcatgagaacagactaatacatatcactaataatatcctatattcacatagaacactatattcacagtctgcttttaaatataagatactgcatgtatttactgcctaatgtcacctagattctctcctagaccctggtcaaatagccatgcaaattacatcttctagaaatattctgaaaatagatttgatacataattgttgtatacagtaaacaaccgtgggtttcatgtgttctcatcctggtatgaaaatttttgtcaactactccaaagctgttaatctaatatctaattattttaagtagcaattccagttaaaaatattacctcatgcagaaaattggaaagttagggaaaatacaatgctagaaagttagcatttcattgggcctcaccaccagcaataatgattgttaaaataattaacaagtaattaatgctattatttaatttctatgcttggattaataagttctagagattttgctttgttcagtacttgtatttcctcttctatatactctgcatccttgctattgcccgtttatttgtcaggaccttagtatattgattatcaattcatgggagcacatactgcataaaagatgatgataccacttgatctttcatatttgttataatattttattcccaatgcctttttaaagcttttaacataagttgaggatctaatttttaaatttttatgtacttaaatctgcaattatgcttctctctaaattttttctttattttgtaaattatctgctctccagtaatttgaccaattgtcagatttggtctctccataccaatatgtcacctatagatgttgttttttctcaactgtctttgctcataatattggagcaaatacaattaagagctcaaattgccagacaaagtcatagaaggaaaatgtttggtcttttcaattctgcccaacttgaaatgatggacaaagtttataatcatagattttcactgaaggcaaaagggactagccacatattgctgtaggtgtgtggtatgtgtgaccttctttcatgttcagcacaactctcagaagtagttagtattcttatttacatggtaagaaactgatgctatgagggactaagtaacattctaagatcatactgctagaaattagtggatctggcttccttatccaggttcagttggctcaaagtcagtatgctcttccctggactgtgatatttggaaggccacttaccttatcagaagtgtttttaaaaaatcaagtacattcatattaatgattctgtaataaccactaattatcaaactttactaagaagcagttcctgcttaagacctgtcatgctttatcttatttgagattgactgtaattctatagcattgtgttatatccctgtgttaaagattaggaaacagaagcccaaggtcacagaattatcaagtattggagagaggcttataatcttggtcttggttctaactcctggcgcttaaccactgtgcaatcctgcctcaaactactgtatacggtgtcatactttaaatgacttcccagtcatttgagagtgggaagaacctacccaaatgaatggctacccaaacagcttctttagcatatttgttaaattaggcacttgttatatactcacttccatttgaatagtgttaatagtgcttaatagtttctcggtgttacagtgtgctttggttggttggttggttttaagtatactttctattagtcagagattagagtcaaaagggaagaaacacccacacagtcacaggtttcctggcatgtcctagagctcctttgaaaaatgtgttcattccctcctgacaggagccctgaccccgaagtctgtcagattcataacaaagccatggcatctattttatgtttggggctggcccatctctcatgtgctatcacttgcttcccaaaggtgcatcccagcaggggaatctatttgaggaagtcccaatgtcattttatactagatggtaggaaaaccttcacaaagccctctttgtcactgttattctacaaggtcctggaaatacacttgaatatctagcgctccggagtttgcatgttattcagaggtgagcattcaggatgaaagtgcatagtcagaatcaaacagagcctttccagaagtttttaaagggtcatggaaatgaaaagactagtgaattctttcagataattctgcctttctacatttctcactagatttttagaaatgaacactgaaatttcaagataacatttgttgcaggttcactaaactaccttaaataccaaattatttaaaattaccacaacatttaaaagattgtaacaactcatatgtgctgtattaatcaaatgcaattttagagagtaccaagaatgtctccacaaatgtccacatgagcaatcgtcagtaaacaggcacgtataatccaaggagagagctataaagcaagagcctaaggatctacatttgattatcatcatcattaataattagacacataattgatgggatatgtcattagatttaccctgttaaattttcctatccatgaaatgtggataaaatacaactgttttaactggtttacaagaaaattgcaaggatcatctaagtaccacctaaaatagtttaaagcactttttaaatgaaagaaactaatttctaggttttgctcctccctgaccaaaatataaatgaacaagctataagtcttgaatcataaatatatcccttagaaactggaaaagtcagaatgttctattgcataaaatcaaattattcacaaacaacattgctgttaggtcaaacattaaagctgccacaagtcatcttttagtatgtggatgagcatggcaatttactatgatatcattcaaattgggaaaggccctagaaatggatgtaaatccaaaccctaggttgacacaggtgcagagagagaagccaggaaggggggagatggacatatccagaatcagatgctgggatgatgtccaagccagtaaacagacttaataacctaaatctctggacactgataaataagtgccattcaggcccacaggcaatataaattgggtccagtgttaagtaactcaatgttcttgcacatgtttgccaagcatggcaatgctggatggaaagcagaagtaggaccatattagaggagtccagtggaagtatcaggaatctagccattagactgtgcagttcaaaaacagatgtcagttctaagtgttgctaacagcaaggtaggattttggtaacctaaagtctatgggattcaaggacaaaagaaaaaaccagaagaaatttttatcaaaaatagaacgttagttcagagtgagaatagtagtgtctagtttattcatttgtgcattcaacaaacatccattaactcctgtgatggttaacattgagtgtcaacttgattggattgaagggtgcaaagtattgttcctggttatgtctgtgagggtgttgccaaaggagattaacatttgagtcagtggactgggcgaggcagacccatcctcaatatgagtgagcaccatttaaatcagctgccagcacagctagaataaagcaggcagaagaacgtggaaggactagactggctgactcttctggccttcatctttctcccatgctggatgcttcctgccctccaatgttggactccaagttcttcagcttttgtattcttggacttacaccagtggtttgccaggggctctcgggctttcagccacagattgaaggctgcactgtcagcttccctacttttgaggtttggggacttggactggcttagttgatccacagcttgcagacagcctattgtggaacttcaccgtgtgactgtgtcagtcaatactccttaattaactcactttcctgtatatatctatcatattagtcctatccctctagagaactctgactaatacactccctactatgtgcaaatgaatatgctagtttcagtaatgtgtggcgggggaaggtacagtagccctcatatgctcatgagggtgagcagagggcaattagcattgtgtagcagcagtggaaggcagtggggaccaggcaaaaacttaagagaacttcacacttacagcaggtgttcagtgataagtagaaactagcagttctactttgagaagaatatttagagcagagaaaatgtgtttttaaatgcctgttttattggagaacagtaaacagtttgatgttgatgaagattaaggtaggtatgggaaacgcagtggagctggtggcagggtagttggggacacaggatttgcagctgcaaagacaggaaacttagaggtctgtgaaggttcacgtgtgccatgtaagagcctgagtctgcatcaggaagcacttgaggaggccctgaaggacttgcaacaacaaagaatgactttgcgctttggctgtgattcagtcaaagctttaatggcaagaccatggaatatcttttggaaatggtgtcataaagcttgattttattatgttgaaggatctctgagtaaagctgaatttgtcatttggaaatatgaattaactttatcatattcttcttgcatcttgttgatgtttgccgttgtgagcttcaagaactgaattgaaaaaaaaatgcaatagaccagagctctggccgggcaaggtggctcacgcctgtaatcccagcactttgggaggccgagacaggcggatcacgaggtcaggagattgagaccatcctggctaacacggtgaaaccccgtctctactaaaaatacaaaaaattagccgggcatggtggcgggcacctgtagtcccagctactctggaggctgaggcaggagaatggcgtgaaccctggaggcggagtttgcagtgagctgagatggcgccactgcagtccagcctgggcgacaaagcgagactccgtctcaaaaaaaaaaaaaaaaaaaaaaaaaaaaaaaaaaaaaagccagagctctattttatgagatcactctgtcacttgtatacaataaattttgtataagaccatatcgatctatgtatctatcacaaggaatagtgtaggttctaaacactttgatcaataaaacaagtagttttatatatgcatataaaaaggaagaaataaaacatattaatcaagcatagactataaaaacttctccacagggttcatttttctttgaaacaaactactagatgttttaggaaatctaatttcatgtgaagttttgctgcattttagttccatgaggaaaatttttcattcatactttttcagtgtcatttgataacaatacaaactagttcatatattcttttagagaatgtacttcacaatttgatttggttgcaatgttcataatatgctaccaaaaaattagtatcccttttaataaataagttgaagttaaaggaaatacccagtattgctgcacctgcctcaatcccatttctttacatgaaccggcctcatctgtgcactaataataaagctgaaccatggacatgccactgcagttggcctcccatagctctgcactacctgtttctgttctgggacagtttataagattatgccaagactggtttcccccaaacttgtctttgagtctcaggtagataaaacaggtatttacttttcagaaaagtaaagtccatagctatttattgaatgcttgctaatattgttaggcacagttctaggtgctgttcatgcattgtcacatgtaaggctcacagccaatgaggtaggtacttttattactcccagattacaaaggagaaatttgaggctcagacaggtgaaataacttctcaaagtcacccacagaagaagcagttgtatacaatgagcttgaattgaatgcaagttagtcaggctccatagctcataacttgccaacaccacattcttcttatactgtggtcaatactatgagaaatgtttcccacactacataagtttcttcaatgtacctcctagggttagtactttcaatgtgcctcccacttagggtacctagtcagtgtcctcactgtctttcagctctgtctactgaaatttagcctctccttggtttctgtggaatttggcaagtccagtgcagtgtctaactgggaccatctccttttggcagcatcaagttaggcttactgttagtatcctccaaacttgttgctctggtttgctggcagctggagtctagctttgacagttactcagaaatggagcattggccttttttctctagtgactcggtagttctttgaagaaagtcatgggaagaatatgagctttacactacaatgacctgaatgcaaacatcaactcagccatttattgttgtgcagcttttgtcaagtgatttgacctctttgagcctcagtttatcatctatataatggatattaaaatatatacatcattaggctttttgtcaatttaaattaaataatagaatctctctatattcatggaacccctgtatagttagcactcaatgaacctgccttgttacaactttaaaaaaattatattcacttaaaaaaatggggtataactgaggtttacatatgaagttatgggatacatatagatagtaaaatggttattacagtgaagcagactaacatatccatcacctcacatagttacgtgtgtgtggtgtgacaggagcagctaaaatctaggtatttaagaaagatccctaatacaatacaaatttattaatagtcctcatgttgtatattacatctctagacttgttcatcctacacatctgctactttgtattcgttggtatctccccattttctctcctccaccctgggccctgttagccctagattttttctgcaagtttgacctttttattttaatttcacatgtaattgagatcatgcaacattttttctttcagtgtctggcttatttcacttagcataatgccctctgggtccatccatgttgtggcggatggcaagatatcctttattcttgctgaataatattccattgtgtaggatgggtatatatatgccacatttcctttatccagttgactttggtcgtttccatatcttggctattgtgaacaatgctgcagtgaacatgggaatgaagatatctttacaaggtggtgatttcatctccttcagatatatatcaagaagatggattgctgggtcatatggtaatctatttttaacatatttaggaaccatcatactgacttccataatagctacaccaatcaacattttcaccaacagtgtataagggttttcttctctctacccccaccaccgtttgctatcacttgtctcattgataagagccatattaatgggtgtgaggtgatatttttatagtggttttcatttgcatatccctgatgattaaacatacattttcatatacctgttggcatttttatatcttctttggagaaatttctgttcaggtcttttgcacattttttaattgggttgtttttctgctattgagttgtgagggttttaaattttgaatatcaatcccttatcagatatgtgggttacaaatatttttcccactccacaggttgccttttaattttgttttttcctttgccagacagatagatgccttttagtttgatgtagtcctttttttttttttttttttttttttttttttttttttttgctgttgtagctgagcttttggtgtgatatctaaaaaatcttggccatggccatgtcagtttttcctctacgttcccttctaagacttttatggtttcagatcttacatttaagtcctttgttcattttgagttattctttctggatggtgtgaaatggtggttcaatctcactttttttttttttgaatgtggaaactcacttctgcaagcaccgtttatcgaagagaccacccttttccccattgtgttctcttggtgcccttgttgaaaattagctgatcataaatgtttggatttatttctaggttctcttctattccaccggtcgatgtttctgtttatctgccagacatcatacttcgtgattttaaattataatttgtaaccttagtttctcacagcagttctctctactgcttcttcatgtcagggttcttctactcgaatgccagtgtttctatacatagaatttcccattgttttctctgacactaactttctacctgactggatttctgccattgcctgccataacccttcccagtcagaaattagattcagttggaattgaatcataatccatttaatttttaccttttcttttgtggactgattttggccttacaaatgaccttaagcttttcagaccccactcaactgccattagaatactacacggcagctttgtccccacgcccagccacatgtttttcttcttcccaagctcaggttgtatagcctgtagatattcatacctgaccaagtacttttggatgtgccatctcatttaatttttgcagtaattctgttgaagcactgtaaaaggtcacatgagataacggagacttgccttttaaaaatatttagttaaaccacatgacatggctgatatttggatatctttgacctacaaaaacaatttcttaggattcaatctaatccttccttgaatatgcaagatatgagttcttaaatagttttagttcacgaagcgcatcagcacaggtacatataaatgtcacacttcattctgatattgtatttgccacactaaaatgaggaaaggcatcttatgttttcttttggcataaagcacaggattccaagggactaagatataatatgatataataaaagctcattgtagtgctgggaaaagtaagtcattcattatcattactgctaatatgtgtaactgataaccccagagtttatttataaatgtagcaagtatttctcacagcatccacaagacaatttttagttcgagaggctgcataaaatgagtactttcccaatacccatttaggcaaaattatccactcaataaaaatgttctagaactttggacactgtgttctgaggtcggattgtttttgataatagattatgaggtcatgtttttctcttgtaccagtgtaccaagaagaggatttaaattttcttagtgacaggaatctcagtctgggccttctgactttcttcctgccagtatctttaattgccatgtgttcttattgagaagaaaagttgtcatcaggttctctttgatattaaaatggtttcaaacacctcgatttgatttaatttaggtctgatattgctaagcctctactaaacacaatttcaaatgatttctctttgatcactattctattggtgagataaacttctcagaagtggcttaaaatctgtttgctttgttttttgacaaagttatctacagatttgcccattagctttttcctattaatcaagttaatttaaatctaactgctaagtaggttttccttagaactctttttaaaaaaactgttgaagaaatgtgtctctggtggattattctgatttcctaaactcagactctaaaattgtgtgttttcatttaagagtctgagaattgctagtgttcaatttgctcagattggattttagttatgagaaatctagacacatggaaaaaagtgctttttaatcagttcttgaaatcaatatagcaataaagcaatacatgagaaattattttgaaaaaaattgtatagggtggatgtcacagagtattctacatgaatactcatttcatatcttgcatgaggtactttatcatttacactaaattattctacttaggaaacttcatcactggcacatctttttgtaaataactacctttcctcaattttatatgtccaatatattctactttaggtcagtttttcccaaacctccgccattaatttacttacctttttattacctttgccatattctaatccatatttatttgtttctttaaattgattttcaatcttcttatacttctaactgagccttaaactataaaactatatgttgatgcatatttttcaaatgtacattaaataaatactttgctgttagcacataaattgataaccatgtactacctatagttattatgtcttccactagactagataccataggtatctgtttaggaaaagcttttggttgtcttatatgatctatataaatatagatatttgataatacctgtttttattaacctgaagattgattgaaatgaaataaaactgtgggaacttagtgtataaaaaagaacattatatttggtattacatgaactagaagatctatcttctaattgcttttgtacctcctgcttgcaatatagttttggggacgtacatttccaaggtcaaaccagttgctgcatctacacattaaagacatagaatcattaaaataatctctaagatctcttttagctcttaactttctaggagagtcaaaaattctttgtagcactcttggatgacttatttggggcaatatgtattctaagctgcattactgctatattttgtaattaaaatattttgtattactggtgagtattaacctttaattttcatatttcatgtgagttgtcttctctttattagagttagatgtttgtcctggtgtcccagttctattcccactttctcattcaactacatgcacagtgtaagaagtggggtgctgctgacatttaaggcgtgtaaaaaggcatgcaaattatttagctagctgagtttagtcactagcaggtagtaatcatgagccattgtgcatagtggatgacaacggcgaaaatacctgacttgtatctttcctatgacattaggcaagcttatcaaatattctgatcctccatgttgtcacctgaaacaaagcttcattactgaaggatatgggtcaagggatgactggtcattcactgggatagtcatgatactcatttatatcccagtatcagtcacatttgacattcagctggagtgatggcagatgtagataacatcggtctttcagtgtatgcttcatggaggataatgatggtttgcagctattatgttcaaatgggacttagaaaatagcctactaattaaatgactaaatcaaataaaactacacattttaaaatttctcctttatttaaacttagcaaattatattttttgatcttctatactgagtttctgacttactcatctcagcccaatttgtgtatatctgagctttgagtggaatgtgcccttccaaactataatacttctatagaatgtgaatatttttacacgttgcttatggaacactcaacttcttgaaattctcatctgatttgctttgctcttacacaaattacatgtgctacacatatatacattgaaacaaagccacttttccaaacagcaagttctcttaccatggaagtgtgatccagttatctttgatatttcatttctcttaaatatcttttagcaacacacatcttagaaagtgttgtcattttttataaggtgatatattttaggtgaattttcatatttgtagaaacctattttttccactcttcactaaatgaactcagatttggttactcatactaaatgctctggctaaacatcaacgaacagaaatcatttatcagtctaaaccaactttatatgcatttatagaatatattcactttcatataaaattttacaattccgtatatattaaagcactatctggactcaaaatcactaaatttgaagtttctatgtaatataataacttctaaaatgggaggtttatacaatactacaaaggaaaatcatatttggatccatgggttttatttgcttttttgattttttttcttttcaggattacaaacaataagtcttactgtttttcaaattatatccttatttgctaatttgatttacaaatgcacatgatctttgagcacattttctttgcatcattccaatgtttacgctgctaacttaactacttagatacttgccacgtacagtctctagctctttatgagaagctacaatggaagaaatgtgtgacttgcattcatagtactgtgaatctgttcactcactgaaattcactaaaaacagaacctgttttcagccattccttgtttcaatctgcattccttgtctgaataactgtaataaaataggacaaaacaaattttgatgggcaatttcatcgtagcccatctgttcggttatgctgggaggcaggaacctagtcttatctgtcctgctgtttgcagggctgtcttaataaagtttggtgaatcagaactacaaggtatttcatttacttctatgtgtattcctgtgttttgactttccttcccctgcccttcacagtggagttaaagcaggaatctagtggcatcagagattggagtctaaatgaggttgaaactagaccgggtatcctattcaaggtagtcttgaaaatagagcatcagcgggacaagtcccaggtagccactagggaaaactgagattcaaacactaggaaaccaaatatatactccaagttcaaatgacaagagaaatctaaagtgaagtttcagagccaagagtgagcaggtgggcagagaccagatcagctctggagctgatcataatccagtagggagaattgctgcctgtagcgatggttcctggaactaccattcacctactggaggcttcctagaattgaaagatcatgaaaatgtggacaactaccttaagagctaaaacgaggcaaaggtgagacttacggtcatctcttaccttcctggtaaaatttctcagatcatctgatacaatgtaagacaatctgcttgtgatccataggccactcgttcttcctccaaaatggccttgtacatgttactatattttatttgaatgtaaacacaattaccaagcagtaaataatgattttccttacccattgattagtgcatgttgatactgaagatgcattgatttgtacaagcctagcttgaaatggagcagatgggtatgtaaaggtttactcaaaatcaatgtgaattagattgctgctcctcagtaaaatgaattataagttagaatggctattttctttaacttaatgtaatagaatgctgtctaaggcaatctgttaaggtagacttactgaaaatgtagcctttgatctcaaaaataagcattcccaaaacaacatgatttaatgagcaaagacaatattatgtctaagaaaatgtagttaaggcattgtagcaaatgtcctggaaaaatgtttgacaataaacttgttttcttttaaaaaataataatcatgttctttcgagttatacagtattacactgactgctttttttccttgattgtttgtaaatattcacatatacatatgttacagtggtttaatcactgtactgctcacagtgcagcagtgctgatggatagcttttgttaaagaaatatcattaacatttatatccttgtttactgctgttgcttacaatgtaaagaaaacaataatccatttatagtccactggctgtatattcaggctttgttcattcctttaaaaagaatagtccaaccattcatgttcctgaaatattaagggaataggccattctttgtccaacttcttaaatagatctttgagtttcggaaaaactatgggggagagaaatgtgtcaaaggaagtaccacagactgtgttttatcccagtatagggtgctgctttcgcagaaaagcgaaaaacattcccaaataagagtatatttttgttttgctactggaattattcctcagatggcttgtgcctgtttttagagtgatacaaatttgcaacgtgtacctatgtgtggatggatgtctcataagtctattgtcataaatgtgactattcagtatatctttattgagcacgtatgttgtaccaagtaacatactgtgtactagaaatttaaagaaatagaaagcagagctcctgctttcaaggaactcagtttgatgtggcaccatgatagctctcaggcaatttaagtctatacaagaattcagagaaggaaggatgagattaatccagccaaaaagggttgaggcatttgacttgggattataaagatgaatcatactttagaagcatggggaaggggagtgaagatggggttggttaaaaacctaggaaatttgaaaacaaaaaatgaaaatacaaaacacaatttggaaagatgggttatgtaaaacaattggagcatggagtgagtggtggggaagaaagtaaagtgatcttgcataaatagcctaatttctctacatatttttcatattaaacacccaaaagaacagcttatttttgtctgatatttaagttatgtttataaagattttattgagcagaatgtgatcaacactgctggtattacaaagcataggggcatgttgtagattaatttgtatgatgtatccatatacggtttatatgcatatatagcataaacgcttccttcaagattggtatatgtgtaacctaaattagtctctagctccaattctgatactgtttaagtatgtaacattggctaagttataacatttctaaaatgtaactagacggtctataattctttcagccaaaaccttttggagtgatcttatgactttgtgattcaaggctgaatatttggaatcagactgtcctggattgaaatcctagctctcctgcttgccagttgtgtaaactttatcattttgctgtaatacagtgcattctctaatcctcaaatccctcttatataaaactaaaaatagtgtctatctcataggattgcctttagatttagtgtaaagtgcttagcccatttctgtcacatagtgagtacttaacagatgctgcctattactattgtgcgattccatactgattagtaaaagaatcatatccacttaatttctgggcctttgaatgtcaaaaactaggcctgtgtcattctaataagcatgattaggctttttaaataaacattattcacctcagtcttgggcagtgatttctcatgcttgaattttagttttggctttcctaagacttcttagtttagcttctggcactctttccaagacttatttattttggaaaactaatatgactcatctctcaagataactggcccttgactgccatacttgatttagtttgcccacagttcttggtaaaagatcctgctactactgagcccagtcccatggaatcagctctaactaagctatcacttcagacatagaagagtaaagaacaaagagtaaagaaggcaatgaagataaacaactgagtgtccacaggaactggtggcaccctattttcacaaaagaattggcattaagaattggaatggtccttggaagtttctattctaacacatattttcagagtgtaaaaaatgatcacaaattctacccccacccccaccccaccccacatcaagaagtgagtctatctagtttctcgcttcttgagtctggactagtcttattacttgcttttctgacatacatgacatagaataaaatagagtaggttttgattctcagactaaagatttgtatatttcatctctctctctcccccacctctcctttcatcttttcctctctctctttctctttttctctcggagaatgtttagcatatgagcaagccagtttaaactattggtgggtgagagaccatgtgtagagaggtcccattcatcccagtctttctagtcaaagtcatcttaaactagccaacccccacccaacccaaaagctcttgccaaatgcaagagaaaacttgatatacaagaagaaaaaataaagcccagctaagcccagacaaattgttgacttacagaattatgagctaaaaaaactggtcattgttttatgcactaagttttgcataactgctatactaagcaatgcatgaatcacctctaaaatactgcctacaagtggccaaatagctattgcattaaggaagaaattttctccccacattcattttcatgagtgtgaggatactatatggctcaataattagcgtaggtcaacctttcaaaccctttaaagtattaaagtaatcacgtgagttttcattataacagatttaaatcacaaatgaaattgtcagtttatttttgagttaccaaattccttacacagcttttaaagttgcattgtacactgttttgctttctcatttactttaacccagaaatactttctaagcttaagtacattcaaaacttgtttttttctcacctgattctactgatctctgggatttgttattttcagaatccattgtttgttttgctaactttttctcgcactgtattacctttcttggcttaaaaacccaataggcttggtaagccagatgtacgcctgtccaaccagctcaccccagtttgaatcactactctttcatcttctctgccttcccagtatggcttagatattctcaagccttggcttgcttccagtcttttcagaacagtattctgaattatgtctatagcatttgttttaacttttttttgtggagcggggggaagctcaaatgttctgattatttattctgtggatttctgcagtggaccagtgaggattctgcctgtcatagttatctccatcaatccatcagctaattgcacgaccttttcttaaaaatgcaattttgttgcaatcactgttctgcacactctgacccattatggtgatgaaagaaaattaaaccacattctaaaatatgaaaaaaagcaaagaacagtgtgatgaaatgaaatggttatgtctatatgctgaaatgtaaatgtgggcaaattctttttctgtagggagtttttatgtgaagctcttttggaataaatataaaagataaagactggagttaaatagaagtgttgaattgactccccagacctatgccttccacatcatgtttatgcaattgtgttttaaagtcaatgtctatattcatctgaaaatatcacccaagtgctttatcccatctacaaaaagaatcatatttgagaactgcctagtgggtaggcatagacgtctcaatccctgtatagccttgagatgaaactatctagggggtctaaaaaatgaaagtcttcaacatatatctttcaataattattttttgtgttaagaacattaaaaatccatcatccttgaattaaaaattgcatgagctaaaaatcacacaggttatatatattgaatggaataaaatgagaagtatactatattgaccagaggtaagatactgttgtattatccttacagaatttaaatgaaatcataatttctatttataggcaagctatatggtattgagacaaggaaataatttacaactgttatagttatagaaaggttatttctaattttatctcatggagttaaaatagaaacttaattttaagttaatctcacttttgggagtgtaatagtgcaacctctttgttagcaagaatatttttaacctaactgtataaagcattaacacattgtgtaatatcacttatcctgtaggaaatcatcaaaatctgatgattacggaagactggctttacaagttcaagggagaatatctcgactccagtaaattccatcaagactgagaaaagtgtgatcacgggcagttagaaagtatagcaaattcatatccttaggctgctttctaaggatatcagtgaaaatgaaatcagacctttcttaaaatgcggttatctaacacagtattttagaattaaacttttaatctgttttcttatatgactattgagtattgttatccttcacttttgttgttttgttttgttttgttttgttttgttttgttttgttttgttttgagacggagtctcactctctctcccgggctggaatgcgatggcgcgatcttggctcaccgcaactccacctcccgagttcaagcgattcccttgcctcagcctcccaagtagctggaattacaagctcctgccaccatacctggctaatttttgtatatttagtagagacggggttttgccatgttggctaagctggtcttgaactcctgacctcaagtgattcgcccgcctcggccttccaaaagtgctgggattacaggcgtaagccacttcaccaaagagttatccttcactttttatgtacatttgcattcttgtactttttgcaaaaatataactgccagtttagcacctactagacaaactagttcaacatcgttcaattttcacatgaaaattagcatcccacctagttggggtgatcttcccattctgttcttttttcttttcaaatgagtaaaatcattaacttcatagaggctttatttatccatttatcctattcactgaacacctttaccaagtgtgttactagtttagtctctgggtttctaagaatagatacgttttttcctaagcaggtcacaatcaattgttggatataaatgattttcatacaactaattcccaagcatacccttcaatttaaaccagagcaatacagctacccaccctcaaagacaaaaggaaaaatatatttgtgctctatttataaattgccaatattttaaaaagagaatgaaaaactttgaccttatgctagaacttgccgtttttattataaaaagttccacaatttcatctgtgcattactatgattcatcccaaaattgttttaaagggtaagtattcccaataaaattaagattcaatttggaaacaatatatctatttcataaagtaaggtggacttctgtgacaagatcatcctatagatgaattgagacttgactgaagtaaggaaatgtttcttcaccagctttattcagagaaagtggcttaagtcatcgacttaggattccattgtctgcattctttcctgttagatactcagtaaatataattagattgattaactgactaaacaagtcttacttactgcatgagaagaactatctctgtaaaaggaaatctcccttagcagccaaattttctgaatgatgtcttcaatgtgaagagtaataagtattttcctccacagaaacctgacccaatatcagcctggtgaagagacctagacctctggccattagtgtgaagtcaatgctattgacaatcatcaaagattttcatcctttccactagagtacttaagaactaaatatcattgatgagaactaaagcctgttgatgtgttcctgtaattttaattaataatacattaaatttttttcctgattgtatgaacatatatcatttaacaatgatttataccaaagccattaggaaagatttagtgtcatatcacagccagttattctcttttcttcttccttacccctaaaaaatgtcccagatgcagaaagtcataatctgatattcagatatttacatttaaaaggttcctgtcttttaaagagttttcaaagttctatctttgtctaaaatatatagtttagaaaatataatgtacatgtgtattgcatatatgtatattacaaatttaaggatgtatatgtcactcgctatatatgtaattaacatatttaatcatgagcactatgccttgcatatgtagcacagcctcagacataagtcatacctagagaggagtgtgatggaaacaaccagaacctcgtaacaagattgagtaaaccaactgacatcttttagactgagatatcaagtacaatgagttaaactgttaaagcaaattcaaatctgctccaagtgagcattaatttttaacatgtattatacatgtcacgacttctgagcagtgttaatcaggtgagaattctcagatgagaactaaggttatatgtcaaggaagcgggaatttgcgcaccgtgggaagaattcctctgtatgatggacagaaacagagttggagtccaacaatgattactgtgtggaaagtgatcaccagagaagagggaaggcggaaagtatagttacacaaaaaagcaagtctaagtttcaatcaggtgatctcaaataagtcaattccaaatgtcacttaaggtacagggactccaacaaactgtgtcaaacatttaaggtgagcatatagggactgattagactggattatgaatgatatgtaaaggaagaaataccatggaatactctcccttagaccaggttggacactgtgaaatgaatgggtttcattgttgctactttttatgttcattattttagttaaataaactccttttttaaaaaaaaattgaaattatataacagagtaaaaatagaattcactttttacagtgtagagagtttctggttataaaacagctgagatgtaaaccataaatgagatgaaacataagtgattcgaacataagcaagatcattctaaaaataactatcagggaacaagggagttcaagatgttaagatcccttatctatgtggaaaaatggatgataactttgtcaatcccctctctagaaatgaaaacaaagaaaaatttaaaaatgaaaaggttattagcaaatggtccagaagtaggccaggcagtagaaagcatgattttgttagccattagttacatagagcaggttatgtacgtccctacctggaaagtcataaaacattcctgaaaatcctagctggcatttccagcaaattgtgagagaacacagtttacattctgaagcccaagaagcattgtttttttaatattatgtaccatttcactacttaccatttcaagagtataaaataacaatagaattggccttctcattctgatattttagaaaattccacattttcacggttcctattgcaaacaagaataaaatcttttggcagagcctgactataaaaagatctagaagctattcttataatgtaaaaaaagagtatgtttttatgaccttgccaatttctctattgataaagagtaggaagtgtggatatgatctataaacatatttttaaatgacaggcatagataaagaattctctgaagcagaataatttatggaacaaaagcagttaaggatgaaaacatttatcatgggaaatgggaatactgtgagtaaaaagttcaagaataaagtatgatttatgataatagagattctcacaatattttcagaactatagttgaataaaaatatgtagtatttgattgaaaaccaaaacagtggattaatgtaactagaaaagtttgggtttgggccaacagcggacattgaaatatgagtatatttttagaataaacatctatatatagctccagtgaattcactttgattaaaagataattcaatggataaattggataaaatatgtaaaaaaaaaattctctggctctgatgacaaaaaggcagtttcacagatttgctatcagaaattactttttcatagaaacctacatatatttctcttttattctgatatgagcttctcatgtgagattagtcagtgtgaaggccagtatagctcagacaaagctgaccacagcatagaaacccctgccaacactaaggtcacacccctctctggggtgtgactgaccagatgcaggcctgtctttcccaaagaaccatggctgccacttctgtgggatgaaggccttttttaatggagaatatctagtcaaatgtctccgtaatattaccttcattgttcgtagagtaaaatgtaaagggttttaacttcagaggaactgtgcacaggcagggaggtgggtgaagttgacctaatgcagagatggggagccacagctcagggtcaggtttgtcatctcttaattctgtttatgccattgacttgttattggatggtgcacaggtaattgatttatctggctaagttttcttattactaaaatgaagttaacatctgcatcatacagttataggaacagggcctgggacagaggaaactctcggtaaatgttggctattgtaattattaccttagtatgacatcctcccgaattcttcataactttttggtaactggtaagagatgttgaggggtaacaagatcctgctggggtaccattctccttgacttccttcaaaggtcagattttgctggccttaaaccacaagtcatcagtaaatgtaccattgtgttccggaattgtaaagtatctagtggaggctttaagaagacaccgagttgttgttgttgttgttgttgttttcaggattatacttaatttagtcaagacagatttcttgtgatgtaggttccgtgtcttgaataaataagtacaattctggaaaaaaaatgtttcaaataatggtaatattagggagacatataaaaaatttagggagccctaaaaagcctgagatagaattggtttcagatgacactaagtatctcgtatttccaaggtactttgggagaggcagcatggcactatagaaagagcacaaactttgtaaacagactggactaagtcctgctcacttacatgtaacctggggtaagattcatttatagaagcttcaattttcttgactgacgtaatacatatgtgcctgatttctgtgaaaattaagaaatgaatgtacaataccaaaataatacttcagtgtcagctctcaggaaaggaaaatcaaagacctctgtttaagcattgcatgtttgctgataccatgtcagtaccacacatagcttcctcaaaccatttgagtaattcttagatcctggattctcttgggttctatggtttgaatatttggcccctccaaagttaatgttgaaatttagtccatccataaggacaaagccctcatgagccagtctcctcttaaagtgccacagtagagattaagtttcaacatgaggtttagagggggcagatattcgaatcacagcaggctgctataacagaataccatagactaggtagcttaaacaacagaaattaattcctcaaagtgctggaggctgagaagaccaagattaaggtgtcaatgaagtttcattccaaagcatcttctcttggttgataggcttctcgctgtgtgctcacatgaattctttacaatgtgtgtgtagagggggagaaagatatttaaatttctgcccagtctcttgaaagatcaccttggctttcatctcataattctcacctgatccatactgttcagaagtcttaacatacataatccattttagaaatgatgtggccatgaatcctattggattggagccctgccctgagatttcattttttaaattttcctctgaaagactctattttcaaatataatcatattgggggttagtgtttcaacatatgaagtttaggtgggggatacaagtcagtctcattgaagataataaggcataattactgagggggatttatatataggtagaaaagtagagtgggaacagatcttgaaggtcttctagactagtctaaggggtttgattttatcctaagagatccaaaaatcattgaacaggtttaaaacaacaaagtctgatatgcgtttttcaaaaaattactctggtggctatgtggaatattagatgtaaagaggaaaaagcataaacaggaaaactagttaagactacttcacagtcaaaaaataacttgggtgaggacagcagtaggagaaatggcataagtgaaatgggctaagatatgacatagagttagtcaacagggtttgtgaataaagttaatgaaagggaatgatgaaatagaagcacaaagtcttctaagtttcttatgagctgctgtgtggttagaggtaccatttgctaaaatggagaagattgaaggaagaacattttggggttgggttgggctagatccagagttttgtttttagatttgttgaggtgcccttctagatattcaagtgtaggtgtcaaataggcagacttataaatcttgagttaaatcaggcttagtgttaacttaagagttatagataatatttaaatccatgtaacaatttgaaaattatagctagtatttaaatccactggactaaatgagatgccctaggaagaaagtttccattaaaacaaaagagtctcagaattaagtctcagggcacaacatttagaaggccaacataagaggaggcaccaacaaagagaaccaaagatggctataaagttagaaaaccagaagaatgtggtgtcatggaagccaagaaaagataagctagcaagaagggaataggcacctgagtgaaaccctgctgagaagggaagatgaagacaaagaagtgactatgagatcaggttacatgggaggaattggtgacttagaggagtttcaatggagtggtgttgatagaagccacctaagtgtagattgaaggcagaataggaagtgtggaaatggaaaatgacaacatatgctagtgtcccttaaccccagatccacccatggaactttagagaatttccaatgcctgatcccataccagaagtagagggatgaacttgaaagtatttttgaagctggagtatttttaatgagtttccaggtaattataatgttgctgtcaatgttgtgaatcactattatagacaaatgtttctagaagtttttgagtgtgtgtgacagcagaggggtgaccatgtggcaagaaaagtatatgttgttattactgtagttttgattgtatttttaatagaaaatacaagaggatattatgaattcatgaggaaaatcctatataaagggagagaaactgatgattcaggattaagaggaaacaatagcaaaaggaaatttcttgaggagggcagaggggacagaaactctgcataattttagaaatcacatctgatggtaacaagggtaggcattttcgttttaaccactggaggaactcaacttgcttggtttgcacctatactctgatcctgagtagggaaaggtagaaaacaaggccttaagctttttttgtgtgtgtgtgctttaattaaatcttaatttcccatagaaacattagtcttggagtcatgatcaggaggtaagtcaacatacacataaaaatactcacctatcctttatttagttaaataagaatggacaatccattaatctatttaatacagaactttccaaagtttaagtacacaagtttaaccacttatacctgacatagacaaatatataaataaaatgaaaattcattgcctaaactgatattcaatgagttattacaacatattaggaagagatgctctcatcaagaatgggaaataaaggttacttttcagtcaatagtacagaaagctttgaagattctaaagcttaatgtcttcataaaaaattagccttttctcagattgtaaagaagttacctggatttgtaaagaaaagaagtggtttaattcaacctccagaatccaccaaattgagtgagattttattgtcacactattttgaaattcgtctagttcaagagaagaatagaatttgctcagggttgtaatccaaagaagtcaagacctcagcatatggaagaatcctctaatccccagatgtactgattgatttgtgcggctgcaaatttttcctaacaactagaggcaatagaaaatagatttctggtccctggagccctattaagaaataagtttgcattcagatatctatgtacaaatgcattcatgccaatgtcatttgtaataatacttgcacacagataaaatttaacaatcaacgacaggggaccaatcaactaaatcatgatacttctattaggttatgatacagccattgaaatatttacaaggtgtcttttattaagaaatttcttaggaagtgaggtaaaatataaacacacaaaatatagtatgtttttagctagccgaaaaagacatacaaaataaatatcaaaggtaatgttacatatgcttatttttgggtagtgaaattgtctgtgattatcactttttattcttccctttcagcatatttgagttttcacagtgtgcatacattgctctatatttgaaaaaaaatcattccttttacacataaacctaaatcatgaaaattgtataaactccatttactttttgcccttttcaatatgataattttaaaataagttaaaagataaactcagttttttatttaatcattaatactctgtcaaaagaattcttagaacactttcctttttaaaggacactattcctaggagctaagataactgaaattatattttggttttaaaaagtcaaaatatttaaagaagtattttaatgtcaaagtcaattagagtactgaaaacttatataaaaaatgaatcatttgcaaaaatatttcctcagttttcatacattttatggcaaaccttcaacacttatttattccagatgctaagattaagacatctggtacagtgtgaggaaacactatttaaaaagaaaaaatacattgaatttagttgtgctagtaaccaaattaagtataagaaatgttataacaaaactgagattgtattacatatatgtacttgtcatttaaattgaggcttgaatcataatggcaccagaattttctgtttccttcatctttgattctgactgtccatgtcttgatcattcaaaaccttgaagataattttaaattcaaattcaaaaccttgagagctgattgtctggttcagaccttcaatctgcttagaaaaatgttgtccaaaaagatatattatttgttgaagagcatatagacagtaagggatagaacagacaacttcatcactggactttttgccctcaaaagatcttgtataaaaatcagacctgcttttaaaataaaagagcatcccatgtttccactgctttttatattgtctttacttacatcatcattaagtcaaaagacataaaacaggttttgattgcagaatagtaacaacaaacgttttcccatattgggcacaagtcttcccttggccttgtaatagccacttaacaggtgtggcaggagtactgttttaaggactaaagattcttacagagtgtgaacaataacaaagatactcagagctctgtgggttttgtttatgttttgctttattttatttaagatttcatacttctgagtgccattttttggtctcaagaagtgaggctaaagttgtgttcaaaatttgctacaactcctcaaagccttttgtgagtgcctccttcagacttgtcaactgagacagttcaccagttataacatgaagtactgtctttactcccagccttcttcctttcccggctttcttccttcttcactcttgtgcagtatagaattgatgttgtgacttgggagactgaaacctccattttgcaaattggtaatatgatttaattatctatattgctgaaagccattgagatacagggtgaatttctaatattcggtaagcatcattcaaatattttatctagatctccctttgttgaagaaggaatacttattaatctggagaagttgtggtagttgttgtttttcaaatcttaattaagcactattgcctttttgtccttaaaagcatatggggagacagttaaatgagttttcaatgaaaagtgagctgatggctcttgtttagtacaaggaaaaccgatgagctgttggaagagttagaagccattaccagagataaggctctaaattaaagctgaactataaacttcaaaattgagtaaggaaaaaaaggatgggagaaccattacctatctaattatgatgcaattcagtggcaagtatgtaaagtttatttcaagtactctaactataccagcagaagttgtcattgcacataattgtttcattagttatgacttgtaaacacatggaaacatgattcaactgccccttttgcagtcaaagaaaagtgtggcttccctgatgaagtgttgattccatattgaggtttgaactgacaaacccagcttatactgtactttgaaatgctccaagcccagatttttatttttttaactacccttgttttaaatatctttcaaaaagacaacgagctaaataaccaatctaatagatagatagtgatttaattaacctcaatgattaaatctgatcagttatttagaatacagtcattcatttcctggacagggaaatgtaaatataatctatagtttttcacagaaataattttgttgttgttgttgagacagagtctcgctcttgcccaggctggagtgcagtggcgcaatctcggctcactgcaagctccggttcccggggttcatgccattctcttatctcagcctcccaagtagctgggactacaggcgcccgccaccaagcccagctaattttttatattttttagtagagacagggtttcaccatgttagccaggatgatctcgatctactgaccttgtgatccgcccacctctgcctcccaaagtgctgagatcacaggcttgagccaccgcatccagccagaaaaaaattcttaagactagtaagaagacagagaggacaggcccaagataaaaagatagagctatacatagggacaaggaggaaacacagtaagtcttcactttagcatcaccctccggaaaaaccctgggctactttcctttgctcattccaggaggatctaatttagagtgtccttctttgctcattgggcgcttgcttccaaggaacgataatggacggaaagagatgtaaccactagcctgggaaatttatcactgaaaaagggcaacaagaacgtggacactaatgcaggaagacaaacaaacccacgcagccaccaagagactagcttcaagaatcaatttattcttcccattctcattcacctcatgggggtcaagacaacttgactttaataatgcgattttcaaaccacttacaaatcacgcaaactgtggtctttctgatacgctcttaggagagggactgtttttttgcacggagggattagcaaatccgactgcatgtatgcttttgaagcagctttaagttttaaaagggaaaggcttccatctactggatactttgagtaataaagactatgagaatccacatgacagatttccttttgtgccggcaatgcataacctggcatgttcacttagaggttttgtaattcttttaaaatacattttgttggaaggacgtagttgttactgaatacgttcagcttttacaaaatacaaagcccacaatatatcacaaaagagagacaaaaggaatatataatttgcccttcttttcatttggaaacaattggatggaacagttaaatacccaacaaagacattctatttgttaagaaaatccacaataagcatagctttaactggaatatgaagatggttgaaacagaatggggtgtttcagtcacctcactttttttcttttctaaaaattgtattacttttaatgagcaaatctcatcttcattagagtctgcctattttgagttcagctacttctatttaatgacacatatttttgctaatatattgcattatatagtcagataagaacacgggtcttttcctgggcatattttgtagatgggatacatttgagctaaatcatgtaatctttgttcaagtcagcacataaagataaaaaatcttttttccagcagatagattttttaaaagaatgtaagaattaatgcctttatttaaaacaaatttagttaataaattttttaaaagtacacagagtacaacattttagtgtctgagtcttaatgaaatctcttaaatttatatagaagtcaaaattaatatcaaaattgtactgaatatcttttataccaaagaaaacaagcaaattacaggttaatagtgtcaacttttaactatgagaatattatggcaaaaaggacaaaactgaaaaatcatgagaatttttttaattcaaactcattaatatgtaggacagtattattcgtggattttccatgtttccataaagtgaggttgaagaaataaagcagaaaaatcttaagacttgccccctaaactatagtaaatatctaaggatttgcagatgcgttctctcagctttataccttcctttataaattaataaatatataatccctcacacctagaaaagactaagtcttgctaaagcagattcctgtcagggttactgtagaacttattttgaatattcttagtaccagaacctggaatataatacaatgttaggatctacctagttcagatatatctttataattctacctgcaggattacctcaaaatagtatttttgaaaacagtgaaatgatgtgctgagaataataggcaatgtaaattgttcatatttaaatatatattagcttggtaagtatatacaacaaatattaaattacagaagatactatgataattcctctttgataaggacctaaatcttttcattcagtgatatcttttctgggttgtctgggttctgttcattgtcttttttgtgaccaagcttttttacacatttatggcccatgctgattgacaatggaaatgtttatttcatttttgcaactgaaaatttcttggcatttacagaagaaagaaaagaaagaggatggaaagaaggcaggcaggtaggaagggagggagggaggaattagccttttctttgcacttgctcctctaactaaatcaagcccagaacttctaaatataacaataaaggaagaaccgctcataggctttagtccatacattcacctcaaattattcaaatgagacttcgctaaagcctaggggagaacacaaaagaaataaaaatgaaaagttacattggcgtagttaatctgacttaaaaataatagttcattcattcatcatttattatctaatatgtcccaggcattcctctaggtcctagggatctagaagtacatgaaacagacaaaatattttttcttcattgtacttcccttctagtatgaagacagacaataaataagattatgatagtagctgaggaaattaatagatcatgaacaggaactgggtgaagaagcaaagtcattttagatagggtagtcagagaaggcttcacagaaagagtttagtgttttgatcatatgatgctgtgacctagaggaaatcaaagctcaatctctaaagacgtgccacccttttggagtgcattcctttttggctggattatcttggctttcttccttgtgactacatttatatgacccttgtccttatggagtgcccccaacctcatatacgctgctcagatttcagacccacagactattttaccttaagttccctgtctggagaacgaacacagagaacgccaattctctgtaaaggaaacacaccacatttaagtacaacccacattcaagaggttcactgggatcgcaggaggaggctgttctgctatacttgctcaatattcagattaagaagtaatcatttatcacaaacgttactgagactccttggttgactatcttaggaatgatttgagatgtgcagccttgtgccttcacttgagacaataaggaaatacgtaactaatattttaagttagggagaaggactcacttccacacctcctgctattaggaaacgcttgagctctaggaaatatatttcaaaaccattatccatcttctctgttgtaggcaactaatgtaatgtagtttacacatgcacagaattgcattttattctgcctatgtttaacaatgcagaccgcagattggttgcaacaatttgctgtcttacaaaagtatgtaacaaatgtgaatttttaagtcacagataatttttcttcgcacccattgaccaacctctcacattcctcccctcccgattctctggtatcgactcttcggctctgcttctattaaattttttttttaaatttcacatatgagtgagattaaccctgatttgatcattatacaacatatatagtattaaaacatcaaatcgtaccccataagtatttacaattacaatgtgtcaatggaaataatataaatatttttaaagatacttttccttgaatgaacaattgatctgcaacattttgtcatgatgcctctactttggcttggattgtcaagactcttctctcttcatttaaaatttgataaactgtgactttaaaatgtttcaggcccagtctcaaggaaatttcctgttacagtacgtaaaatgaaaccataataacggcagtaatttcagaggacatagaatatgtggctagaaatacataatgtgtgcttaataaatgatgctagcccttttaaagcagaaaacaaaactacattaactatgatattaaaaaaactaaatgttatgtcattcgctcatcttagtaaaatggttaaaaattttgtattttcatatgataataaagacatatcatattgactaaggactaccaatatgtcttaataaaataaactcaccttgtaaaatgctatgtagctttctctacttttttttagagccttaaactagattttcataaaccaggttttatcaaatgttcttaacattttcttaatcttactacagactatctttaatagtagatatcatggttatgaagctgtgaatgaaaattaagatattgcttaagtgcaaataattttaaagtaattaatttttggtctattaacattgtctaatagtctcctacatattcaattccttagaaggctgtttgattctcatgtatttaaaacaaactttaaaagtaaattatctagaaactacttaaaatgtaaaaacatactgatgttttaataattaatgagtagtcctataatgtctgtgttcttaaatattgaaactcagcattggtttattgtcaaacagaaatctataattacactatgtagtaactgtacaattttaatgctgttaaaatttacaatgaattctgcaacactgccttgctgagtaactcttaactcagtaaatactgaatcctgggcaggaaaacaattgcaaagttaagtatgcatttaaaaagattaaaggaattaagattactgaaccccatgaaaatattaataaaacacttatcttaatgactgttaagtgaagtagcaaatatcttaatctatgactaaaatcactgaaaattgctttcaaatttttttatctagcagaagaaataaaattaaacttaaatatttctatttatgtctaaaaattcaaaaagtggaataaataagacagtaacctgttattagattatgaaatactttaaagtttttataactgaacaaaaggtatttatcaggtttttgacacgagttaacattctttaactctcactgtgccaaatactttgtatatatcattctatttatttcctcatgataatcccatgaagtattaaaaattatatgttttacccaggagtaaagcaacttataaagggtcatatagctagcatatgatgcacctgaaatttatactcagagggatcattcacatgaatgaaattaataatctaagtctccattgcttcatggttttctccctaatgctttttagattctaggatgacattttggtaaaaggtgatagcatatcttttttaatgtagccttaaatagttatgtgttaatatttccaaaagttcaactcttaaaatatttttaatgtatatattaagaaattaaatgatgacctaaacaaccttatagtcatccttccagaatttttttcttcattttctgggagattttcataagatgaaaaaggacttaatgctatcagcatcaaaagacattccaagtgaaatctgaagacacaaaggggcaacatattgtctatcaatatgtacaaatatgtgtactaaattgccacgaacttggtggctgaaatccagacatatttattatttctcaagagtctagggatggcctagctggggcctctgcttcagggtctctcacatgcctgcaattaatgtgttgatgggggctgcaatctcatctcatggctcaactggggaagaatctgcttccaattttacatgtcagaatttagttccttggagattgtcaggctgaaacctttagtttcttgtctgtttgccagcattttcttatgtggccctctccataaggcagcctacaacatggcagtttgcttcaccaatgccagaaatgcagagagtaaatagagttcctgctaacaagatgtaatataatcatcaaagtgacacctcatcatttttgtcctattttctggattagaagcaagtcataggttctacctacactcaagggcaaggggtcacacctagacataaatatcaggaagtaggggtaatagcctttttagagtctctttgctacagaaaataatgtggaaccaaacaagtaaacaatccttggaaatagccaaataaaaaccactttttatcaataaattcccaaacaattaaaccaggaggcactttctgtaatgctcacccactcttctctatctcatttcccctacctttatatctcagctcaaagatcactttcctcagagaagacttccctgaccaccccttcctgaccaccagtgaatcagttgcctattctttgcatttattctctgtacatctctcaaatacacttgtaatctcacatttgttaatttttgtgtgggctatcttattaaatcctgattaagctgatgaggaaagaaactgtatagaggttttgtggaacattgtatccccatcacctaggacagtgtgtaacataagatgcacaacaaaacgtgagggaaggaacagaggttaaggacactaacctggaagtcaggaaacctagtttccaatgtgggttctttcacttactagctgttctgtttcacccaagtccaatcatatttccaagcctcaggttattcatgtgtgaaaggtcattttctaatgcaaatggttggaactttgatgcaattttttgattttatactgttgttaatagttacatttttattgtattgaaattttttccccagaatcttttggcagctgctgccttcatcttttgaccagtgattttgagatatgcccaaacagtttgcaacaggcaaatttagaggataagagaagtaatgtgagaagcttaaatcaacatttgtaaattacatatattttaagaaacactcctgatgctcttcagagtttgtgcatttgaatgccacagctatgatataattcaaaatgttttcctttcccctagacaaatgaaaacctcaccagaaaacaaactacattacacacatgttgtttcctttcaagatgttggcatcctgccttccccttcagctgcccaatcccctctatggacacagagggtttgttaaattaaatggtagcatagtcctagaccaatgatatcttgaaacaaatataaagctctaaaaaagaagagaggcatgttagaattctctatgtaacagagaactagactattatgtagaagaatattttagcatcacaatagtacagctgacatgcttggcctgctttcatcatgactgaatgttacccttatttagtgattactgagaagttctcataccaagcagtgttaagttcagtttttgaagtgtatcttatgtatgcaataaataactctgcattgttttcagtatcaattctttgacatgaccagtgctagaagaagataaatactgcatgggaaacccaggagcagtatgttactctaccattccctgaagtcatatgtcaaactcatggttattgaaattttcctcatagattgttccacagttaacagtgcacagtgtcctgcgggtaactaatgattctcctgtagccttttccagcttactcatttatagtagtttaggacagaaggggaaaattggttgacagttgaggccatgaatactttttacaattgttctttcaatccacaaataacatgttctcttaaaacgttttttttttttaaatataagtttctactgttcttagtagtgtgtcttaactgagagactgtggttatggaatttgtgtttttctttgttactgtgtggcatttgtgtcaaaatcaccctggtacagaaatgtagataggagaaatggcaagtgcagagaggtggggagcatcagtttcatgtttattagtactttggggttagaaaaatccacgggccaagaccttaaatgatacctctaagagtgcgattctgagacacactggaggtgaggtatagtatgctgctcattgaaaagacatctgagccagagtaagtggttgatttcccacttcgttcatctggtatacaacagaagtacacaatcccagaaaataggctagcctactcttctgttaggagatgatgtacctcctgaggtgcatatacacaagaaaacaacagacataatgggtaacatttagtgagtatttactatgcatgatgcactgtttgagtgttttatatgttaactcatttcataatcatagtagcactcagtaaaaggtgctattattagcactgctgtataaatagaaatctttagatgtcataaagaacattcctgctgaaaaaaaaattatatgccctatgtttacagtctgcctagatagtcaacaattgactattcatagttatttatttccttggtttgagttaacatgttccataatataatctcagatgctccttgagttactaaattgtaacaacaattcacagtagtcttcctgggtcatactgtgttttttctttactaactcataattttaaaacataattagattttcttaactgctttgcaaaacagaatgctgactaaatacagactagaccaatgcactttaataaatattaaaatattactgttatgatattcttttatcaatgaggccaactaatactttgaagccgatttttcataaacttattgctatctatatagctatatctatatacaagagtaatataaaatatatatctgaataagtccaaatcactttttagtaagtgtaggtagtaattctaagacataaaagcaaatatatagagatatatttctaaaacatacatatatatgtgtgtcagagagagagagagaataagacagaagagagggcacatgacagagctctgcaaatagtagttcagctaatatttagagaatgtctactgacaccaggtactgttttaggaactgaatgtaaatacacatatcagcaaatatgtgtttgctaccattgtcttggtttcattaaaaatttgtgattaaaacttgttaatggaagaatttgaaaagtacatggaaggaattatgttttgttcaaaaagatttttctctaatgggatcaatttatgttttgctagtgactaatatttttggttaaatatagaaaatacaacaaagctgtgtttctcaaaatattttcagtggagcactgttgtctcaaattctggaaagcggaaaatgaatctagaaaatgtgaatgcctttggttattcatgatgcactttaccataataaataaagacacctatttaactttgttttacccattctttccattaaaatataagcagattgtaaataattaaagaataaatatatttcatctaatttagactgccatcaattgaaagatcaccattatataatatatctctaagaaaaaattgtttaaactataatgcaaaacttcctttttacctagaattactttgtccctattaaaggaactcttttagacataactaattcaaaaccagcttttaaatcatatgtcattcatgtatatacataaaaatataagcaaaggaattgatcaagcagctttatatttgcaggatgactcttttgaatcacttttcaatgcaaattaactgatgttcatgtgtttcctacccactgtcattctcagtgccattaagaagattgacaatccaggctatcttaaaatcatgattcagtattatgccgaggatattctttcaagtccctgaaaccattcaggaaatttttatcttggtacttttttattttaccagaagggatcaaaggaagctttttcaaacaacaattaagatgcattaaaatgtcccctaatttaaatggccataattatctactgaaactgcagttggctactgattttagagatgggaaaacatatttgcacatgctaaagcagtgacgactacaataaagttgctttctcaccaacagcaatggtaagatatcattgattataaaacatagcactatttcagaaaggttcaaataagatagtatgtggcatataactgaagaaacagttatatctaactagcttcctgcagcactagtgatggatggggcataattttaaagcactttaggaaatattttcgtttgtcagtcaattgcacactgaaatcttctggcttgtatttaattgtcagatcaataaagtaactcattatatatgaattcaagtttgggatcttggatcaatcacactgatgttaggtcagggagaatttgcaacgtgagtcctatcattcaagggatgataattaccatgttctgtacccaggaaaatatttccctttataggtttttcaaacttcctccagtttcatgacccattctagtagagtgaacaagagcatggattttgatattagataaaagtgaacaacatttgaccctacttctgctattttctaagtatacttaataaagttatttaaccattcaaagtcttaattctttcatccttaaaacaagtaacaataataatagataaaaatgctatatagacttaatgagaatgtgtatccaaaagtgcttactatgtagtcgggaacatgaagtcccttaagtaatagtttatctgttgttccagtacttccggtgcctaactaaaccatactactccatggagggatagatgagtgtcctctttcaataatggtccaatatggctttctacattctaaattcttatgatacatgggaagaacatagagggatacctcatcaattataaagttagcaatatttgtcagatataggaagtcagttgctaaggaaaaacacagcttttcctgcttctgagtccacaaaagaaattactcttgagatttctaataaaaacaaaatgcaaaacaatagcaacaacatgtatgataagatagtcaaaggcctcagcataacacaaaatgctggtacaataacaagtttggtgtcactatttttttttgtactgactctcaatatcttaccaagacaccagaaattcagtcttaggtcctgctggttgctgcacagaaattcaatcaccaagacgatgagtattgccagggaagaagacttgaaatcagtgatgcagctgaggagatgggagatagtctcaaattcatctcctcaactgactaaaattaggggtttatatagcaggggaaaaaaatgtaaccatgtgtgggaaaacagaataagggaggagtaaagaagtggagttgatccaaaggaagcaggtggtaagtaaggcaatcatgatgggtcagtggtctgtaatctcattgtccatatgtggtgatctggtaagtttcagttccttgatactatctgggtggcctgatggttggtttcctgagaaagtactcagataagacaaatataactttctcaagtttcaagactgggagggtcagtttttatgcttattcaaaagaaatgataagcatcagttctgtgggacaattggaccagtttcaaatgaaaaccaatatcataattccaaatcctcatttagacttgataggggtcaagataatgctgaaatatacagctatatattagactgagttaattctagataaaattttgatagcctgcagactgttcagtctgtgtttgtctcaatggatatcaaattgttcttttattttaaaagactactgcaaatactcacttttcttatttcccatattctcaatgatcttggaccaagcatttgaatatgagatctttattgtcacactgatctgaagtttgaggtaattgcctagaaaactcagcctcaagacctgctgtaacttttgactgtggatattagagttaaataaattgaaagttgtctgataatcctcttcctgtgtgacagctctgtgcagaagctatgattttgtaaaattcattatctcatttttactccattaaaataaaattgtggtaataatagtaaatgataaattcaacacataatcactatgtattattagttggaatagtcaatcagccagttaatgtagttctgtccactgacatgctaatgagaacttatgagcctgggtaatttgtatggacatagggaatagataaaaaggtagattaagggaatagttttaaatttaaaaacaacaatgataattccaagaaatcgcctaaacctctgaaacaatacagtatcatttatgtacttacaggcttattcatatttttaattgacaagttttaacagtaatcataaggcacaatgtgatgttttgagattacacatacagacacaaacagtatggaataaataaatcaagctaattaacatagccataaccttgcttacctattatttttagtgataatgtcctagttatttgaaaatacacaatgcatcgttgttgactatagtcacctgatgagcaatagatcccaaaacgtgtttctcctatctgaaattttatagtctttgattaataactcctcattcctccctcctcatgcctgtagcctgtggtaaccatcattctattctctacttctgtgagtacaactgtattagaatctacacataagtgaggtcatgtggtatttgtttttctgtgcctggtttatttcacttagcataatgtccttcagcttcattcatgttgtcaaaatgatgggattttcttcctttttaaggctaaatagtgcttcattgcatagaatacaacactctctttatctgttcatctgttgatatacatttaggttgatcccatttcttggctattgtgaataatgctgcagtgaacaagcgagtgcagatatccctttgacatattgatttcatttcctttatataaactcagaagaggaattacagtgtcatgtggtagttctatttttagttttacaaggaagctccataccacttttataatggctgtactaatttatatttccatcaacaatatctaagaattcccatttctccacatcctctccaacatgtgtcttttatatttctgataaaagtcactctaacaggtgcgagacgataccttattgtggctttaatttgcactttcctaatgattagtgatgtaagcatttatttcatgtgtttatgggccatttgaatgtcttcttttgagaaatgtttgttcacgacctttgcccatttttaatcaggtgttctcttgtttttgagttgagttcctcatgtatttcagattttaatcccttatcagatccatggcttacatttgtaggctttctcttcactttgttaattgtttcctttgctgtgcagaagctttttagttggaaaccatcaaacttgtccatttttgcttttgttgcttgtgcatttacagtcaaatcaaacaatttttgtccagacaaatatggactatttctcctgtgttttagtacttttacagtttcagatcttaaatttaaaattttaatccattttgatttgatttttatatttggtataagataagaataagatctaatttcttcttttgcatgtggatctccagctttcccaataccatttacaatttggtatttagatgcaatagaatacaataattgctagctggattaacaatggcttattattatattattttaaaaaggagaaaaatgcagattcttattcatgaagttcataattacaattactgagagtaaataacaaaataaagtccactttctatttggaatttagaaaatatcacaaaaaaattattagcttaaactgtatatactggtctactcctgtaatgtgaatatatatcattaatatgacatacataacaaactttataatcaactgcatagttttgactgttaaaggtaaaaaggagctttatctcaattttttattatttcatatattttaattacaatagctgtataataaacattcatgtggcttaacatttttccatattcttacatagacataattattttaatacgagagttgtattttgtcaaccagatataactttgatttgcttaagcattctttttgttttgttttgtttttgtttttgggggggtggttttttgagatgtggtctcgctctgtcacccaggctggagaacagtggtgccatctcggctcactgcaacctccacctcccgggttcaagtgatactcctgcctcagcctcccaagtagctgggattacaggcacccaccacaactggccagctaattttttggtgtttttagtagagacagggtatcaccatcttggccacgctggtgttgaactcctggcctcaagtgatctgcccacctcggcctccaaaattgctgggattataggcatgagccacagtggccacttaagcattgtttattgaataaaaataatttcccttttaagttatgctgcaatatgtattcttgtgcatgaaattgtaagctttggcatgcattagggtattctttcttcaggtactttgattttagagagacagaactattagacttactagacatctattaggggaagaatttaactgaaataattattatcattgaaatgccaggggtttggtctaaggcccattgcttgcctcacagaagtccaatccctgagacaatgagtattgccagggaagaaggctttaactgggtgctgcaaccagggagacaagagagcagtctcaaatccatatcctcaattgactaaaattagaggtttatatagcagcaaaaaaaatgtaattatgtgtagggaaaacaggaattagtgaggggtattaaagaggagctggtcaacaggaagcagttggttggtttaggcagtcatgatgggtgagggggtctggtgtctcactgtccagatgcagtgatctggtaagtttcagttccttcaaaatgtctgggtggcctgatagttgatttcctaagaaaggaacttggataagacaaatacaattttctcaagttttaagactgagagggtgaatttctatgtttatataaaaaaatcataaatatcagttctatgggacagttgagccagtgtcattatgatcttccatctaatatctatttaaaatttaaaacatgatttctctaaagagtgaatttaatactataatgcaatagacttactatgaataaaagacagatttttttatacttaaattcagggtgcatgtacagatttgttacatgagtaaacttgtgtcaaggaggtttgttgtacagattattttatcacctgggtattaaccctagtacccattagttatttttcctgatactctttctcctcccaccctccatcctccaatagactacagtgtgtattgttcccctctatgtgtccacatgtcctcatgagttaactcccacttataagtgagagcacgtggtatgtggttttctgttcctgtattagtttgctaaggataatggcttccagctccatccatgtccctgcaaaggacatgatctcgttcttttttatggctgcatagtattccatggtgtatatataccacatttgctttatctagtctatcattgatggacatttagctggattccatgaaaagacagcttatttaaaaaaaataggagcccataaattttatcatttacctattaatgaaacctgcaaacctggaattaattaaaatactcttttgttggtactcattatgcatctttatttcattgtcaaagcctttacatggcttttgcaagttccattgaaagacttgccttaaaaacttataaatttttgccacagcgtgtgtcaccttctaatgtatttactgtttatttaggtctttctccagtagaatataaactccatggaggaagataattttgttttgttcacagatatatcccaagtgcctagaaaagtcccttgtacagagcttgaccacagtaaatatctgttaccttaatcttggcttggcctctgctgtctatctttagatagtcttctcttttacgctcacactctatatctttccatatgtggatttatcttacttctatattggtgtcactttcataggcctttgttgtatggtagccccaaaaactccaggcttaactcatctatacagctacccagttccagaggaaatagagtttcaactttctaatagccctagtgtattctcaagggtatgcttttattaggctgactggtttatttgcccattcctgagtcagtcattgttatctgggttatatgtaaggaattgaaatagaatgctctagttattttgggtgctaatcaaaatctggactgagcaaaagcaggatcccttggagcttgttagaaatatggaccctaaggcccccactccagaccaactgaatcaaattgcatattaactagattttctggtgatgtgcctttagtctgtgctcacagatggaactggaagagtggggaaggcaatgaaaccagccccatccaagctgaaagtgaagtgggagtggtttcccagagaaactcaagtgcttttaccagagggcagaatggatgtcaggcgtgcaaaacaacagctatccaatgcaatatatgatgtgtattaagcaattattatattccagtcattgtactaaaccttttccaggcattatttatttagtagtcacaatatcttgtaagatattatcaggtaggataccttatccttcaaaaaagataactcatcatccaaagtttttgttgagaaggcagtgagcaaagtgatctgaaatatgatatcagatagtaataagtgccatggaaaaaaattaagcacgatagagggataaagacagacctaggaagatgagagaaagtgatcaattttgataggaaggtcagaataaacctgaagaagtaaattttcagcaaagacttggaccaagtaaagaacaactcatgaaagttgcagggtaacaccattacagacagaaaaaaagaagtataaagccttgaattgttgaattatgaatgaacgtgggatgtttgaagaaatgtaaagaatgaaaaaaagtggggctagaatgaagatgttactgaaacacaggggttctgtctgtgtcctgctgcttgctgcactggaagtcaatcaccaagacaaccagtatttacagggaagaaggctttaataggttgctgcagccaaggagatgggaaatcagtctcaaattcatctcttcaactgaccaaaattaggggttgatgtagcagggaagaaatgtaaccatgtatgggaaactaggaattagggataaggaagaggaattgatcaacaagaaacaggtggttaggcaatcatgacaggtgagggggtctggtgtctcactgtccagatgcggtgatctggtaagtttcagttcctttatattatctggttggtttcctgagaaaggaacttagatgagacaaatgtaattttctcaagtttcaagaccaggagggccattctttcatgtttattcaaaagaaaccataaacatcacttctgtgggacaattgggctggtttcaaagtgagtataaatgaattcaaaaagccagccaagagctattttctaaaggatcttcaggcaatggttaagacagattcaattattcttagtgttatggaaaatcacggtacacttttggtcaggggagtaacatgatttgatttgtattttaaatatattgactaaggaacaggcaatagtgaataaaatataggtagaggaatgtaaaatgttttggggctagttaggagactattgcaatgctagtgtaagcaagagataggagaagttaggaccaggatggtaacagtagagtggctgaggatatattgtgaagtagagccaacaggaattcctaatgagttaaaaatgtatatgtgcgagagaaagaaaattatttgtttttccttgagaaaatcagtggatatttgtgctagatactgaaatgaagaaccttggagatggagcaagttggagaaacaaatttttgacttgtcaaatttgagatgcttagtatagatcccagtaaaattattgggtaaacaattggataacctactttgaagaggtttgagttgcagataagagtttggggaacaagtaagattacatatcaaaccatggatctgaataatctaattcaggctctacagtcactaaatcatacagcacaagaaaagtctctccatcttgtagctgcacccactgggatacaagtcctcctcagtccctgtggcaaaggaaaagaaagctctcatacttgctttcctatctttaaaatcagaagtgacataacccctttctctcacagtttgttggccaggaccagttagatgtccttacctaactgcagggacctgagaaatgtggaggagtacatggagtgtttgtgaggactgttgtctcttaatatgtctcacttctaagaagaaaaacatggattcagagagaaaaagccattctcaccaaaatgttaagatagcccaccatatttttttgtacatttctaaaggtaatttagcataattatctaggattagaacaaaagcaagttgcagtggaaatgccagggggcggcttagaggtggcaggataagaaggcttttgctttattcagtaatctctataattccccattagccactttttgccaaatctgaagtggacaattaatgttttctctgacctcatataaaatggtatgcaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaaaaaaaggtatgcaaatgaaactttaaattttcatttcaatcagataactgctcagaaaaaccttctaggactttatcttttagagcagaggttggccactgtgacccatgtgccagaaccagctcactgtccattttttaatgacccaagatctgattttaagtacttgaggaaaagtcaaaagaatagtatttcatgacgtgaaaattatgtgaaattcatatttcattgtccataaataaagttttattggaaaacacatgcacaaagaaacccttctaggaagatgttatggagccagaactaccaaatcttaacatgatgaaaaagggaggatgttgatattaaataagccacctcaattaaatccacccacctcaaaaatgaaaacagaacagtaaaattgactattgaattaagtcctctgaagatacagtgttttgcctccccaccaggcacaatgtcatctctttatatgattttgaggaaaatgtattcaattatttcaactgtaataatacttaacataatgagaaattcttctagtgatttatttttgtaaatactaaattgttttgagcttcttattttgaaggttgcattccggattggaagttctgaatagaattatttcgaaagcaaatatttatctgtttaaaaagcccaaagaccttgttttttctgcccaaacaccagctaggaaaatcaatattttctcttggaaggaaatggtttggctgcttcagcatcagaatgctttctaataacactatggcatttaattttgaaaaaacaaaagttctgaagagacaagaaggtcggagctagtgaatgatgagttttgagtgttgctgctttggaaaatagtggcttggtaatggcattagttaaagacatttagattgtctaaacacttgctctattttagacaacaattggctggctttgttacttggttgggatagaatatcctaaatactaggccattttgtgccagcatgttgcatagtggccttaaagaagaaagttaaacattgaaatattttcagaatattctaagaataattgctgtcttgtcacagttattacttatttcaatcaaatgccaatattaatattgagcaaaccaagttgtcgtaaaattttttataaaaattagtagcattattattcctcaactagaaaacattcttttctgattttcagtggaaatattcatttaaatatcaaatattctattatgtgaaataaaattaatcatttttcatatatacatgtgaatatatttctgttcatttgtttgttagtttctttacacttagatatttgctaactttttcaaggacaatggtagcttagaataactcaataaatcaataaaaattaagtttatggtaactagatagaagttcaagaaaaagaacatatgtacagtctattacgtgaattattctatataaatttcgtataaaatctacaggtggtgaataagtgactctatagggaaagtgtgaatattaacaaaaacattggcactactagaattttttattaaggagaaacagacatattacacagctcagttaagctttgattatgagatactaaataccaatttacatttagttaattaattattcaatctaagtagtacaagtacttggtgataaatatttgtatttgaaaagtcataaccaatgggagaagtgttatttatatctatttaatgtactaattcgatggtagtaaaaatccagtggagtagcagctgcatatgcaattgaatttgctggaattatgaagaagaaaactgatagcaaagtaaatgtagtaaaacagtactaaaacaaaaatagcacaaactgatttgtgtttctctgaaaaattccaggtgttgtcaaagtggattatggagatgtgtcagtcagaaaaacactaagagaaaatctgaagtgtaagcccttttcttggtacctagaaaacatctatccggactcccagatcccaagacgttattactcacttggtgaggtatgaattatttattttggttaagttataaatatattttgcaaatggagcaatttctaaggagctcagtattttttatgttatgaaaatgctgtaagggatttttaattagatctgttttaaacaacttctcatatttcaaggaccatgaagtcttcatcataaggaatcataaaaatgagcagaaattttaacattgaacaaaaaaaaaatttttttaacagttctaaagcttttggtcatttacgttcttaaaatttactgtgtaccccaaacaccttttgttcatgtgggttacaactgttattaatatttactgtatttaaattaaaactgagaactttaaaacccattttttactaattaaacgttatataataaacaattacatgttaatgtaagtaacatatttttgaaaagttaatatattttttccaagcaaaatcaagtaatgataagagagtaccattgattgtatttttgtaaattgcattaatgtctggcttaatagaagatagctggattgtcatatgtgcttcggtattccatctattgctgcaatacaaggcagtctattacaatagcctctagaaaactcttatacactcaggagaatgtgaaagtgaaaactgcaagtaatatcttggtactataacaaaagtggtattgacgttgtagacactctgagaaccattgatctgcaccattcttttctacatatctattttatcttgaaatacaaaaatgacttcattataactatacaaactgtatataatgtatgtataatatataatatattcatactatagataattatatataatatattcctgtattcatctcatagattgatgattatatataatatattcctatatagcatatatatctcaattggtcaaaacaagaattatatttcctttatgaattatatcctccatattgataattttccactgaataggaatcaaagctaccttaatattggttgtgattaaagcatttcaagagcaataaataggccgggagcagtggttcacgactgtaatcccagcacttcgggaggccaaggcaggcggatcatgaggccaggagatcgacaccatcctggctaacacagtgaaaccccgtctctactaaaaatacaaaaaaaaacttagccaggcgtggtggcaggcacctgtagtcccagctactcgggaggctgaggcaggagaatggtgtgcacccaggaggtggagcttgcaatgagccgagatcgcgccattgcactccagcctgggcgacagagtgagactccaacgacaacaaaaataaaagcaataaatatgcacttaggaaataattatcaagtaaacatattcttagatttaaaatgccattgttgtagaccataatggtagaatatctgaaaatgtatatggtttaatctaatacttttttgggtcatctgccttaatgctctgtaactttataaacatatcttacttacaattaactagaaaaaatgaaagaaaaaaatacttgaggtgactggaaccctagctgaatcgtttttaatgactgatttaagtgccatattcatgccttattgtccaagtctccacttcctcattagccatgtaaatatctctctatagagcttgatttacatatatttaactttcatctgaataatgtagtgaaaaatttcatgtgtaatagcattgattttaccactttctaagtgtatgactttagactagtcacttagtcccgtacctcaaagtatttttttgtttgtttttattggagaaggaggtattgttgctatcattttcaaatgtgtaacatcctcatgttggcactgatctcacagggatttatatttaatgcagaaaatatactacagtgctttttaaaatagaatagtctttgcatgttagttattacaaatcactgaagatctctgataaaatatttaatacccttatcactttattgaaaatttgtttgaacattcatgaacctgactatatcctcagaagaaaggagtttttctgttcttcttataaaatgtttctgtcactgttgtcagtggacccaaatcattagtaaacatcgattcccttttctaaaaggaggaatgaccaagggctataacaggacagaaatgagcaaagaggacttttggaaatcctctggggccaccaaggtgactcctgagaaagactcagggctctgtaacagaattagatgtttagttccaagttaaaaatccaattttatgctgtcctgcactatatcaaggaaacctaattcactttctaaaatgtaaaaataaaatatagtgtgggcaaattcctttgtacaaactactgatttcaaattagctatcttctaaatggatcaggtgaccatattttaatctgtagaaatactttaggaaaagattttaaagagaggaattgagcctttcatagcatctaaaagaggcagtatggtgtattgaaaacattccagcccctgaagtcaagcataggagggttcaaatcctagccttacagctttcattttgagtggcattaagtatcctctctactacctctgtcaacagaataaagataataatactgggttatagtgatgactgaagacataaaacatctagcccaatgcctggcaagaatagtagcctaccagtagttacacttattatatctaccatttattgatttcctatgccaacagttattctaggtgctttagatgaattacgtagaaattagaacaactttcatgacttggattttattatcgcagggttaataaggaaactgacacacagaaagtttatgtgcttggcctataggtcacacagctagttaactattgaagttaggataaattacgtgctagtccaacactaaggctcactttttcttataactagaaggagaaatagatgattttattatattttaatcattcaaaatgtttttattaaataactaagagcatgaagctgagtgtgttggcaggtgcccatggtcacagctattcaagtggctgaggcagtagtatggcttgagtccaggagttcaagaccagctgagtaacatagtgagaacccatctctatttaataaaaataaaaaaagaacttgagctatgtcttagtccattagggctgctataccaaaataccttagattgggtaatttataaataatataaatttatttgtcatagttctggagattaggaagtccaagatcaaggtgccaaccgatttagtgtctgataaaggcttctaggatggcatgttgtcactaagtcctcatatggaaaaagaggcaaatgatatatcctcacatggacaaaggggcaggacagctcccttcaacctcttttataagggcactaatcccattcataaggatgaagccctcatgacttacacacttcctaaaagtctccacctcttgaatcttctgattcatagttagacatgttatctcttgggccactggtcctcttggctgcacctcttaataccactacaatggggattagatttcaccatgaattttggataaaggcattcagaccatatcaaactaaaccttttgttatatgttgaaaatacaaagtcaaataaggaaagacctttactcttaagcctttctaccaaaatagggatgcagaggtgggtagggcaagagagaatcaaacaagtaaagaaattcagtagaagtaaaagatgccctgcatgggttatatggtataacggctgtttaaaaaacctgatacatttaacagataaattaagttctgtgctttctggagtattaatgtactgtagttttccactttaaaactagccttaaagaaatgcaatccagcatctgtttccatggaaacagaaggacaaattcaccaagcactacctcccaattcaattttgcatggccacgtatacataatttaagatggacattttgataatgagttagagttgaactgttaatgaacaacagtcattttctaaagctttttccttcttactgcctgttattaacctttattggaaaaatgtaaaaaggtaatctttccttatgtataaggcactttctcttaaataattagagtcccaaagcaatatcaggtgttcaagctacttgccatcaaaacaagaacaatatttctttgcagtatattcatttgtacttctcactgaatttgaaatgaaattgggtggctttaacaatttatatatttttaacttcaatatttttcaaactctatttgatattgctgtgtattggtgaatataaatgtttccttgtcaatttccttttataactttccttgctgtattggaatatatagaggcaaatatggtattcagtttttctattatataccatcaccaaagtcaatagttattgatatcagatatctgtatcttaatttattttatgtttgcatcttactcaagtaattgaaatattactttatccagcccatgaattacatgcagtttccaatgggaagttaaaagctgtgcaattgctttgaactaaaacctttaagtaagttaatgaagcatgtgtcttttagactcagtaagcagatcataatggaataaggaagttgagctctttgcagcattaaattctctcttaactagccctgaagcttatgtagatttaacatgctcggttctgatcttgtaaatttaagtgtaagattgaaagaaatggcattctaaaatagaatgtctcagcccaaatttttgggttatgacaggctttctgaaaaaaaaatacattgtgaactaaaattgaacacaatctgagggcaaatgaaggagatgaggatttcaggagccaagtgacaactcttggtgcttaaaatttgcatttgcatgttgctttgaagatgtttcgacattagcatatgcattttgtattgtgtacttaacctcggggtttctttttcctcttgtatcctttagccatagtaagtagttaaagttcttgcctatattggtattgtatgccttaaatattgctgaagagcaaatttacataatggaaaatagacatccatgaagctgctaggctgcagagattaagggtaaaatcagttactgccaaatgcagaagctaaaacgcttaaaagtttaccctttctgttggtaatcagatctatttatagattcacagtcttcttggccctttaataggatgaccagcaagaaagccttattttaggtgacttacgtaaatgcggacatttttctgttcattttatttccaaaattcttggggactcagtagctaatttttatcccagggtttctgaatatgtgtatgtgtaaggagaatatgtcaccctttattggatggctaccttaaagtatgttgggctaggcaactcacctgtgaacaaagtgagctatttttattacttgaaaatattgtatttttttaacttcatatttctaataaactaaaattcattctaattttattacttaaatgtgtattggcagaaacagctgcaacaaactatatgccagtttggcatttattcaattctctcaggattttggttgtcactgtttttgttatccaccaaataaattaaattgtttattttgctatgttctttacttttggggggaagggatttcagatatcagataacaataatttttgaatctcacagtcattaatcaaggaccttctaaatccagttctccataagtgaagtcaacttgaattgtttcagtatacagattttgttctcatctttctgatttattcacaattagattaaacagaaaatatgctttaaatgcatatccacaagagcaatcatattatggaaatattaacattaagctctggaattcactgcaaatgtgcttatttctgtctttacaaagaaaagagaaaacaaatgaggttgacatttgtaaaataatgataaaaaataatatgcaattgaaggataaacgtatgttgggataattaaagtaaaataatgctagtttaagtttagactgtcttatctttagaatggattttctatgagtttttaaaacggaaagattggtggtgggggcgtgggcagtatatatctctctcttttagaaatggaattctcattgctacttgcttttacattccagcagagggagcaaaagctagtgaacaaattatataagtgatacgaacactaccaatgatgctgcaatgcacagaaacatttagaaaaagtcttgctgatttcaaacatcaaaacacaagggggaaaaatgccctcaagtttgtgtcattaagaattgttttcaagcaataaaagattatgtgtaaacatagaaatctcaaagcagacagccaattaaagttaaaactatcttggccttgtgccatatattcaaacatatgtaacatatgaatgagtcaaaaaagtttaccagatcttagagctaccagtgtgcgctactattttgattcaagttctggaacagactttgtgaagaatttttaatggataaagttctttagttgttggttgctttgatttttctcaggattaatgacatgaccaagccattgttactgtcaggtaatatggtaccgttgacaaaattgcatcttttctgaaattttacttcttcccttgaacaacattctttgtgagtatatatttgaggtctcaaggtgttcttagaaaagttctgattttaaaattatacatgatcatcctaaatttgattatcctttacatctcaaaagatgagatccatagtttcaactctcccatatgctagtattgagatacatgttaagatttgtttgttaagaattgttagaaaacaccagtgaccatttttgtattttgaagacaatatagcagatgcctacagggttgggctcgctcactcgggaacaatttatgtgcttctatctgccccctaggtgtgcatggctttaaaaaaaatctgaatattttaggcctagtgataaaaacctttcagattttaggccaggcatggtggtttacgcctgtaacctagcactttgggaggccgaggcaggcggatcacttgagatcaggagtttgagaccagcctggccagcatggtaaaaccgcatttctattacaaatacaaaaattaggcagttgtgatggaattccatgcctgtagtcccagctaattgggagactgagacatgaaaatcacttgaacctgggagttggaggttgcagtgatctgagatcacactgctgcaccccagcctgggtgacagagctggactccgtctcaaaaaaaaaaacaaaaacgaaaaaaaaagctttcagatattgtctctatcccaggtgatatgtccctcttatttgtttaagatggcaactgatatcctgatttcctgacactctgtcctccacactgcttatctctcaggtcaccctggacatagatagaaattatttgcctgacctcagctcatcaggatggcactaagcataaagaatactttgtttttaggctttttgacctggtcccccaggcctaataccaggttgcctttatgtatcttttttcatgtgtcttcacctgttgtctagataacctctggttagctctgtttaagcagaactgagtcctcccttgctccttccaggcctccgttctaacaaacactgcctccctgtctggaagtcaggactggcaattcccagactccatagaatacctttacgttttgttttggcaaattagttaacctctctgtatcttaatgtttttgtttgtaaaacgggagtaataggttggcacatacaattcaaatagtttctaatttatattattattatcatcatattggaggtggtagtggttgtctctcttttctccctgtggcaggtttcctaaaccattgactcctgtctattgctattctcccagattctacatccagccagacttgacttcagttcctattttgtatccacttagcacctgctgcattctgaaggacaagtaatattacacatccacaaactacaaaaccacattgaatgtggagtagttagaatgtgccagaaataggataggcttcttttcatgcagtccccaagataagtctattctggaattctggaaaaattggtggcagcaatgacattatgtgtgaatctctgaattttcccattaaaacagaaaacgactagaacagcaaaacttaaaagaatgataaacaattttgacaacaaatttaggtggcaaagtgttctcacagattctcaaatatgagctgacattgtcatgacccagatgatactacaatttttgtaggagacaacagaggaaagcaatgaggtatttgatggaaatgaggtcaggataacacccaattttctaatagatactcatgagaaattgtttcaggccaattggataatagtagctgaaaatgggagaagtactttgcaggtgagaaaaaaaactcctctctaatatctgaagggtctgaacagtctgcagtctgtgaattcttgaaactcactagctgaagctccttctcagaagacactttggggaataaagcccaactagagtgggaggaaaaggaaatgaatggtccagattaaaatgggtgaggtaaatggggtcaggaggtctcaagaaatagaagggtaatttttttttttaacacttcaaaaactacagaaaaaggtgttccatatttgtgaaaatagaaatggtcttttgatcaatcatttccccttaaaagactaggaaaattgatcttatgcaaaaaaggaaagaaggaaggaagaacaaaaggaagagagaaaagaaaaactagaaaagcatgactgatgtaagaaaaagatagtaagaagtagaatggtatctctgcaaacaatgcaagcacaccagtactttatgctcataagacagaggaaaagtgtaatctaatatttcaaaagatgctaaaataaatgctctaaatgatagaatatagaaaagaacaacataaatttagaaaaactgaaatgtgcaagtataatgcaggaaagaattagaaatcaaagactaaatcatttcagaaatgaaggccaaacttgtaagaacacatgagtgaataataccgagagcatgccataagaattttagaaaagaaaaaggagcaactaaaaatataaaaattggaaactaaattgttcaattgaaagtgacacatatagaagataagcaacaagaccaaaaatattaggatttcctaaagagaaaaaccaatgaaataaaatgaacattaataactataggcagggtgcagtggctcacacctgtaatcccagcaccttgggaggatgaggctggtggattacctgaggtcaggatttcgagaccagcctgaccaatatgatgtaaccccatctcttctaaaaaaaaaaaaaaaaaaatttgaccaggtgtgatggtgggcacctgtaatcccagctacttgggaagctgaggcagagaattgccaccactgcactccagcctgggcgacagagtgagactgtatctcgaaaaataaaataatgactataattccgggaaacttttctgaaaataaaattgcaacgatattgtgaaaaggaacactacatccctgcgagagtgatccataatgagtaatgtcaagatacattgtaggaaatctcccaaacttaaaagataaaaaaatcagtttggcttcgagggaaatagatacttgtaagaattaagagggggaaaatcccagattgtcatcagagttttcaaaggaatcctttactctggaagtaaatggagtaacatttaaaaggtagtcaagtttggtgagtcatggattttagatctatcaaagtgattttcaagtatagcagccacagatatatttatcaacatgcaagaactcaagactattgttcctggtaaatagaaatagcatttgcccactcgttcaggcccaaagcttggcatgtttcttgatgtctttatttgtcttataactcacattcgattcaatggaaagttccagtggctctaccttcaaaatatatctgaaattggaccttccacccccattgttattctgttaatcaccatcatctcttgctggcatgactacagtggccttcttccttgtttctctgcttccagtctttcctccctctaatctgctctttgcacagcagccacaataagctactattataccatgcctatgctaaaactctcatgattccttacattacttagtctgggatacctctctaacctgccccttgctcactgcagtggtggtacaaggctagtccattatttcactcagtactgtccaactacagggagcatccatttgctgttcccctgcccaaaatgtccttccatagatgaaaatatggttgctctcctcttcattaaacgtcttttcaagtgtctttattccaactgacctttcctttctaaaatagtaccatctccttcactttatctacccttacttactgtgctttatatttcttcacaggacttcttgattttctgacatattacaaatctatttatttgttgctctcttcccttctaaaacataagctttatgaaggaagagactgtgtttattttgttcctttctgtctcctcagcacctcaggtagtgcctggtatgagatatacattttcctgatactactactcaattgaataaatgaattcacaagaggtgttacatactaaaacattaaagtgttatcttttgtagaaaatagatcaataataggttgttactgaaggcaaaatattttggagccattcttaaaggtatttcttaatttgtcaaagagtaagagggcatgcatctccgataagtccctttccagtaccactgtcagagtatgtactaggctgaatatggctttgaattttctgctttccagcagagagagaaagccttacaaacaattcaagctgtaacccctgtaattattaattagtgcctattcaagtaccatgtacctagcagagattcttctaatcagattgcataccttacatctaaaaatgaattcgtcattttgtgagatatgtatttctctaagtataatggcattatactgtcctacactcttttaggaactaaatagcaataatgtataatcttattttcaagaaatcttccttttatgaaaagtcaataaaatctgatgtaagggatttaaaaataattcaacttatataatttgatcagactatgtgcaacctataccatcctatttactacatcatactacaatttatcagttgttaccttccttaatcctctccagctgcaggtcctgaaaggtcttttgcctataggttcaatcccttctagtgtctggaccacctgaaatcagattgagaatatatttcagccctatatgaacaggtaccgggttttgcttctagaagcccgtgccctttccttgtaatattcagtgtgtgttttgtcttttttaatgggttgctgctcagatttttttatgaaaacacatataactctgctctaaatctcagccccttgaaacagggcttgatgactctgtccagttttttctaacatttaccaaatgggaattctgatccatactattctcagttattgatgggggccttaatgcaagtcataccactttccccaactccaggtactagtacttggccatgaggttctgcaccacagaaaaagtgaattgtataaaccaaattcatcctctatatgtttatgtagtaagtttcctgtcttattcattagccaatgtgaggaaacatgtactcagagcatagataagtaaatatatgtgtccaataattctaccaactgaacagtaaaatatgcatgtctatggttcggagatacaaacttttcaaaagcagagtggacaagcataaatacatacttggggttgagactaagtaaaaatctgaaatatcccatttattagaaggttgaaggtttttttcttttttgcattcatttgttcttgattcagtgagattagtatctttaaagtcaattattggttttgtaattacatttggcacaaatatgtattaactttatgttaattatgggactaatgccatgtttgaatgtaaaccaagaactttatgtctgtagtcagcaattcaatcttgcttttgaggaatttgtaatgtgaaatcactgtttagcattgtaatagctttccttagggtcaagcacttcccaataagtttgacattaggcatgaaagaagatgcatgaaaatgttttactcacagatataaacagtgtaatctttattaacacacagaatggaacatacagtaatgaagcaatctaaaaagaacataaatttcaatatttagccaatttgtttttatttccttccatgcaatagtataggagttcaagaatagtcaatggttatttgagtggaatatgaaaagtgtgtcctaattttcagaggatttggggaagaattcctaattcataatatgcagctgcttccttcttctatgatactatgctataaacagggaatgtttcttgattagatgccaatgccaattctgttcaaaaacttcaggaggagtttagaaatgtatacaggttaagaatggacactgaaaaagacaaatatttaaagtaatatgtttttcttggagaaattttcttatgaagttgtattattcagttaacaatagatagtaacatgagaaggatttgatgacttaaataactgtctgatttatgttttatccccccccttttgtgtgtttcctttagataagaaatgttgaaaccaatcagtgtttagacaacatgggccgcaaggaaaatgaaaaagtgggtatattcaactgtcatggtatgggaggaaatcaggtaaactctccctttttatcagcttcatgttttagagggaaaatattgttaaaactatcagtggagaccatggctcacatgttaataactataaactgagcttaataaataaatgtacactcaaatctagaactaatttggctattttattgtcccaaggatcttaaaggagagctgaaaaattaaaataaaaagagcaacactttcagtgtgcctacagttaatgaagatatccaaatattttagacacatctcattttatcatgtattagcaaatgagaggagtacattttattctattaactgaatatagaaaataattcctcaacatctgtgatgttttcccaatggttatttttatccatctcttttcagatttttatgtatgttatgatttttaagagcttttgaagtttaataaaatgtttaagtatatagttcagtgttgaaagctgactaaaagtcttagacagcctttcttgtgtgtgacaagagttcttgtgctcttcttaagcattggaaaaaagctttgcatggtgggccacatggaggctatttggctgtgagtcttcaggacagagctattttactgccatggccactttgagaggtagaatttggagttcctgggaactataccaacaaagcagagtttgaggtagctaatcctctgtaaacaagttatctacagaagtttaggagaaccaaaagttttttatccagaggtagaatttctgagttagtgtgaaccgaggttgcaaaagttatcctgtccagcacaattatggttatatttgtgtcaagatttattacaaaaatacttgttgattcttgtactataaagaagaaaatgaactctgttgagttttggcgcaccatacttcaaacagggccggtgttatttaatggagaacattaaaaggaagtttctcccttaaaaattcttaatttaaaaaatcctaattagtgttccaaactgtcaatttgagcaagaaaatatttaaaccaaatttctaaattacagcatgggaaattgaccttatggaggaagaggatagaaacaacataggcagactaatgacaaagcattcagaaatgattccatttattgtttcactgattcataatgaatgtgacaggcctctactgccaaaaaccaatgaagtcctgatgaattcagctggaaacaacaaaatgcttaactataagaggactaaatgtgtgagggtttaattttctcacataataaaaattctgacatttgtttaggacctcaatgatttcataaagaaaccaaaaactttatgtctttccattctttagtgtttagagttaacttttatcatcagctggtcagaagaggactgctgaaattccagacatcatatccacattcaaggcaggaatatcaaagtcagggaagaactgcaatagccatatctgtttttcttttaggaaaagcaaaagccttcctagaggctctacacgtctcagtgtatctctctttaggtaaaaatgtgttacttggacatccctagtacaacaaaacactgaatatttaaccccacactcacaagtagctgcttctcacagttcatttaccaagatattggggagacatttagaagtgccagccataatctgtttgaacaacttatggcaaaaaaaatcagctaattatctgctccataatttcatacagaatttaaagaaacactacttatgaaatctctctcattctattgcttatgaaaataagaaaggtaccccagatgaattctctacatagaatcattacagtgccatattaaaaattactttattcatctgcacgttttcaaatacccagaaataagctatctcactctactgcaaacttcttgctggcagtcctatatcttactcctgttttcatacccagcacctgctgcagtcttggaacatggtgagcacctaacgaatactaggcaagtaaatagatgaaagattgtattgccagaacagtagatttgtaccttagaactttgtagacattgccaagaaataatgagctgttattttcatagtaactaaaagtatataaaaacagctcagggattcataaagaaagtgatcaaataataataagcataaaatctatccctacttttattctaatgtgctctacaagatcaatttaataacaagataaaaattaaaaccattatttttccatctacatacttaattgcacatacacacacacacacacacacacacacacacacacacacacacaaatgtttttggagccctttttgttaaaacacaaacaatggaaacaattcagtatttaccaagaggggaatggttaaataaagcatggtatacgcacagtatagaaagctgtataccatcaaaatgactgagggaggtctgcatgtgtgtcactagaacttcaaaagagaaaaacaatccagacaacttattttcaataatctcatttatgaaaaaatatttgaacaatatatagtatctgtatatttatatggatgctatgtaatctattacaaatctataaaaatctatctggaatatagattgtatctggcgagtggatatctggaaagaagactgagttggaaaagaaattttcctttttaccgcacatttttctgcatacagtagtacatgtatttccttcataattaaataagaatggggaaatttaaactattgagactagaagaacattgttgtgttgcattaccctgatctgattaattgggtaacttatggcaagttacataatatttttgagctttgatattgattgtccataaaatgaacaaaagatttcattcaaattttttctaacactaggaaaattcattaaaaaaattaacactaaacatggcacatactaaacatgcaatgtgtattgatccattgccattaattagcccctttacttgttatttctattgatgttgttaattctcttatttctgaagttaaaaaatgttcgttcagtggctaatgtcacaagcaagataaaagcacaacacttaatttggtattgttgatttcaaaacgatgaacaacctctcctgtaactctaacaaatacagattatggaaaaatttaaccatcatataaaactcaattattatgaattctgctctgatggaattcaatatttctaagataattaatactaggaacctgtttcaggttttgtctttctcactttaataaaaaacagattttagaattttattctcagaattaccctccctggttttattgctattcttttatgttaccatggaagcagcaattatttttatggttatttagttttgactgttttataagtagcccccaacccataaaaatcactcaagcttctctctcttgcttttacacaaaaatcataacaaatgttaaaatccttttttaacttagttacatttctaaaaaaaggtattttttttttgtttgtcaacaattataccttaaccatttctccttgcataggagttttgatagtttaggggttttttaaggccttggaaacatcaggaagaaacttacttttcagtagttgttagaaataattttcttaaacactcagatttcccagcaaaatctaaatggagttaatgaaagtttttgtagcaggaatactgcaaaagctaacaactggagaattattattcaattcaacatgaccattttgaagtgctctttttttaaagccttataaataaaaactgtcttactcaaagaataacaaaattcagcactccatttatatctattcttgcaatgatttattttcattgtcaagcaacttcatgataatcattaacactttgaaaagaataagaataatttgattaacttgaatataaacttttacaagtgaaagacagaagttacaatttactgaaataaagtatagcagttgtgagagtgtcttctctgtacttctgaaagatggcatggattcctggaagcacttccatgtcccgtacaatgttaatgactcagatttacatgtacagccccaacctctctcctgagctctagaatctatagccagttaattatcgttaatgtctgcagacatctcaaacccacctgtttccaaactgaactcatttcctttcctttcacagagtcatccaaaatggaaacctaacatagaaacatacttctgaagtccgattagtcaccaaatcccaacacttctatggaaaaatgtccctacatcttagtccttttataaccaggatctctgcctttgttctagcctatatctacttttacccatatggatttaaaacctcattattttcataactcataattcatgctacattagtttaacatctcattaaatattcagcagctttccactgcccaaagaataaaagccaaattctttcctatgatatacaaaacccctcataattgtatccccatctggttttccagcctgatctaccttgatgtcccatcggtctcctgtgctctagacatacgtctcatgatttctcattccttgaatgctttcagtgttttcctatcctagcagttcacttacactgttctctgaaattgagctgttggctacactctgctccactaaaaaacttaagacacactcactgttgaaaacccgataatttagcttctcatttgctagctattcattagcaactccttaacctaaacaggacacatttttaatggataaactataattgatttattcattgttttattgtttaacatacaatatttataaaagttcattgttataaaccaggcccatcaatttccttgtagctaaaatctggcaagcgccaatatttacttctttagaaatatctctagaagtacatttgctacaggacacatttttaatggataagctataatttatttattcttttattgtttaacatacaatatttgtaaatgttcagtattataaaccaagcctatcaatttccttgtagctaaaatctggtgatcactaatatttacttctttagaaatatgtctagaagtatgtttgctcaatcaaaggttatgcaaaattagaaggcttttaaggtatactaacaaattgttcttttttcttaagatttcagcaaataagactaatagctaaaataaaaaggactctgataaacatttaatacaaattaccctctttgagacttacaatgatctttgaagtagatagtgttattatcttattttacttacgaatgtaatggaaatcttgagtgattagtatcatgattgaaatggtaaagccagtgtgaacctaagtctgattccacaccaggtttatagtcactgtatttgcattgatttccaaccacactttccaggattataatcgcagtggccaaccctgtgtattatattttttttttgttttttatctttgccattttagtatgggagaaacattttatcttgtttcaaccatatttctagcattatcagtgcatttaatgattttaaaaactggcatttaaacatttcaaaaattgttattgcaaattttctagtgatattgttgcttatgtttccattgggggttgaaaggggtcttttttctcttgtcatttataagaatactttgttaaatattatcgccctggtcatgcattttgcaaacatttttctgactttttgtttacagttttttttatatacagacttttcaagtttatatattaaaaccaatgtttgccttaatactttctcttttttgtgtagaaatgccattcatttttaaagtgctttgaaaaaacatttatatcatcataaaggcataatatcaaaattggtactcagatcatagtcttattaggaatatgttatatctactcaaactgatattaatttttatttaaaatttacataaaatagctgggcatggtggcatgcatctgtagtaccatctattcagaaggctaaggcaggaagatctcttgcacataggagtttgagtccagcctgggaaatgtagcaaaaccccatctctagaaaaaaaaaaaactctaatacataaaatatattcataattaggtaaaaattaaattaacataacatttataacataaacattttactttgaaactaatcactgtaacaattttaaaaattcaatgctgtttccctctgaatagcagcacatctttaattaaaaatgaataaaaatagccccatacacattgtaccttttccttttaaaggcaaaaaaatgtaaagtaatggaaaaatattcacaaccctagtgaatgcatttataatgtttctttttctccctggagccactcatttgaagacagctagaaagcacgtggaaacattccatataatttattgcggtaaatgattcagagctatttttcaaggtagcaagcctttaaggaagcttatgctagccatttgttaaaatgctgttttctgccaagattaaagaagagatcattaggtatgatctacacttttatacaaatatctcctcctcgtctaacatctgattacttaaattgaatctaatcttatgacaggtgtattaaaaatttagagagtaaacaaatactttgtttcattacagatcctctcctagagaaagcttaattattttattaatatgttctaatgtactcacagattgtaatgaatacattcaacagatatatattcattttaaagtttgcatttttataagtactgtaattacttagaagccatttcaatactaatttggtccctttttagtagcttgcacagtggaattaaaacttaccagggatttcacagagtaaatttgcaagttaaatagaatggcctatgaggaaagaaggaaaatctaccattcattaaatgtttaaatgagttggatacatgcaagctagaagaaagcagggttaccacaacttctatagaaacaggaattattacaagagcctttcattatcattaatgcttgactgggagaacttctctggtctttgctgactttgtcctcctgtcaggagattatactatacttgggatggaatgctgtcttagtctatctgggttgctataataaacatacaataaactgggtggtttaaaaacaacagaaatttattgtacacagttctggaggctgagaagtccaagatcaagacaccagcagatttggtgtctgatgagggaaaagttcattgagccttcttcttgcatgctcacatggtgaaagagaagagctagatctctgggtttctttcatgaggacactaatctcattcctcggggcagagacttcatgacttgatcaccttctaagggcccagacttctaatgctatcaccctggggactggatttcaatgcatgaatttgggaggggggactcaaacgtttagactacaacaaatgataatttcagtcaatcattcatccaacaaaacctgattatcctagtcaataataaacactctaggtagtatatgactaaggggaaaatatccaaagaaaagaaacgtttcactttggctagctttttgggggatcatgagttatctctttaccctcaagttcttcaaacaatgaagtttgaagttttcttttaagtaaatccaataggccctgtgatcatttgatcagtcaggtgtcaacaaagtcttaggatacttttacatgtcagtgaatctcttattgccatgctactctgttcagtcttgattcttcacattttatttttctgcaaaattaatcccctcaagtttaaggaggcgtcaaagttgtaccatatcctgggcttgcagccattgtttcaaactcagtgtgtctataattaccttttgtcccaagccttttgtcctctaatctctttctttcatcttttacatttttctctctcatctttcatcaccccatgctcactacaaactggacctaagccctggggattcattctactagtctttttaaaatctatttcttcttttcttccattaataactcagctttctaaatttgagccttgattgcctcagacttgaattactacaataattttcagtgtagtttccccaaactccagcctgtccctatcttcattccaccttccttaaataattaagtgatgactccgtcgaaattatcgctcccagttggaaaaacaaacaagcaccaaaaaaaaaaaaaaaaaaaaacctgaaagagttcctagttattacaggataaaattggcattgtttacacaactttgacccctttctgctctactccatcaactttatggaccctgaccagacttgtaaaaaattgttattgttagttgttgtttttcttatagctttgccttttcttaaacccatttgccatgaccttgccatgcttttatttatttatttatttatttatttatttatttttttgaggcggagtcttgctctgttgcccaggctggagtgcagtgacacaattttggctcactgcaacctccacctcccgggttcaagtgattctcctacctcagcccccccgagtagctgggattacaggaacccgcaaccatacctggctaatttttgtatttttagtagagacagggtttcaccatgttggccaggatggtctcgaactcctgaactcaggtgatccacccgcctccacatcccaaagtgctgggattacaggtgtgagccaccgcgcccggccacttttagaactatgtaaattctatcaatctagtcgcacttcaaaacccaccatctctatatagtgctgtattttttctgcttttcaatatacatttatatttcctttgaacttagactgcagaattttttctcttgtttttaacttatatattatttctcaatattttattctttaatcattatgttgtcattcaattatgtatgtttcattatcctatctgcaaaaataaattgtagtcttttttggaagcaagaatttgttgtttttctttttaaaaaatccccttacaggaataaacgcttattaaaagaatgaacaagtaaacaattgttataaaaatgtttaaagttacacaagagcctgttatcataaaaatagcttcaaaattctgactacataaactaaaatcatcttcctggaggatgaaattgttcctctagaaatgtgtggatttggggctttggtaactgaaaaatgaatatcaaaagatacccatgttctaacccctggagcctgtgttttaccttatgtggcaaaaaatattttgtagacatgattttgttaaagatcttgagatatggagataatcttgtgttatctagatagccgcgctaccacatgtatccttataaaagggaagcagagggagaagaaaaggtgatgtgaccatagtggcagagcttggagtaaagcggccaataagccagggaatggttgtagtcacaagaacctggaagaagcaagggctagattttcccccagaccctctggagggaaagaggccctgctgatacctgattcccacccagtaaaactgattttggacttctggcctcctgaaatgtgagagaataaattcctgtttaagcttccaagtttgtgataatttgttttatcaacgacaggaaattaagggctcacaaagaaaattctagaaacagtatagctcagagttcataaatagccaacttctttggacaaaaatttctaagatactaaaccttcctcaaagttggaaacatacatgatttcatcctgatacttctaaacatgttgtgatagctagaaagagtggacctcagttatatagtactgattcttcagaaagttttaattgtagaatttttgtttttagagattctattttaactcaaatttttgtattctctaccatcatagtaattgtaaataacattgtcaattataaatcctatattaataaaaatataaaataactaaaatgaaatccttaaaatattaaatgataatggctccttctgttaataaatcctgcacaggagtgttaaaattattttatccaataattgagcaaaaaatcaacaagtaacattttcctaattcaagaaaattatatcagaggaacatctatgaaaacttggagttgataaaaacttgtaggaacttgtgatctgatcctgccgagtgttgcctggccacagtgttttctagcatagaaatgttaaatatgtcatgtttggcccttttctttccctgacaagagttactcaaagattgtaagtttttgttttctttcttaagatctcttaaaaattgaaaactagtattggctgttttttagatttatcttttaagtattgtagagtctcattttatgtttctacattttgattgttaacatctaccatgtaagacattttttcaaaagtgttagaaaaattgtcaattcaagtcaatctagaaaacaccttttccattttcataagatatttaaaattcatttcatgggatcctacattgatttaaataagtcacaactttggctctatgctttctagctatgagcacaaagttggttatatgattccttgtgtccataatattaaaaaacagcttcgtaaaagttcagatattcctggtgttaaaatcataaggatatctactgtgattatcgataagaaaagcagtacatggaaaagggactatggcaccaacaagggaaggacaccagaccaaattggagaagacagtgtctaagaaggcatcttagaaaatagcaaagtatgtcagtgcaaatagtaggacaaaatattattctgttgattaattggttaaagtatatcaccatcatcccatgcataactgagattaatattacatttctataaggcttaaacattaaaatgatattctgttttttaatgtacataaatgtgtatcagttttattaatgggattcccagaatatttggaaaaactccccttaaagtgaaatatcacagtaagtgtataaagcagaacgtttaatactaccctggtttaataaaaccccactacatacacacacacatacacgtagacacaaaggcgtacctcaaccatcaggacaacttttcttactgaaaatgggaatctgttacctgaaaaatttactaaaaggaaaatgtgttgctactaacagcatccactttgtacccattgcccaccaatttgtctcctctaaagctcctgttatatacagatggactgcaagctctctgctgactttaccaagatgaatttgtctccattaaactagatatttatttccagcagaacttattactcctgtgtactctttaatcttctgaccctcattcttttctccaccttgtcttcaaatagttttctcctgttttatgcctaattcgttttgacttgaggctataaccttactcattactgtgaaatgtatccttgttcaagtaaccttccggccaacattttatcatatttaatacttttttaattaaatgatttgaatgcatgagtctactatatgtgaagaatattaaggtctttcgaaatactcttctattccccatcacccttagactagctgtatgcctatttttcatcaaggacataattattttcaccataaccattttaagcactctataatagataatataactttatcttggcttaatccatgtagtaaaagtcagtttattattttctaggtaaggtaaataatgtctgtgatttctaaattaacagcgttgcctagcccacttttatattcttgagaagccaagcagaatccatacttatgattagttgctttgctgtacctgtgattgtcttcatcttactgcatttgcaattccatcctagttattaaattgttacagttttggaataaattaggcaaggatattcctagttttttttgctttttaaatatgaaaacttattttttcagaaatgaaaagatagcacaataaggccaagatgacataaaactatacaagaaattcatgttcaaatagttgactaggcaatactaatactttatcccgggaagagaaacattaagtttagaaaaagaagacatctgaaaaaatatgcaagtgaaatgaagatatttgatatattttatagcacaaaatacattttatattctgtataagattttttaaagattccttgcttaaaacttaccaatttttaaaaggagtcatcaaatataaaatattattgaaagtagcccagtgtaaggagactaatcaagtggaagctacacatcgatatggctaaaacacaatgttttagatatgtcatttaaagttaactatatatcccatatatattttgccttgctacaaatatagacgtagtagtcatactatgtcagcaaaatatcttctattataggttttacatgccctaattatatactcatgatgtcaaaaaggaattggatctgagatatcatgagattgtcatttttctgtataaatgatgaagaaaaattatttctaatttttttccaaatctattcttaacattaaaagctatctttatattgaaatatgtctaatacttttttctttgcacaagaaatacgttttctaggattttattgcattctacactaatttgaagcatgtgttagcagtatgaaatgggttttttcttttaattacatcatatataattatacatgcaagaaatatatatatatttgttatagatagatatcgctgtttaaatccactttgaaacaagatgtaatataaataggcacacaaaccatatactcaatctcatagggaatacaaaagaatcattaacaatacagcaagcattcataatgctctacaggaggcattcaggaaaagttctgataaggacaggaatgggtctaaaagactccacaaagcactcagcgtgcacagagagcagagggtgagtaaggacagcaaggacactgccacaaatggaattgaaagtctggagtgggacagtggaaaattaagttttacaagtagaagagctaagattacaatagaaggtaaatgtcaagcaagggaattttgacttgaggggacaaaagaagcaatgagctttcagactacaaaggttgtcaaaggatcgtgtgtaataagcatcatgaaaatacttggactgcacttttgttattaaaaatgacactgtgaattcagccaaatatgaaaagggcttcttattcatgttatttagtgttgaagtctaatttcacagcaagcaggggcagactgtagaaactttttcaattcatttcttttattctgctatcaaaggatttgatccaatacaaagcatgaagctacatgtggtgtatacagaaatgatacctttccattaaaggaaaaaaagcttcagtaggtaaccatggaaacagcctagtgtccattccaatttcgaatagaaaatcttagtcttctaatgaaaacctaccagatagacatacttctactccagctctctagttctaactctctaaaaaggtttggaatattcattttatttaagaaagtaaaatatgtgtttatgactgtaatatgcaaaatttgattttttcttttagacaaaaaattcaaagatgcattttaagaccgtaacaccaaggaatgatcaaagtggtcttgatagctcaccatagccagtgtccaattcatggtttacacattactgagagcaagtgccacttctgggtggcagaaattgtcatgttccaatccacctaacaaagagacctgattttttttcttcactcagtgagttaaccaagtgacccgtgaggtggacttattttttttattattattatactttaagttctagggtacatgtgcacaatgtgcaggtttattatataagtatgcatgtgctatgttggtttgctgcgcccattaattcatcatttacattaggtatttctcctaatgttatccctcacccctccccccaccccacaacaggccctggtgtgtgatgttccctgccctgtgtccaagtgttctcattgttcatttctcacctatgagtgagaacatgcggtgtttggttttctgtcttgtgatagtttgctgaaaatgatggtttccagcttcatccatgtccctgcaaaggacatgaactcatccttttttatggctgcatgctattccgtggtgtatatgtgccacattttcttaatccagtctatcattgatggacatttgggttggttccaagtctttgctattgtgaatagtgccacaataaacatacgtgtgcatgtgtctttatagtagcatgatttgtaatcctttgggtgtatacccagtaatgggattgctgggtcaaatggtatttctagttctagatccttgaggaatcaccacactgtcttctacaatgactgaactagtttacagtcccaccaacagtgtaaaagcattcctatttctccacatcctcttcgagctggacttattttttaaatgtatgaatcttaatgtggtgttacttataaatctaacataaatacatagcccccaatttcttactgaagctttaagagacaagttaaaattgttctctgggatcccttgtacagaagaatttcatataagttttgtagcttactccaggaggtataacataaccttcccccttccctggcatgtgtgctgtgttgactttcttccaaagattacaatgtggaagaggatagtggcaactttacaatggagaaatattggcaaatactaccttgagtatgtaatcaagattctataatgtgagtcatagtgataccgtgcacccttgaagtgatgggaatgacactgtacctttgaggtcttccacccccaaccctagacccctaatccagccatgagataaacattagaaaaattcaaactgagagatattctataaagtgcctgataagtatttctcaaaaccatcatcaaaaagataaaagtctgaacatctatcagagtaggctgagggcatatgatgactaaaaatatattgttggatgggatcttggaaaaaaggagcatggattggattcgtaggggaacatgatggaaaacctaatgaaatctgaataaactctagagtttgaaaagtatcaccaagaagtgaaatgctaattgtgtggaaagaacatgggacttggagcctgacagaccatagttcaaacactggctctcccacttgcaaacggagtgactttgtagaacttctttaacctttgcaaacctcataatcctaatttgcaaaaaaagaataatactgtatgtgctatatcatatttaatatacagtatattttaaatgaccactgtctttcgtaacacacaacagttgctcccaaaatgttgtttctccccttgcttccagcccaacatcaaaaggctagcacctctgaccctctgggggtcttttaaccaaaagaggctgctttgcccatcagtcacattaaattctgctccctggaagctcacctcaagcaaaagctgagggcagatgatgtataaatatctcagccctgtcactctttgagggactgactccgacgtgcttattctacactggttgccagggatccccaacagaattaagctctagttatccacagtgtaactaattagataatttaccatgtattagcctttttctcttccctaccaccatacttgtcttttctgagatcatattcctaacgaacgacttgcacttgaattactgtctcagtgtctgcctttgggggaacccaaactaaatagaccctgctcttagtttgcagcaatactgacagatgctataagtaaataagatttctttaaacttgaagccatctagaaaactttggtattatttgcacccaatgcaagcattgtggtaataattccaaggtaaattttgaatattgtgtccggtgaagagtactctccctttacagatagagagttgtaaacaatacataagtatatcattgtgccatttaggatattataatttggcttttcagaatctttatatatgtaacaattttatctaattacatgcctgaatatatctggtatagtatataccagagttttaggaagtgtctaaagatacaagtgaaaacttttaaaattgtatgaaatgttacaaaaacacctgtaaaagacattcagatgggatagcaaaaagtcttttatcattatttttcagctattgaaacaaacactaaaatacaatagtttatctaggtgtcatgtgaatgatatatttattgttgttatgtctgttttacatttacatgcttagatcagtaagaacctcaaagatcaggtatcttgctgcataatggtaccaactaatgagactggcataaagggaaactatgtatgcatgtatgttgcccattgctaaagaagaatatctcatttaggagtcagtgttcttgccttgaaatatatgttcaaaagccagttcttcacagaataaatacttaaggaatgatccagttgagaaaacataggcgaatataccatcaatagaaagataagttgccagaagaccattacaaaaagaagagagttcaaatgaggttggaatagtgggagaaattcttacagaaatgataacactcggttagatgtatgtgtattgaattcagcagttcatgaaggtgatgtgtaatttggataaacaagacagattaaacacacagaaaagtatgttgaataaatagatgattgaatagctgagaaatagaatgatagagatgggtcatgggagatgatgtctcacatggtgagaacaattctagtttttgcatgtttcctttttcctgatggtcccgtattagttttctattgtttcataacaaattactacaaatttagtggcttaaaacaacacaaaattattatttcacagtttgtaagaggaattcaggcacaatgtggctgggttctctgctcagggtctcacacagctgaaatataggtgttggccagagctgtgatctcaactcagcctcaggggattcctcttccaacctccctggttcctggcaaagttcagttccttgcagctgtaagactgacttcctatctttctttgttgtctggctctctgccagggttgcgctctgccagcagctagaggctgccctccgttatgtgccatgtagctctctccaaatcatggcagttttcatcttcaggccagcaggagagtccctctcttcagtgctaacccaaggttgtatctaatatctttgtaatataatgtaatgtgatcttgaaatgactgtcctgtcatggtcacagtctgtcttgcacttaagggaaggaggttatacagggcatgtataccaggggatagaaaccttcggtcatctgcaaattgtacatcagtcacataaaaagcaatatgtgtacattcaagcataactcgtgggatatattttggaagggattcccaactgagcttaaatttgcaatttatattcttcaatactgcaatagtaaaatataagcatctggagcatgtttataaattagatttcccaaattgtagacttcctttaaaacccttcagggcagagtcaagtattaaaattacataaaatttaacattggtaatgtttaaaatgggaagatttaacaatgaagtagaatagaaatgtcagtcacattttgttattatattactgcatgtggcttattgtattatcttgcactgttgctctgtttcccataaagactagggaatttcaaagacaaattattttcatttcaattcaattcataattgttggacactactctcctactagaacagtttccatagggattcaaaatatatccttagcattgttattgagtccacaagatttttttaaaagaatataaaaaccaataggaaaagatgagatagaatataatcaaatgtagattttatgcatgaatattgcacagataatcactaatatttagatattacttgaggcaaatgctttgtttagagcttacatgaatttggcttattcagtctgtaaaatagcctatgaaagaggagccatatatttatcctttttctcagatgaggaatccaacattttgacaaagactcccagtaaccctggtcctgagtgatacctctcaagcttaggtttgtgtaatcttctagagcccattgttgcagtattgtccaattccaaatatatacagatatgatacctacctgcggtacaatggcagataagctatctgggtaaaaatggtaagagagtgctaaatgaaaaaactgaagaatgtatgaagactttaaggagattagccttttgcttggcaaagcggagtgggaaggatagtcctagtgatgtgatcagcacatacgaggtcagggatggaagaataagctggcttgctgagtgcaaattaagcatcacattgttatatattgttatattgaggtgaaagcagaaagagtgaatgctttacagatgatgttgaggacaggatgagaatactgaacataagatgcatacccacatcctgtttttagttgtagaattttagagcattaaagctgtaaaaaataagtgatatcatgtagatgtgtaagagtaagttaagagtgtacagctagatgctacttactcctcctgaccctcctctgaacaaaccgctgagctaacagcctatagatgaaacctgaaatcaattcaggcataggaaaaggtactgtctgggaataaacttggcagctccactggtgacttcaataccatctatgaattctccatgctgacttcaggatggtgtgaatatggaggaagataatattttaaaaaataattcacattgctaaaggtataatttttgttgctaaacagttatctctttgatttcaatacaaattttcttgggttatttttacagatgagggagaaaatcattatgacaagtttattttcttacaagttttatttctggatttttgttgacacacttttcgaattgactgcgttccaaatacctaaagagatctcccagaggatgcaaaggtccacaatgactaaataatgggtgtgtaaagagaagtttaagcccgtggacaaatagtggcaaatagcagagcttcaggttcagagagacctccgtcactaagcagctcggacatattgggaatcctgtaacttctttggcttcagtttcacttagcgaagcagttggcaaaattcgatatatatcaaactgtgaacttttatagtaaatattgtcctgatgaactcgcacaagaaaagtattttataatttaaatgtagggaaatcaaaacctatatgatagagctgcaccaaatatacatgtagacattttgaattcaaatatatattcatttgtaaactataccttaataaaaataaaacaaaaatgaatacatgtatatgtatctaggcatacattgttttattactctttgctttattgtgcttcacggatattgcactttttaacaaattgaatgtttgtgacaaccctacatggagcatgtctattggcttcatttttccaacagcatgtgcccactttatgtctttgtgtcaaactttggtaattctcccaatatgttaaactttttcatcattattttatctgttgtgatgatctatgatcagtgattttttttttttttttttatttgagatggagtctcgctctgtcgcccaggctggagtgcagtggcgcgatctctgctcactgcaagctccgcctcccgggttcatgccattctcctgcctcagcctcccacgggcgcctgccaccactaactattgttaattgttttgtggtgctgcaaactgtacctatataacaacagtgaacttaactgatgaatgttgtgtgtattctgactgctccacagactggccattccctatctctcgctccacagactggccattccctatctctcgctccacagggcttcctgttcctgaaacacaacaatattgaagttaggccagttaataaccctacaatggcatctgtgtgttcaagtgaaaggaaagtcacatgtttctcactttaaatcaaaagctataaaagattaagcttagtgaggaaggtatgtcaagagccgacacaggccaaaaagtaggcatcttgcaccaaacagctggaaaaatagtgaagggaaaggaaaaattcttgaaggaaattgaaagtgttactctagtaaacacataaatgaaaagagagcaaacagccttattccgtatatagagacagttttagtggtttgaatagaagatcaaacaagctatgaaatgcctttacaccaaaacttcttccacagcagggccctaactctaattctatgatgggtgagaaagctgcagaagaaaatttgaagctagcagaagttgatttatgagttttaaggaaagaaagataacataaaagggcaaggtgaagtagcaagtgctgagggagaagctgcagcaagttatccagaagatccagctaagatcattgataaatgtgaatacagtaaacaacagattttcaatgtagataaaacagcacccaattggaagaagatgccatctgggacttccatagctagaaaagcgaagtcattgcctagcttcaaagcttcaaaagacaggctgattctcttgttaggaaaaatatagcgagtgactttaagtcaaaagcaatgttcatttatttaccattccccaaatcctagggcccttaacaattatgctgaatctactctgcctgtgctctgtaaatggaacaacaaggcctggattatagcacatctgtttgcaacatggtgtactaaatattttaagcccactgttgtgacctatttctgaggaaaaaaagattccttttaaaatattactcctcattgataatttactcagtcacccaagagctctgttggagatgtacaaggagattaatgttttcatgtctgctaacacaatattcattctgcagaccatagatcaaggagcaagttcaattttcaagtcttactatttaagaaatacgtcttctaaagttctcactgccatagtgattcctgtaatagatctgggcaaagtaaattgaaaactttatggaaagtattcacaattctagataccgtaaataacatttgtgattcatgggaggaggtcaaaatatcaacaatatcaggagtttgggaaaagttaatcccaaccctcttagatgactttgaggggttcaagacatcagtggaggaaataatttcagataaggtggaaatagcaggagaactagaattaggagtggagcccgaagacgtcattgaatttctgcactctcaagctaaaactttaatgaatgagcattgcttcttatcaatgatcaagaaaagtggtttcttgagatggtgtctactcctattgaagatgctgtgaacactgttgaaatgacaacaaagtatttagaatattacataaactcaagtcgataaagcagtgtcaggttttgagaggattaattcaaattttgaaagaagttctaccatgagtaaaatgctatcaaacatcacatgctacagaaaaatctttagtgaaaggaaaagttgattgatgtgataaacttcattgttgtcttattttttaaaattactacatccacctaactttcatcagtcaccactctggtcagtctgcagccatcagcattgaggcaagaccctccatcagcagaaatattaccactcaccgaaggctaggataattgttagcatttttaacgataaaatatttttaattaaggaatatacattgttttttgagacacaatgctactgcacgcttaatatggctacagtatggtgtaaacataactcctatgcacaggggaacaaaaaaattcatgtgccttgctttaaatgcgatacttgttttattatagtgatctgaaactgaacccacagtatctctgaagtttgcctgtgtatatgcatgtacatacatacacactcacacccctcttcatctatggattaaaaaaaggaaagaaagaaaccctgtggcaagataaagcaagtaaagggcatttaattcctgagatctttgcagaaagagacaagattcaggtcccaataatacagcaatgcctttgctttcttactttgtaacgtgtactgctggaacaaggtttcattagcacaggctcatgctagagatttgagaaaacgtttgtttgtagtttttctaaagggtcatgaaaaaagagtattttaaaagaagtaactatacatatattaggattttaaacataatacaactgggaaaaaaaatgtggacacctagtctttcattatataaaattaatttaacagaatattttagatccttctcacagaagtccttgaaattatttagatgttttaggtatttgaagaattgtaaaatgtctttggacattctccctaaaaagaaaaatccagaacaaaccatacatgtacgtgaaaaagaaagaatgcttaccatctgatatgatttggctgtgtctccaccaaaatctcatcttgaattgtagctcccataatccccacgtgtcatgagagggacctggtgggagataattgaatcatgggggcaggtttttcccatgttgttctcatgatagtgaataagtctcacgagagctgatggttttataaagggcagtttccctgcacacgctctcttgcctgccaccatgtgggatgtgcctttgctcctccttcaccttccaccacaattgtgagcctccccagctatgtggaactgtgagtccattaaacctctttcctttataaattacccagtcttaggtatgtccttatagcagtgtgagaacggactaaaacatcatctatgaaaagaaaaatacagagattaaaaggaattgagatttgaattggctttatatgtagtatcatccattatagatagtactcatttgattacaatataaattcagaagcagaaatcattacgacttcaataaagtatacataaaatcaggaaatcacctagtcacattataaaacacctttatgaagatacagctataatataaaagtattttgaaaatggttgattttatactattggaaagtataactggatgttaaaatttcagcccagataccaagatacaataaatgtgaaatgtaaaatcagatttccctatgcaaaatttgcaatgacaatctaaaatcagattttcctgtgcaaaatttgcaaagacactttggaaatctgatttcgtgactttagacacttcaaccagcatgaggaggaaaaggaggtatgttggtttgctggagctgttgtatcaaattactgcaaactaggttgcttaatagaaacctagtaaattgcttaatagaaatttattgtcttatagttctggaggctagaagtctgaaatcaaggtgtcagaagtgccatactccctctgaaacctaagggagaatcatctttttcctcttctagcttccggtgtttgccaacaatccttggtgtcccatggcttgtagatgcatcattccagtctctacttccatcatcacatggctgtcttttctctgtctctattctcttataaggacgccagtccttttagattaagggcccatcttactccagtatgacttcatcatgaggactatctccataagtgtgcacattttttggtactggtggttagtacttcaatatatcatctggggagccacagttcaacccataatggaaagtatcagaatatgaagaagattacaagattttgcctggagagattagttgccctccctctagaggagatgggctgggattctagcttccagtaagaggaggattcaaggccaggaagttcttgagcttgcaacccatgcaatcacacagatccctacaatcttggaattcttggtaattttataaaaataagttctgcattttcattttgcactgggacctgcaaattatgcaggatgccagttggagagcttggtatatgcttctggtacttgagaatatggcaggctgtggcctgactcacacatgataaggctggcttgtgacaactgaatacagggagctgactgcactgcctaaggttagcctgcctcccagagttttcacaaaaagtggctcacttataaaatatgcattgtcctctctctttgcacttcagttaagaggtgctcagagatgggaatctctaagaaaatccaaatggtctcaggacagggagctttaaatctctggcaggccagagaacaggaaggagttatacaaaccagttcaagtaagacctctcttacagctttgccactctggaagaataaaaaaataaaaaataaaaaataaattgattagcagactgggtgaatttaggagtgggtaggaacagtgaggaataaaaaaaaagcttaagtcgtaaaacagaaaaagcctttgcctctgcaggctgccaacataaattaggcccaatgtgaagaagggggaattatttgatattacattacatttagagttttgattagtactactaaacagtatattctaatttctgaattgaatcccaaggtgatctaaacaggttagccaaaaaaaaaaaaaaattcatgtacaccatgtttttcatttaggaataaggaaagatatgttatctactccaatacattgtaaagggttagtggtgttgtggcctgaattgtgctcttctagaaattcatatgttgaagtcttaacccccagttccttagaatgtaaccatattagagatgagtctttaaagaattttggcatcattagggtgccctaatctaatgtaactggtgtttttataaaaagaggagattaggacacatgcaaacagagaaggaagaccgtgtgaagacacatggagaagatccctcttacaagccaaagagagtggcctcagcagaaaccaactctactaagatcttgatcttggacttccagcctccaaacctgtcaggaaataaatttctgttgcttaggccacccagtccatagtactttgttatgacagccctagtgaactaatacaacagtaaacaataaaaactgagttattacagtgattagtttgttggtttgtttgttttttttagaggagtctcgctctgtagcccaggctggagtgcagtggtgtgatctccgctcactgcaaattccgcctcccgggctcacgccattctcctgcctcagcctccagagtagctggaactacaggcgcccaccaccacaccctgctaattttttgtatttttagtagagacggggtttcaccgtgttagccaggatggtctcaatctcctgacctcgtgatccatgcgcctgggcctcccaaactgctgggattaaggcataataatcaacaaggtccataaaatggagcatagacatcatcacctgtatcattatcaccgtcttataagatagctgagattaaaagagttgactcaaaaatggccattttagtggttgtttgtagacctagcttgactgaaggactacatgagaatatatgtgatactagatagctcataattttacagttgagacaacatgaacattaagtgtgaaacagaattttaaaaacactataaattactaaatccataggattcatacaaagagctctacatgttacattttgcagtactgtaagttggtatacattcatagaaatataaatgtaattgcacaatagaagaatagagcaaatttatttaatgtaatatatacgaagcatagaacacattttttaaaaaaggtagtgttcaattaatgttaactttctccctgtttcctcttttataatggaaggaaaggcacagaaattgattgtttttccctgcttctagtcagcttaatcaaagtgattagactttgaaccaattaattgtcattaaagtcaggctgccactggaacaaatggaaacatatgctaaatctatggttcatgtaacacagttctgctttactaactattggtaaccgatgataaagcaatttgagagataattagaaaaggaagaagaatagtttccattattttaagagaatgtacaatgagattttattaatgaatgaatcaatcttgtatcgtgtagttatcagtatatgtgatagtttaaggtaaagtgcttcattggtgtgcaggttagaaatattttaactcacatagtcaggcataaaggtttcaaccacagcaaggacaggctgggccttacacatactaactgagagtgtctgtggagtagtgagatggaaaaacaagcaacagctatagggaatagctgcttcctaggaaatacagcatgagatttggagattgtccccaaagtcataaaggaactcataagtagttaatctagagggtcataatacaatgctgaaattatcagaaacatctgtcatcaggtattataaactctctctcgggacttgtgtagtggccaagggtcagcacagacaggcaagagcaaacattgctggacccttatactaaaatttcttggcagtattgggaagaaatcctcaatttgggattaactccaagactgggaataataactctaaatatcagctactgaattttgtctgtgtgctagaatctctgcaaagtatttcacatataatgttttcagtatacccaaagtgaattccatgaacctttcacagtagtaaacatgaaaaaaattttaataatgacaattatgggttaaaaagctaatggatataaatgataaataattgagatcaaacctaataatttccagataaaatcaagaaggatatgtatatactgacatgcactgacttttttattattatgaagagtaaaagacatcctagaaacaagcatacaaacgagattatttcccaggtacacaaagcaaattaatcctgattttacattaatccaagaaaaataaggaagcattatctacagattgtttttaacattgcttgtgagccaaatattttaacatctgttaattttttttcaagtacaaaggccaaaaaaaatttagcagacatataatttatatacacatataagtgcagaaactgttctacagatatatctttcttaaatgtacgttacttataactgtaacaaccacaaatgaatctaaattagaaattgaggatcaagggatatatggtagactgctctctgaaaggttcaacaggtactgtttccaaactatcttaagacactggagaagaatacactgtataaaaacggcctgagccattagaaaattaaggctgaaatggatgttatgatgtttccttttacactggcatttgtacactttaaaaggaagcaattctaatgtcgaagactatccttcagtattgaaataatcctataatgaacaaaagaaatttctctagaaattttcttctctcagcttaagattctcacttgtgtaattaaataagtttgtaattgtgtttaagataatacggtttggggaggatatgaatatttctgtttgatgggtttttattttattcttcttaggtgaccatatgttcttcataaaaaacatatgaacatgaaaaagtaaagaacctagaaaatttatttgtgaattgaatatatgaagtctgtgttatattttacataattcaattaaatgtacttcacatttctcaaatttgtatattattgagaaaatgtataacctttgtgaagaattttctgggttttgttgttgttgttgttgttgttttgagactgggtcttgctctgtcacccagactgagtgcagtggtgtgatcatggctcaagcaatctgccaacctcagcctctcccactcagcctcccaagtagtggggacaacaggcgtgtaccaccatgcttggataattttctttttattatcgtttgtagagctgacatctctgtatgtttccctggctggtctcaaactcctgggctcaagcaatcctctcgccttagcctcccaaagtgttgggattacaggcgtgagccaccgaaccaccgacccagccccccataatttccttttaagcggttggcagaagagggtatttgtgttctgtcattgattttgccgcttcctctcaccacttcttgtggttttcatagaagttctgagtagcaatgctgcagaggcaactcttccaagactaactcgttcagcttacggagctccagagtttatgttatttgtaaagctgacttcctcagatttcatcagatatctttgagaaacaaaaagaccctgacatgacctttctcattatgtattctgttgacattgcaaggagaaagaaaaacccacagaatactgaacaatgcttatcgtagttaaaagaagaaaacacattctataattatgtgcttaataaccctcatgaggctgggcatggcggctcacacctgtaatcccagcactttgggaggccgaggcaggtggatcatgaggtcgggagattgagaccatcctggccaacatagtgaaaccccgtctctactaaaatacaaaacattaggccggcatggtggcgcatgcctgtagtcccagccactcgggaggctgaggcaggagaatcgcttgaatccgggaggcggaggttgcagtaagcccagattacgccagtgcactccagcctgacgacagagcaagactccatctaaaaaaaaaaaaaaaaaaaccctcatgaaaccttaataatcaatgttgtaaataaattattcacaccaggaacaaaataataaagattattatagttcaattgaattatctaacaaagagtccataatccaccgtgacatttcttggatattttcagaagaattgatgtagttaagcttaggcaaaccatattagagagataagtgtagagcctacctttaataagatctctagagaagatacttctacaaccttcagaagctcactgacagtatttaataaaacttacacgatgtacttatgttatcagaagaaagatttaaacttctatatgaaaaaatgacattgtagaattggagaactggtcatacaatagtaggaacagggactgccttcactgagctccatgcagtttgtaaactttattttacttaacctattgagagctttataatgcaagtatcatgaaagaactacagtgccagcaaataatgggtatttaaaggtttgttttgttaaactgaggcctcaccaaaacatcataaaacagatgactttgtccctattttgcagttgaggaaaaagactcaaagagatgaattagctttctcaagataacataccagcaatcgtttgaaaacacaagtttatctgatacgaaagcttccctggatagatctgctctattgtgacattttaaaacatacattttttttattagctgaatttatattttcaggtattttcttacactgctgacaaagaaatccgaaccgatgacttgtgcttggatgtttctagactcaatggacctgtaatcatgttaaaatgccaccatatgagaggaaatcagttatgggaatatgatgctgaggtatagtattttcttaatttacttattatttgatgcttaagctcagttatatatttcaacattcaacatttaaatcttaagctggtttttatctacattggcagaattagattttcaagcatgcaggctcatatccggtaatattaggatggcatatcatataaacaggtttcaccaaattggtccattaatataaaatatgaatgaggacaataaaatcagttttgtgtatgacaacttgttatctccatgtacatgccaaacataaattaggcaagaggtaagctaagcctatctgagaggtttgtatgaagatgtgcatacaggataatattgacaatatgtccatattttcaaattttaaattttacaatactaatcactgacatttatgttcctcaactggaaggaacaatatctgacaagattaacaagatttctttactgtttacagttgtaaatattttgcagaattcagtaaactaattagtcacataaaaagttgagtagcctcttctcaatatagcacacctttctgacagagaagagggagagaaaaccacaaaattactgttggaaatttatctccaggcagtgtgtaaaaaccagatcagccatcagatggagctaataaaaaagaaatattttcctttgcataacgaagcttactcttgaaaacagcttcatttctttcagttttcttttttgattaacaaaatgaattggttgtctgtgttacatttcccacattattaagtggtaggtgatttatttaaaaggaaaactaaacttcgttctgcttaaaagataaatactactatagaggtaaatgagtctcacagatgcagtattccatgcaagcctaaaattttctacaagaataacattttaaaaaccaatctacagagtttttggtattgttgatattttagcaagaccttttaaaaacctttttgaatgtcgttttaatatttgcatgagtctgtagtttcttaagttgaatactagaaaaatttactgaattctcataggatttgaaactggttgtgcagggttaattttgggcctaacactcatacagtgttaccaggatcttaggacacaaaatcatcttctgggccataattgagggcaaacactgagaattcttcctatgttgtaccagtgtgattaagatgctactgccttcgctatatcttactcaccttgtctgaccaccaatttttttctcttcaactattatttattggtaccatccttgatattaagcctacagaaaacagtgcctttgcaaaatacatgtaggtaaatccttcatcagtactctcttctatgaggaaaagtgcagtaaaatgtacagatatagtagaaatcctgtaagtgatatttgtttttaaataaaacttgttcttcttgttgttactgttccgtttctaccaggaacctggggctctactgagcttatgctaaaaataagaaaatctagaatatatttattaagaaaggggaatgatcgtgtacatttttataaaagcaagcagtgtggaattttagaataccacttttaatctttaaacttttccataactcttgagtgaacaatgtcataactcaaattctttcatttctcaaataactactgttagcaatttggtgtatattttggtttacattttctgtcagctagtagcaatgctattgaatactaaggaattttaagtaaaaagtgaaaaaaaaaataggtagcttcacataggtagataaataaatgatttctataaatttactcttttggatgactagtagttatctgttgcagtatttcagagcactataatattttgtgtcatgtttactttgactttggaacacacgcacaaaaagcttataaaatgtcataaatattgagaaatttttattttaaataatttgatcatctgaattatatagcttaattaaattctcttatatgtttatgttttcaaaattaactagtgatgtttacattgtctaatgacagcactttgccaaattaaaaaatgcataggtcataatctaataaatgacatgagaatagagcaattgtaggaataatacattgcctttctggaaatttcagctttgatgtgcgattatatttttgagaaggtcgttaaaaaggattttttttaaacaaaattgaaatataacatttattactatgcttttcagttttacatttagggtttctttagttcacagaatggttccaccccttgctacccacagggtgattccaggagtagtagcatcacctgggaacttgttagaaatgcaggatccgaacccatgctaaacacactgaatccaagtttgtattttaacaaaatctccgatcattcatatacatatttacatttgaaaaggacagggtcaaatatctatgtatcttccatagtctttttatacactggttaaagaatgttacaaatttaggaaaaggcatgaatacaatttggaaaatggcaaggcctccagaggggagcagagagagggaaagggagcaaaaggataagaggtgttgagatgagaaagaggaataattgctcagtggttctattcttctcatattccaacctgtggaaagtaaatgcgcactgcttactactttaactcaattctttatcttttgctggcaaggacaaaattattctttgaaaaatctctgaggtggtgcaggttcaaggcagaataaaaattgttggagttcatagaattacagaactgaaatgtaccttaaagttctctcctttaagcctttatcaggaggaactaaagcataaagattacaccgctagcagcagagctaggattcaggtcctaataaagtattccaagcaagctagctatcagtacaattgtgaatctcaccatgtgaacagcacaaatattccatcaccttatctcccatagtcctttcaatcttagaaaagaaagtcataaatagaagcaagattgttggaatatccagagaaaaatggaaacagtgtcatgaagcctcaaaagatggaatctatccagctactttggttttgtttacttcttaggtgagtgggggaaaagagaaggaatacagttcaacacgtatttatctgttttctcatgcaattcttacaatagtcttataagacagttattctatttttcacattagtaaaatgaagcatagggtaaatgcctcgtttaagtttgcacagccagattctggcagtaaatccagcaatttttctactacactacattgcctcttgatgttgtcgaaaaactggaaataattagattctctttcagtggttaagatataataagctaaatatacagtatttcaaatggaatagctaaatgctatcagttatttgttatgccaaattttgaactaaaatttctcatttttttaatagggggaaaggtgttctacaataaatatggtccatttagctaaataagcagtcataaaactactttgtcattttgctctaattgcttacaaacttcagctatacatattcataatataatatctaattgcttatccttgtaattgaatgaaactaagcacatgttagtaataaatgcacttctttggtcaactttgatttcaagtgtagtttctcacacccctaactaaatagtccttaaataaccacgaattcaattcactgtcatcttatatgtggcctaacctgtttgaattgagggcatcctgggcatcattagcaaaattgtggggtacctacgtggtctggaagcttaaataaattgcacaaacccttctgtgccatgaaatgcctattgccaggattaaatgaagagaaaaaaattcatctcactgagacattttaaaaattatttttataaagttctgtcatccattaattctattgttttcaggtgttcttatattctgtttgaacattataattatgttccaatcaatttagaatatttccctatgatatgtgcacataattacatttctttttgaataactaggcagctacatacagtgtgagaatctaattttagatcagaacacttatgttcaacaaacactatgcaacaaagaaaaaaagggagaaaaatatgatactaaaaataacttatttttcatgtgactgagcaagttgacttagaaaatacttgttgtgaattctatatacatctgtatcaaataatttccagagtcacaatataaggaatttttttccataggtgaaatgtgttagattaatatttagactttacttacactaccatcttttatttacctttattagagagcaggtaaatgggattataatttcaaggtaagtgatctttaagtgcatcccagccattcccctgtgtagcattcctaagaaaaacaatggctcaatttaccttttgaaggttgtgtgcattacacagttattacctttccatattcctattgacccatagctgtgatttcttattagaagtagtgagtaggaatttcaatagattagcgtcatatttgtagttcctatatgttaaatgattacacttcatattttataatatttctgttcgactgaatgcgtagattaccttgtctggagatcataattaatgttttgagtaacaactttgttatattaatttttaattgttattctatgcttgattaacagaagaactcctattatctttgctattaaattaaatatagtacaaatttatacttattttgtatatgattatatgtaataacataattgattgggttttattttaatcttttactataccaacttttaaactgagacctgtgcgattggctcttaaatcaactatgcagtcagttcattaaaatatctatttttttaaattagtatgttttaataccaaggtatggcctaattttacaatattaatggctcttattttgtcaccaaaattgtttagcctgattccagttggctttaagtaggaattatatatttggaagggtaaagttagagatactccacgctacattttatgttagtcaaacttgcaaatatatttaaaggcatgaatcgttaatatttttcttatgtatttttacatgttacgattaaaatattctacattgcaggcaataccaaggctttgcattctagaggagaacaataaagtaatactatattataaacaaaactcaatactatcttagggtttagatgatcctatttttagtcaatattttaaataaagctataggaaaatatatttggcagtaagttgcatgtcagcctggatgtcacattgtcttcaaagttgagttaatatagctggatgtagtggcatgggcctgtagtaccagctacttggcaagctgagatgggaggattgctagagcccaagagttcaaggccagcctgggcaatatagtgagaccctttctctaaaacaaaacaaaagtagactaattaggcatttgcaacaaaaacagatataactaagggttgatatacctaataaagagcatatcaacccttaattactatactttttgaaagggaaatagtataccacatatagaaatgtgcaaggacttgaataaacagcatagtagaaatgtagccaaagaaaatgaaaaaaagtttttaaaaaacataaataaaaatcattttatgtgtgttactgtattcatttcttgcttatcctttcaatacagcaagaaatgtttttagcagcaacatgtaatattggtgaagatgcagtgagactgacacccataaagtatcctggcagatagcaagcacaagaagtgttagctgctgctgctattattacaaaattactgttatagatatattttaaaggactttgctgatatgtgttaaagtgttcatgtatttgaccttgcaatttcacttctaagaatcatttccaaagaaataatgacagatgtagacattgatgttcagagatatttgccatgtgttattaataatgacaaatatctctgaatatcaatatattgatcaaatatctctgaaatacaatatatttttgttatttgcaatagctccaaattggaaagatattccctgcaaataaaaaagttaaatggattttggaaattcattttagagaaatagtttatttcttaatagtatgtttgtagattattttagtgatagaaaaaatgcccacaacatgaataaaagaatattttattatatgacctcaattgtataaatacataaaattattagaacatacatacaatattaataattgttatcttttcaaacagtatactgagaaaaaaatgaactatgctttgttttcaagcaaatgaagacactaaataattttgtgtgtttttaaatgaaaaataatttttgtctcaataaggacaagatttgtaatttttcttctgggctatggctttttagaagtacctggaatgaaacttctttgactattttttcatggccattcatttgataaacacctttgggacatatgttacagtcatttttttaatgaaaattctatattgtatttatgccctggggtcatgtttccagaggataagcaaaatcattttgtttttgttttatgtcataaaaataatttttcttctatattacaaacataattaacatcatttacactaatatctttgttgttaaagtggcattttccaagaaaagttcacttcaaggagaaatatcactgagagtagaggatgatctagcctagcagttttgaacagtatgggtggaaaattcatgtttggtttaaaaacaaaaatataaactagtcttcttaaaaaatcaagctatatagttaacaatattatttatagttacagttttaatattaactacatagttaatattatgaatacaatgttattttttctttctttacaaattatgtactattttactgtggaagataaatccttgaaaacataaatccaataatttgtgttcattaagctgcctgagagaagtagcttaattttaacaggatttattgtctgcactggtctttcactaagtgtttgaatcaacagacttacttagtgtctcccaagggcaggcacggagcttcaagatgtaggtggccatagtctgtggctttcctggagcttatgttcctatggaggaaatagatggagagcaagaaacagacagataaattaattaattaaaattgtttggagaattagattaagagttaatctttttctttttcctcccttcattatctacctttctaattgacatctaacaaaggtggcaatgtacatgtggaacacaacccaggttagccttgtaaaaacataagtgggagcaatttgagtaccatactgttcaaagtaaagccttaaagctaaattatcctctgaatttgtccctgatatttatttaattttagggtgaaagaatgaggaggccaagggccatagctggactaatcaactattttgaatatccactcgcaaataactcatctggtactaaaaagcattgtattactaggatgaaggctgagaatataatcttttatatctaaaataaccttttgccaaaaatatttcattattttatcgtaagcccctctccatattctcagtcttatcttcatttactccttccttatagggttgatattaaagccatctaaaaaaatgtggctcacagctccatggatacaattattgtgacatgtgccttccatctttatccagtagaaattgcatgttgcctaggatgattgatttattactgtctttgtacttgattttgtcattattcgttattttctttgtcaaacagacccacactcttcttcatataatcacccagtcttgtctctcagtgaacaaagtagctgatggctcccagcatcctactgtggaaacctgtaatgatagcactttgcaaaaatggctactaagaaactatacaagaatggaaatttttagaaatatttttgggaattctactgattacattctctaatgatttttggaggtttgtgttgcagattttattaaatttattttagcatttttgttatgttcagttattgaaatctggaaactcctttaaaatgtggttaagaaaaatttgtatgaccttttctccatggagttaactctctgtcttttacttcctagctactcattaatttggggactgcatatattaagttgtgtttagtctatccttaatgagtaggggtttttttgttttttttctttattttaaacatatatatgcataaatatacttgatgaacgatattatgaaatattaactctctttgaggcaaactatagccatgtctatatgacaacaggttctgcgtcatcagatctgaaaaaaatcgattaaaaaactaacagggccaaagaaagtattgtttctaagacactggaatcatttatttttgtttctttttattcagatactttggttaaatgcaaatatggcatatcctttctaaagtatcttattattttaattaaaacactaagcaaacacattattaaagactaagatgtgatttttaatacctttataaagaaaattatttctaagcatttctttgtggttgcctaagtgaaacaatatttttttaagttgtatcttttatctctcacttttacgatttgtgactatcttttcagcaagcaataaaatgaatcattacacaggtcaagtcaacaaactgatatggaattcttgtaaagagtgcaaataagaacatgtcctagcttttagttttaaagagtgtattatccaataattaaaggattttactttgtcccagaccttacaatgagaacacaaggaagattggggcatttttctggttcagatgaaccacttaaagattgttagtggaggaaacaattgagcttagaagtcttggaacaaggctagaaatgaaattatggatgaggggacaacatatggggtactattttacttagaactatattcaagccaaagacattccaaatgtaagagttggtaaagctggaaaagtctaggtcttttgcacaaagagaacttatgtacagagcaatttatgtgtattatcttagtttgctttcagagcaaccaatcctgatacgtgcagtgccaaaaaaggaagcttaggcttaactaaatatttattctcacaagtctactgtagagtgctagagcagagaccacagagtgcttctctccataggagaaattggagcagttcccttagcagttcttacagccttctttacaggtaacagtctgttgcaaggagatgagatccacatcaggcagatgtcaaaaccatcctggcttattagccttatcctcacagaagatgatgtttccttgtaacaactccataggcctagcttccaggaaccaaataaaacatttagaattacaagtctgcatttagaaaagcccgaagtttgcttttctgttagtatatatatgcaatttatcagttgcagatgcagtttatcaatcagagttcacttttaccataaacaatgtagcctagaaacatagttaacatttttaccctttcaaggttgccaggggattacagttagatagttgactgaaggtcaaattttttaaacaaaagggaaaaactgtatttgtaagcatgtttaagtctaagtattttctgacaaagaacatgattcctcagaataatttgaaacatgcctgagtgttcacagccagtaagtaaaggacaggaatttacctgagtctaaaaggtctggttttccactgcactacattataaaggagaagtatttagttgtttgtctctgcagcagtgggttttgactattagtgaattccttcaaataaatcatatattgtttagaaagaacaataataactagtgtttttaaaattattatttgtgcagttgacaacatctattcaacatgttccttaaagaaaaatctccctaagtctgtgctatattttgaactaaggtaactgataattgatcaaagcattcaactactatgatatgtgatcaattgcaataagacactgggagtgctttccggggtagcttaatgggcaatgacatatttgatatatgaaaaatcatactttttttaaaaagggatctaatagaagtatgcaatggtaagtgatatttttgaaagagaatatatacataaaagaccacaggtacgtaacaaaaatgaaacaattttgttgatttttaactagaactgtctagaaaaaatacatattgtttttgttatgcatctttattttttcaagctggctactggttgaatttctggcataataagcataaatcagccatcttcttgcctatctttggccatttattcctttctttgttttttagtgtaaatagcttgattccatgttttgaaagagcaacaacaaaggtctcaatcttgaaatctcctttgtatctaattgccttgctcttttaatttcctgcttgctgcctcttaggcctcttccgccacaaacctattctccattccatcatttcttacaacagtgcagtccacgatgttttcagtcctaatctaagcaaactacaatcgtctggctgctgttcctctaccatttttatggcccaccccttacatttactttcatcccattttcaatgtagtatcatgagccaaaaaaaaaaaaaaaaaaaaaaaaatttctttgcctttaattttggtaatttgcaaaaaaaaaagtatctagagtgctattttcaagatatatttgcaaatcatctctcatacattcaaatacttcgcttctggttggagaggttttcatataatatgatcctaggtattgcccatgaaatagcagaaatatatataattagtatgtataaatcatgttgatttaaaatgtatatctgaaaagtccaaaaatgtgatttccaatgtacgtaaaaatgccaaagagaagatatataatgactggttaacatacaattattggaatttatgaagaaactaaaatataaatataatgtttaaaaatatgtgatcatcatgcccctgtttttatgttatatttttaagattcttaaaaatacagaccaaactattgtaaggattttatcaagtaagacagattattttttgctctgataatcactttctacaatgagtgtcttacagtcacagatactatagcttgtttagtattttgaaatgggaacatctctagcagttttgttcatttgggtcacagctgtgccatctatttgcatgtttaccaaatggttactgaataacacatgcctaagaaaactaagcttttgcaaaagcttgttaatatttgcagtcctcaactgaactcggagctcacaaatgggctttttgcaaaggagcctgaattcttggcaatgcttgataaatgtcagtcagtttctttagccatctgcaaataaaggtatattagacaatgatgacttcataacagtcaaagatgtataataattaatccagggacacctgtgcacagttccttttacaaagctatcacagtgtattatactataaaaatcataaaggattttttaaagaacagattttatctgatgtgctagcaaagctaaagacgaaataagctgcactgattattggttatcttttacagagactcacgttgcgacatgttaacagtaaccaatgtctcgatgaaccttctgaagaagacaaaatggtgcctacaatgcaggactgtagtggaagcagatcccaacagtggctgctaaggaacatgaccttgggcacatgaagatcatgtcctccaagccatgaaagtgtctacgcttttgtttttccattatttcaattgggggaaaatattaactttgctgaattgaaagttttaaaaatccttttagtattctaaaacacaattgtttctaattcgtttctagaaatgtttgcttatttccctactaaaatttgtatctgatcaaagcacataagaatataaataatagcaaactactattaaacaacagaacaacttgtaaaacaaattgtgtttgctttaagaaaaatgtttattgcactcatgtcatagggttaattggaggttattttatttttggttgtcatggtgattgaaagagataatgtaaatgccttataaaatcttcattatgaaatattatcagttgctttataaactcactctttttatggatccttcatggaaacatgtttgatttctgtgtctacaacagggccacatattaaattacttctgaatggtgaattcatcttacaaaatgttccaagttttggacaaggaaaaacattacattggatattgaattcatggagcctttacagaagcatcacatttaaaccaatgtgaattcaaaaaagagaaggaaactttttaaattcaatttagagtacataaaaaaagaaatccgcgaagcattgaggggaacaagatgagtctaatccgcagcacttcgatcactgtgagagaactcaaagtgggttgcaatcattcctaacacaggctgaaactaaacaatcttgctcctagagtttatgttggatactcaattcttaaccaaaatcttggtctccacaaactctaccatcccttttctcttcactctatagacagtggcatgccattgatgctgtacagaattgcaggtgaaagggagaattttagacttaatttttaactctattgcacttaaagattttagttaggttaccactgtcattttcattttctatgttaaagaatacctttcagtgctgtgctccagtatctaaaaattttatcaccaggggaataaactcaatacacattcattaaacttttgttgtaattaaactgctatatattgtttgccatatattatggcccaaggaatatagttataatcaggctacattcacattttcttttctcatcttaaaaccctttatgttcaaaatacattagcagaggccatgaaagtgaaaaaaaatcagatttttgctagtaagtttttatatttgacatcattttaaatgctcaaagagttgccctatatatgcatgttatccattataaatgcactcagcagctaagagaaatttgagaggaaaagtggaagaagtgttttctggagcagaagattccacttctttggtcctcatctttacttaaaaagctcttatagaaaggattaatcattttgactgcatacaaactatgtctctgacatgcacatacactgctttataatgaaaatgaggacactttctgatggtcagtaaaatcttaaatgatttttgccactggtattccttcctcttttgactttttattggtacaactgtagggaagaatctacaacctggagcatttcaggtttgctctttaaatatagacacccctcaccatgagctctctgtgaatccgtgaatttcctaaaattgtaagcaaaatgttgaatatcagggcatttttttttctgaggtgggagtatgtcactcacagcaaacttggaaagaaggctatgactcccaagaggcagtgaaccattgccttaaattaatagcagcctctcaagtccattgaggcctcatgtaaaattcccatttttcatctttacactccttttctcccctcatttcctcttctccttactaaggtaaaaagaccctgcacagcattattacttaagttgaaaaagcttcaactctcaaggactcatgtataccatatgttccacttattgctttgttagtcaaaatgcatgttatgtagaaaatggtcaatggcaaatttttataaatacagctaccccatcaaagctgaacttgaaacgttttagcagaattttaaatatgtgaaagttcattgtggtcatggtgagaaaactaaaactacatgagtttcatgttagaaaagaatttttaaacaatcttcagatggcttgaacacgtgccattatagtatctaacaaaaagtggcataaaatattacaaaacatccaacactagaaagcaatgactaacatttaatttgtttacaaaaatgtttattgtcttcagtacaaaaagttaaaaccatgattggattcataatgcacttgtcttatcccttatttatggagctagactgacatatttcaaaccaatctcttctgtggtcttctccatctcagttaatgcaacttcaaccttccagatgctcaggtcaaaaactgaaagttgcttttgactcctctatttctgtttcaactctcgtctaatccaacagcaaatccccttgatgctacctttgaaatataactagaaaagaatgacttgccaccatatccactaggtgtcactacctctaacctttttaatcgcaatatgcttattatttagttccctaatttcccagtccttgtcttgaacaatcttttctcagtacaacagccatagtgattctgttaaccatgaatttgattgtgtcacttccctgctcacaatcttccaatgacttctccctccggtggccttcaaggtcctttatgagtgttacccctctacacgtccacaccactcaccacacatacatacacatgcacacacacacacatgcaattctacctttttctaacaccatctcttatctctcattattctgcctcttacttaccctattatggctcccaagaaagttcctgctttagtgttttgttccctctgccccagagagctccccttagtgatctcagttcaaatattatcttatcagtaagacaaacccttctcccatctgccttccctatcccctgtacctgacaatctatgagtttgcttctttatttctgtctatacttccccctccccagccccaaacatgcccatcacatgccctagaaggtaagtcccatgaaggcaggggctttgtcagttttgttcatttggtatttctggcatatatattctctaaatatttcttgaattaatgaactgaaaaatgtgtgttaaagttgctaagtgtaactgtatcatactttttttgtattttaaattttaaaataaaggctaatatatttagacaggatttccaaaaa

SEQ ID NO: 98 - DNA, 293716 bp, Homo sapiens
atatctctaggggtttatgacaggctgttttcttttctcagtgtggggatgaattgctccattatcatctaaattggaagtcatgatgatggttcttttttgattctcttatttatttttgtttatttgttaagaaacttgtatagaaaatgtgttgcttatctggaagttgcgattcttgcttaggccacataataaccttgtatttcttcagatatttatgtatatatacctaaaagggaaatattttatatccttagaccagatctaacttaatttgtttctttgattctttcacataggctaaataatacaacctcttgttgatcatccaaaagtcacattgttaagttgcattttctttaaaatgatttttgcaatgatatacagaaaagttatttatatatatgttcactttttttttctctttctccaaggaaaccaacatgtctgacaaaagtgacttaaaagctgagctagagcgcaaaaagcagcgcttagcacagataagagaagagaagaaacggaaggaagaggagaggaaaaagaaagaggtaaatcctgggtgttggggtgttgtgggggaaaaaggaaaatcacttgattctgaggggctggtcaaatggataaataggactccctaaaagaatccttttatgatatctgaataaaatgattatcttcctattctgcatggtaaagttgttgccctctgctatgtgctggtcagccatcacctaaatgggggataacatttggtccagaggctccagaggcctgcagactccaggcttatcacagacttgaagagaactctaaggatggtctctgatcttgttattgttagaaacttcttaacctttctgtgcctcagtttcctatttttaatatgagaacaataatgcatttattttgtggggttgcacttagcagtatctagaatatagttagtatattctaactataagtgttagttttaagaaaagggttttttgaaaaatctaccagcaggaacattttaggagaaaattagaaaactatgccaatggatttctattgtttccaaaatggtatatatattttttatggtaaataagcatcttaggtttggtaagggggaggctgttcttctcttagagagaaggtaaataggatagtacagtacaaagaattattacatgttagatctggctgaaatttcagagactttccactgaggcctttctttatgccaacaaagcagcagagacccagaggtgaaatgtagcttttctactttctagacctagaatcttggattctataagcccaatccaatgccttgttgtcatatcatgttttcttccactatgtgaatcaaacaaataatttatttttaattctctaatttgtcgtggcagtgtaggaatagcccacatcttatacaaaaaccagataccaaagatatttttgaatagctttctaagaagaaaacttcgtgtggtatgatatgcttttgtgtatagaaaccagagctgcttccctatgcagttcttctgtaaggaaaaagaaaacttattttgatgccttacaatctaaataagtgttgtttcatactacaaggctgagagaccaaggtaatagatttacaacaattattattttccaacaaaataaaagatgattgcagttgcattttagccttctggcatctctcatctctccataccattacgtgttgattgatgtgatcatttatttgtccttgacatcacacataatgttttttccctttgagatctttgctgttacatactcagtctttgagtgaagtagaggtgagaattgacaaggaatggctattcatttccatgcaaagtcaaaaaaagcattaagttattatatttcctttccctcaaatgtcaacacttactgtagttttaaagcacctgctatcctttactaataaccagtttccttttaaactgacattctaatatccaacttgaatgtcataaaattaccactaaatgtgatgtgatatgggaaatttggttccaaattatgctgtctgcttcatctttttcattttacacattttggggaaattacaggcaaactagactgatggaagcagtctccccttttgattctacaaccaagcacttttgcctggtgaggatttagctggtttcaaagcaagaagagccctgggaggttggaggctgcaggtagtggagggtgtggaacacctggactctagacattcctggttgttgccttgttctggaattgacatcatatgaagttctagtttcctcatttctaaactgacttggtgattgaagcttgtgataactgaactgtgctctacagagtcagatggcaatacagagtccgagtcttccatcctcaaagtttctgatttgagtgatctgaagcagggtcagattttgggatccgttggaccacatcatctgtagtgtctctcctggcttgaaatcttttcccttcacacccatctcccctcaaagaggtctttccttgattctgtccatgcactctctgcaactgtgctgacttggtttgttctgagcagccaaggctgtaagacagaagacataaacacagtgattatgcacaggggcttttgagttgaacatggctgggaaacctggatctgcccttcacagaatggccctgagtgggtatgggtcctctctaaacctgtttcctcttctgtaaaatggagaaaggaatgatgtcttcctcacagattcaagaggataatagaagatcccagagcagtaaaagacagctgtcattctgcttctgagatcagctatcagagtagatgaatggggcttcatagaatggtcacatacatttttaggatctctgctggtgaggccattttataaaaatgccccattgttggaagggtcttaaaattcaaggcccccagtttcatggggttggagcattttgtggctgaaaggaatctggaagtcatctattctgatcctttctcacatggggaagctgggcttcagaggtctaagccttagagccaggccccctttatctccaatcacgtgaaggagtctggagttaaaagggggctacctctaaggctcatacagccagtttcccagatcagaaacctgaagtcaccctttcaccaccccctaccccaattcgcagtgatcatcaggtctggacaggcatagcaggactctctttttgcctccattttttttctccctaaaatccacattccagtcagatgcagctgcttacatataccctgatggactacattctttcttgtcagagagcttaagatgttctctttcctctgctttcactgatctcctacttcttcctatcatcctttgcctggctgttaactttacctggctgtccttcacctggctgttaactgcatgtctttccgttctcatctcaaatgtcactttcccagaaagctgcctctgatacctttacccataactaggttagttctgcatcctatcttgacattatcaaaccgtttagtacaagatgttatattttccccttcacttgtctttttctcttaagagattgcaagctttcaaggtcagggctatatgcttttgttgttgttgttgttgtttgttttttaatcattgagtcaatgtcaaatatattggacatatggtaggcattcaaaaaggagttatagaatgaatgaatgagtgaataaatgaacatatgaactagtcagggcaggtttgagaggcacgtcccagacatcctttccaagcatctggtgttctattctgcaaatttctttggaaacttctgatcctgaatccatgggatatcgactggccactgtcactgactcccgagtttaagattttctagttttgtgttgtttatagagaatcagaaatagctttaaatagtcttgatttttataaactttctttaggcttatattttcaataaaacaaataaatttaacattaaaaagaaaagaaatgctctttaatactaaactaagtgccctttttttgccatgaatataaaaactagtgtgaattaggaccacccaagttgattatctccacagaattcagaaaactgtgtccatattgtgtaaaaattaccaccctttgctcttttggatgtcaactgctttcttggctgtgatattatggatgaaatctgattttaaaataaatatagtggccaccatttaagacactggcccaatttaatgaaaaattggctttaatgcaatgaggtgagctcagtgggggccaccctgaagtttcattctgtccttggcttcctgccgaattgctgcaaggtagaatggccaggggtttcctggcctgtcctcacatgtttctctaataaatgtggaaatgtctttaggaaagtgattgacaattctcagctgacaaatttttctttcttcgattatcctctctgggtttcagctgtgattactctccaccaacagaaatataacttgctgagaaaggcaccttgaagatttttaattactaatactgcaaaatcactccttgttgaatcattaaaacatagtaggattctgtagtagatacagatcctcactctgcaacatcttttttctcatcttagttctatctttgcctctgttgtatacataaactttgggacttgtttcagtagtttaaatgttaaaattggaaaagaacatgaactttgatatcttcactgataagagattaaactgccatttcataattttgggttatgcagagtgtctgactctaagactcttataagcccttattggctttcaaatggtagttttccctctaatgacagatagacttcaaaaatatgagtgatttagctcaaagttaataataacagaattgttgagcacagagacatatgcaaagatgcacttagtttataatcagtgtgtaggttaccctctgggagtaagtcaaaagttgcataaactctttctgcttatagatactacagtgtagctaatgcttcacttgctttgaaaggtattctacatgcccaaagaaagtaatgtacttgttagcatacccagctttccttggggaagaaggtatgtctcataatgaaatgttttttgacaggctttaagacagcctcacttctgtaagcttacaaagctttgttgtgaggtagttacacatcaacgtgatgttatcatgtttcagatgtggggcaaataacttatcttaagtaataactgtattatgaaagagagaagagacttggaatttttaaatttcccctagaatcccaccacagatcttgtttacctgcattttaatttgtcactgatctgtaaaaacaccaactgggcataggatctgacattaagaggccagtatgaaaaacataatgtgtttttagacagaatttgtgaaaggaatttcttgtaaatgttttgttttactatattttctacatgataattttcttcttccagttagtatatataatggaatgctgtgaaaattagaataaagtaccaagacatatcaatattgatcacatgccttaatacagattttagcccagtttattttaaaccatggcaaacttgtcttagcaatacaaatagtgtgttttatagttaaaaattttcataaatagtttcacttttcagcaagatcccaacaatacctggtttgcacaatcccaaacatggggcctgaatattacaaacacacagtcatcaataactgatatcccagaagggacaaggaagtctaaaaaaagagacagaatttttttttatattatatccccagccagaaatactttgccttgatgttttctcttccaaaacctgtgagagaaactttcatcccacgtgatagaagcaggaaaaagccttcagccaaaagagaaagtactgggccagtaattattaaatggggcaattatggtgtttattcatcctttatacatgtgattatatctatttagggctttcaccttgtcttcactgccatgcatttatcatttttagtttcagccaggaaaagcatacatttagttatgttattaacttttcttactgacgtctacttctaggctgatatgcagcagaagaaagaacccgttcaggacgactctgatctggatcgcaaacgacgagagacagaggctttgctgcaaagcattggtatctcaccggagccgcctctaggtacttaaaagtgcttcctgttactattcctcaaaatcaacttgcgtgggatataccatgtccagtgtttactattcttttaagtctttagttttttttaatttttatttttaaagacattctgtggcttatggttcaggttgcatgtgtttttggaattgagggggctggaaggagatgggaggaaagttgtagaattgtcagtagtttggggcttactgactgattagatggtcaaccttctccaccgtgttactagtagattattttatacttgttaaatgagttgccacttggtaaatataagaaatcttggaatgtcttattaaattgttcctcattttcattgctgagttccagtgtctctttgccaatctaaatactgtggatctgggttatgaatttcataactaccacaggcatagagttagtctatgatgaaaatagaaggcacagtgagaatttgaaggaaaacaaaatggtggcagattagcagccgattaacaagtttaaattaatttgactttattgtattttgatttgattactaattggcattttcactacaatactcctcctctaattcgttcattcctagttggttgtctgtgacctcattttatcactaaagcttggatattgaattattggttttctttgtgttgaaggtaacttgtgcatattttgtttattctgtcacttacctatgtatctctcatgtaatagttttatttttcttttatccttttgttttccatacatttaagattaatcctagggtgtctataaaactacattatatccaatatagttaaaaacccttttggaagaatacataaaaataaatacagtattcagatcttttgtttagaatactttcttctgaagttaattccataatttacttttatattaaaataaattatcatttatttccatagttagttaaactaagaatataaattatcccatgtagaacaaaatggcaaatgtttatatcaatgtgaataagaaaaagaacaatatataataagcttaaaaattattaagtattgctggatgtaatttaatacacacaaaactaaaacactattaaaaatcattttatactcaatctcaatttgtaataggtaaaaatagtatgttcaacaatgctataataagccccaataagattagattctttggtttaatttcttcatgttgtggaagatgtaacctaggggacgttatatttgactgatggaccttcttttctacttaggagctgatacacatttttttctacttagttgacatctgatatgagttagacacattgcaatcaattatatttgtgcctcaaaatagcctttgaaattatgttgcaatgtgaacactggttaaatacaataatagtatgtcctagtctcccctaccctacataaagccagtaattaaactttaagaacaaaacagattaacatctctaaaccatgaccaacttttgaagtatccttgcattactgccaacggactctggcaagggccctgttttcatttttcagccatctcttcgacttaccctctgagcttactcagagggtaagtaatcagtgaattaattgtgggaccacatgaaaattcctagcttctcgacagatctgccattgtgttataggatttgggtaaaacagttaagccctttaccctattaagtaaataaaaggaaattgcacatgattgaaaccaaatgggaatctacatttacgtactgaaatttctttctatccatatggcttctctggcatatgtgatattgagaacccgttgaattgcctggcctggagccatcttggctatttggtgcagcttctatctgaaggacatttggcttgtatctgaaggaagggggaaaaaattgcattggctttagcttttttcttttattatgcctgctctcagattttcagcttgtgccgaccttgatctttgaacttgtctcctgtcttcagagtggcagcttacttctgtgcacatggcagggtcttctagagctgctggaggcaaggcaaaacaagtcccaaagacagtaaacagtacaatgggatgcaactattaattaaatgtaaaaataaagcagcctggcatttttctttgttttgaaagagactttttaattaccagtttcaacatttaccctttctctatctgtcacttaggctctcatggcaaacagcttatattccacagagtacatttctctctcaatgcagacatacaacagatttttctgactgtccttgaccatttaaaattattcagaatcacttatttaataaccttttaaagttttatagacaccttgttttatttttaataggtcacatctatactaacaaaataatgtgaagaatcagaattatctggatggttcatgttagagagatatttgacttgaattatctggatagctattttgatgcttcattttactttgttagggtggacatggcctcagaatccctaggttaattctgtctaaatcatttcaaattttaatttccaaaatacaaaaaattcactggacttttttccttttctttccttttttttttttttctttatcccatctcaatgtctcctggccatacaaccactttaatttgggcccatttgttttgatttgtctgacactgctcttcaccagtgcagccgctgcattttttaacatgggatacctgttattttcattatttagtcccaacccctatgtctccctcctcgaaatcagtgagcactcccagtgaagctggaagccaagactcaggcgatctggggccattaacaaggtaagaattgtccctttaaaaggccatgatgggtgtcaattaaaaaaaaaaaaaaacagcaacaacaccactgttagaatactgtgaaatgtgcatgtatctgcatgtgtacttggacatcttatgtttaaatttatggtggcttgctatttttagtggaatagcaatgatcttgaacactagaaatgatcaacatatatcatccttctttgagtgggctaatttagcaccatgtgtcttgcttaacaaacacacacatatccattagcttaggcttaaaaaaggcagggagaagccttttcattatttagtagataattgaatatatatccagcttcttattatcctactttggttttggtttccatgaaagtctttgtgaatagaatattgagatgttctaattctaaatttaatttttcaagtgagttatttgcttagtaaagttgactaatttgaaaactcagtcacctaagtatttttattgtattattattggtagtagtagtatcaggattggctgcttctgtttagtgagttcattgccaaatttgtattacactatgtagactcacagattatgtaacttctgaaagtagatctagacattctgtaatttaatcactgaagaggtatccaaaaggtaaagatgtaaaaagaagaaaggagaagtttcataaatgtagatggagtcatggtaaatctccgaatccagctgtcttcaccagtgttcccacatgccggggtccacaggcaggaatttatgtgagtatggcaactgcacccaattcttaaaggccagatggccccctcatagctcaagctggttgagctcacatgatatgatggacccaatttttccgcattttccagtttttcttgagaagctacaaattcagatattcaggtgataatctcctgaatgttaaatgttaatgacttttgttccaagtagttatgggccagatttggcctgtggcaatttatgaactctagctttgactcttaatttaaaaaaatcataaaatgctttaatcaagttttaaataaaagaagaaacaaccatctacagcactgctgttctaagaagtcagccttttggcttgtctgtgtacctttccagtccttgtctgtgtgcatttcttgcctccgtatgtattactggggcaaagatataaaattttgcatttttctcttttcacctaaggcattagcataagcattttcttctgaaagtgtactgtttccacacaggcatagttaatttggtagctgaagatctggacatgaagataatctagcgttgatctgagctgtagggtttttttgcttttgaaaccaacatataagactggaattatgttacctatttctgcctgttggtgtccttcagacttgaatattttgttttcgtaggccctttggaaaccagtggacactgctttcaattaaaaaaaaagtagaggtttttgagggcataaagctggtttattttagcaaatcgcttttgtgatttggggcagcacatgtcttctctcatcttttgctttgaacacttcaaaaggtctttggcaggaggaagtaatagcaacacagttgtgtaagatctaacatttattcaagagctggcacaatataatcacatttcttggggggggtccattggcctatcattaagttaatgtatttgaccatttctgtaccatgatggtgcgtgtcattactgcttagcttcaagggtgcagttggcagcattcaattctattactgacttcacagttgaggagccctttggaaaactttctaaagaaagctgacctatgctgttagtactctggggacaacagcaattatttcttctcagagaatattactctttatttctttctccttcttaggtgattttttttaactttatgaatcactttggaagaggtgcagcttactcctacccaacacaatagtaacttcaattctttataggaaagttcttgcaagactgagtaactagaagtcaattagtaaacctcctgcaaagtgcaggtttcatagaaatgcaagaaaatttgcattgaaaaatgctagttttcagaaaaactgagcacaaagtttgcttgaggagaacacattaagaatgccttagtaaattctgcccttgttttgaacttaggaaaattccacacaaatttatgtttttttctttaataaaataaatatgaagttaaattgcaggagaatgttatatttcagtttttttaaattccactttgaatgtctttttatgtagaagacacatctttgaaaacaatttatattaactttaacacttcataaaacaggagactgggaaaagagttcagttattcttaagaatataactctatgctcataaatttgcctgtttatgtggaatttgaactcttcaaaaaatggtaaatctttcagaagataacaagaattaaattaacacatctggccgtagctaaaggcacatataaattatctcattcatttgccaaaatttcaaaccaaagctaaaattttctttagaaagccaaaattagcaaacatttcttataatctttgtaactagttaatctgcaaattggcctactcaatgtactttattatagagaagaagtaaaaatagtgctttaacaaaaatccctcttattgattttttttttttttaattttaaagagaccgtcttgctccattgcccaggctggagtacagtggtgcaattatagctcactgcaacctcaaactcctgggctcaagcaatcctcctgcctcggcctcctgagtagctgggactacagccatgcaccaccatgcacagctaatttttatttttactttttgtagagatggagtctcactatgttgtccaggctggtctggaactcctggccttaagcaatccttttgccttggcctcccaaagtgctgggattataggcgtgagccactgcactcagccacctcttactgatttttaagagcagttgagaaaattttaaaaaatgggtagagagtagaaatatgtaagttttcagttatactaatgatttaattttttaaatttcacttaaagtgttaccatttgttttgcaatttatgcttccattgttatatcccatttctcatttacaacttatacttttggttttatcttctttctcctgatcggttttggtagaatcaattaatcattgctcagttaattatactggcaagcaacacgctcttggattttaagagcttgttgaaaaggttagtttgaagggttagttttacttataaacataaatgaaaaatctttgatatactgtatgcaactggaatccaacatattaagaggatactatgctatggttaattagtattgtttcaaaaatgcaaggttattttagtataggaaaatgtcttaccatataatttagcatacaaaaaggtcaaagaaggaaaaataatcattgcaatatgtacttaaattatacttaagaaatttaaacacttattcctatattttaaaatgtagcaaactaggaatagaaaatattttctcaatatggtaaagaatatttgtctgaaacagcttacgctttttatacataagagtgaagcattagcactttatagtcctgaagaacggcttttgtttagttgaacatgtctctcatcctcagaaagtggtgaattccttgaaagtagggactaagtgatactcatgtggtaggtatttgataaatgtttgctgagtgaggtgtggtagctcagaactgtaataccagctacttgggaggctgaggcaggaggattgtttgaggctaggagttcaagaccagcctgggcaacataacatccaagattaaaaaaaaaaaaaaaagtttgtagaatgaactatataattctgctttttaccaatgaggacactgagatgcgcagagagaataagtaattttctcaagttcatacagagtgttgttttgctacagtgctaggtttttacctaggcaggttgattcaagtttccacaatgtatatctctatgctacataatctctaacagtagttgatatgagtgatacacaacctaccccataaggttattgtgaggattatacaaagtaatgctctataaagtactcagaaaggagtctggtgtatactaactatatgtgagttttagcaattattataattttttcatattttaatttagccatttttcctatgggaaaaaatctttttagatcctctcatagaacatgttggtgtcattttcaattttagtaagcattgcctgtatctttatccacgtaattacataaaattattaaacatgacaaggcaaaggacagattgtaatccatgcccctacagaccacattctgggttgcccactccttactcactaaccttcagatagcaaccagaagtgaatcgatctaagtgaaaatcattcagccaacatttattcttctcattcacatggatggctcacaagggactttgcactaggacttttctcatgtttagttgtaattccttagggttcgcaatgacagagctgaactagaaggtgtactggcctgcaaaaatataggaaagtgtattgacttcataaagttcagctggacaccacagtgtaggctacaacctgtcccaaatggaaggaaatgttgaaaatgttttcaaagttaaaacatctctcaacgtgataacatactgtgcaatatcctgtcacaataataacacccattgcataacatccttaacaaaatagtccgaaggggagatttctgatgtttgtctttggtgagaagtgtcatggagggtagtaatagaattaatttttgtcttttttttttttttgaccatctttggtcttaacaccatcattaagttctactttccaatcaatcaagacatttaagccctcctccaacattttattttttaaatcttttttttttttaaagacaaagtctctctgtcacccaggcagcagtggtggcacaatcttagctcaatgaagcctcgaattcccgggatcaagctattctcccacttcagcttcctgcatagctaggagtacagttgcataccaccacacccagctgatttaatttttttttttttttttttttgtagagacgaagcattgctatattccccaggctggtcttgaacttctggcctcaaatgattctcctccctcttcatcccaaagtggtgggatcctcctgcctctccctcccaaagtgctgagattacaggcaggacccattgtgcccagcctaaaaatctcttactattatagaaacaacacctgtgtattttatacaactagaaaatataaatgagcaaaaataacaaaataaaaacatcatgtttccaccaccagagtagcactcttagcaccttagtgcttattcttttatattatatgtatgtcatcatatataatgataaatgacatcttactgtgaaaactgttgaacctgctttttcaatcaagtgtatttttatatttcaatgtattttcaccttatctagtatctacactatcttcaaatttccccaattggccccaataaaatcctgtagtatttaaaactgatgcctgtgctcacaattagcagcatttcttaacccaaaacactgatattcgtagattgttctctagggaggtgaggcccctctcaagggtaccacaaatgcagcaggtggagaaatgtcttctgaagcacatcacaggagaatgatgatacaaagggaatggattaaaagtctcttaggctttcagcttcatgtgaatttcagattagaattcagggacaaagggacagatttcttcaatgttctctcttcagcttggatactgggcctccatatagttactattcagtttcttattgacagaaagctttggttaaatttagatacttgtttttgggctacaataattcgttgtgggcaacttgtcctgtctgcatgtagttactactttttttttagtgacttcaggaaagaaaaatgtgttctggggccacatggacataatactcaaaggaaatccttaggaccttcacctttatccacagtcagattctgcaggattctttggaactatgtaggcctcaaaggacttgacccatttgggtgaaagcatcatcatcttctaagatgctctgataaatcagaggctaaagggaagtcataaaggaagtattagtaaaggtgaaaagtgtaataaataatacaagattatgggggaaatttaataagactattaaaattttgcttatacaaaaaaattttaaagtatcattatataaagagagattgacaggatgctaccagccaattcgactttggggagactgaagtcgctaattcaaggttggttaaaagtcagtctctttgtaaattaaaataagatttacactatagggttttctctttatgcagcacaataagttcaaaatttttaatatcattgtcttcaggcaaagtgtgctctatgtacccatatggttatagtaacacagtaagcatctattttaggaaagggtagctgagctttcttctagagaaactgcttgcttgacagcaggacttttgtgtaagattttgggaaaacatgctcttgttctatgatgggaagtcctacatttcttattgaatccagctcagatggacttcccatgtggcttagtgtggctcgctctggagctccatattagggctcaggtgttagccaacagatggaaaattctcccaccataaattaagaaaaatgctttttaaaaagagcctgatataagtatgtatttcactgttccacatttatttctgacatcagaaaatctttatcatcattgccagtcctaagtaaggaaaaaattgaggccaggaaataaaacattaactcattatttgaataccatcctttcttaattaacatcactttaatgaatgtgacagatgagtgatatgatggattttaaaatgtccttattatttcatgtattacttttggaaacggcattttaaaaattagatatttagcgatggcattgactagatattttctgtttggcactatgcttacataatcccaaactgtttgcactggctgattaatcactagtgatttgtttgacagagaagacatgtggaacaagagctcagagaaactgtgcgactcaggaaatctctgtattctgtccttgagctctctctccatcttagagagaaaaggaagaacatgaaaatttgagttccagtgcagttgcttcagggactaattaaagttactaaattcacttggtagagaagatggctggaccgcttttgtttttcaccacaaatcagcaatatgttgagcattttaaaaataataatattcatagagacagggtctcgctatgttacccaggctggtcttgaactcctggtctcaagtgatcctcctgcctcggcctcccaaagctctgggattaccggcatgggccatcatggccggccagtggtcagcatttttattagataagatatgctttccttcttcagtatggaagtgagtctgaaaactctcctgcggccatgtagtgacatcacgctgagtaagactgagttttccataaatgctttgatggatattaagggatttagggagacatgccctgatttattatttcattttttaataaaaacgtaaaaactgtttcttttggaatcaacttgccctcacacgtcacacccatctacagaaaagccaggtaaagaatattcatttgttcattcattcatcaagtcattcagtaaacaattgagaatttattgtctatcagatactatactagactttcaaggaatataaatattcttcttacttctaaagagcaagtaaattgacacatttaatttgaatctaaggaaatgttgctgtgtagttacagctctcaaatatgcatactcagagaagagctcaatggtaatgaggactttggggttattttgcagaagatatatggacgtctgtgtgattgcctggggttagagtagaaaggtgaggggagaagatagaatcctggttggagaatgcctgtctttattggaatggaaagagcaagggtactgccaaaaacacagtgagagagggaggaaaagaaataagattttcagggccaagaaaactaaaagaaagactatgccaagaaggagccaatagtgaccaaaatcagagacagcaaagataaggaacaagaaccgaccatgggatttgatgatttggaggtggttgtcgtcatcattataatcatcattatcattttttgttattattattattattattgacgctgttttattttcataggctgaggtcctgggagcaaaactagtccaggagtaattctattttttatgttcctgccatatattggcatattacttcccaaagaactttactaatttaaatgctaccaacagtgtatgagactgccttagccacattgagtgttagcattataaatgagaaatttgttaactactgccttccaaatatttattgaacatctctttcttatagccaaagactagaaaaggtaagaacaaaaacactctttaggaaataattctaaggttttctgctctgaggtctaataagatggaaagaagaatggaaaccaccaacttgttgttggtaaaagctgaatgggaagaaattgaccactcatcagagtgcaaggtatatgcaacacagacattatgtctttcactcctaagttacactttcaacagatggccaaggatattttaaaattttcacttctttctgtctcataaactgaaactgagcaaataaaattgagccaatgaaaggggaattttataagaaattaaaaagtaatgaattggtacaaggtttaaaatatgaaatgaaattctgcttgtctcttagttggttacggctagtttgaagaattttgatgtttgcctattcttttttaaaaatattgaaaaacaaattgacccacaaattataaattaactactacatggtaggcatttttgtataaggtgccagaggctacaatgtttttgatatgttcaaggttaaataagtgagtattttccatgttgggaagcttctgtattttgaaatgaagttaggaaatgtgaccttaattggcatgtccaaaacagccaatccaaccctgggaccatagaaccgtaacagtgcctgttggtccagagtaggtacagaattattgggttacttagcttctgaacacataatagggctcctatgaaacagagatcagagatcccacctagacagaacctcagaaagttagcctaagaaatcaattgaaactaatcagagcagccaaatgcaactcataaaaataagcaaacaaacaacaccaggatggttccccagcggggaatactgacggaaatttaactgacatagttaaagaaagattgtatcaaacaacaaaggctaggttggtcatcccaggaattccagaaaggggagacttgggtagcagtgaggatgatgtctggtcttggggaaagataaggtcatggtgggggagggcaggggaagctgtcgtagttaaacattcagcatcacctactctagtcccaaagatactgctggacatctggcttcccaggaagctgggcttcaaggagagaagactttgttaggcttatatatttgtctgcctggttattattgttctcacaacaaattgctaagttggcatctaaaatatagcagtcttataagacctagtggactacctcagccacctaagtccaataaactaagcactgaggaaaatgaatttaggcccaaatcctatcccctcctccaagaccaggtcaaatggaatctctaatcttttcagtggaattgtgtctccctgctgtgacttccaaaggatgatgaaactgcagtccaatgcctggctggctggcacggagcaaacactaagtgaagggaaattataacaatcaccattcttaatctgtctttcctatggcatttattaatattttcagctcatatttattcaaactttaaactgtgccagtctctgagcaagtgatgagagctactttcttccttgtagatgttatcggtatattattaggcataaatattcatatgtctcatttcttttaccaaaatggaaaagtcttaagtgcaagttccatgtccctcagcatacatgtggtactgccgggtaggggaagctgtcatagttaaacattcagcatcacctactctagtcccaaagatactgctggacatctggcttcccaggaagcggggcttcaaggagagaagactttgtcaggtttacatatttgtctgcctggttattattgttctcacaacaaattgttaagttggcatctaaaatataacagtcttataagacctagtggactaactcagccacctaagtccaataaactaagcactgcggaaaatgaatttaggcccaaatcctacccctcctccaagaccaggtcaaatggaatatggcaagttttactttcagatttgttctactaaactatatatatatatatatatatatatatgttttggttttttgtttttttttttttttttgaggcagggtcttactgtcacccaggctggagtgcagtggcatgatctcagctcactgcaacctccacttcccaggctcaagctgtcctcccacctcagcctcctgagtagctgcgaccacaggcgagcaccaccatacccggctaatttctgtatttttttgtagatgcagagtttcgtcgtgtcgcccaggctggtcttggaacccgtgggcttcagcaatctgcctgccttggccttccaaagtgctgggcttacaggcatgagttaccgtgccaggcctattggtataggttttatctcctcataagagctgtaggttccttgaacattttttcaaccctctgttacagtattttgtattttaggttcttaatagatggtttttgaataagtaaatgaatgttcttatcaaaatcttctctcctctgcatgcattgattgagccatgccagaaatgactaaaaaatagaactaattattatagtaaacagggtgatttctatatcaccatcattttattttcagagatacaattacttggtaaaatggctggaaaataagatctctgcccattggttaaataaattattctaactggagaagagaaagctaaaaggcagttgaataatcatcctagattttaaaatatcaggcagagaagaatgttaaagggccttaaggcctgcaccctcatttgctgggaacaaaaggagatttgcctgatgacacactgaagccatatccaggacacagacctgcaacccggggccaggagtgctcctctctaagatactgccatctgcggggaagctgtcctgcacggtttacacagaaggaattcggcgaatgtttaatacatatttctaggctatccctggaaacacaaacaacttttgcccattttgcatattggctttaagttcctttcaaaaaatttgcatatttgcatattccttgaagggaaccaccccacagataataatgggaaaaatgaaaagataatacaactggcacatttgatagcatccttggcttcaccccttagcccacagcttgttactgacaataactatggtttctgttactgaataacataggtgtgccaggaggcaaggctgttgtggtgttacattcctaccttggtttttctggccgagtaaatgcaaactccccagtactaatctgtggactttttaagtggatgatttgatagaatcactatttatacttcttaagggtatagtgagttcaggtgatctgtccaataagtatcagaagagccagaccatcggggagctgctgggagaagtggaaaaggtcactaaaaatcagcccatcagaaacctcaaggaaaatggaggtcaaatagttgatcctactccttgcaaggaaagcttcttacaatcagcaagagccagagtctgctcttttgtctacagcagaagaaatgatcttaaatttgacccccagagatatgtgaacagcaaatatgaattacgttaacatattccattactttcacaatttgaactgagattaaagaatcagtgcccagaagcaagaagggctaattttcttcagcagagaatgaattcagagcaggggttctcacccctggctgcacattagaatcacctggaaagctttaaaaaactacagatgcctgggtcccaccccagacattctggcttaattggtctaggggtggcctggatctgatgccaggcttgagcaaatcagaagtttagatgctaatgtatttgagcttcagtgatgctttctgcatgctgactactgaaagcaatagtctagctctgtcattctccaaaggtggtcccatgattaaccttgtaaacatcacctggaaacttgttagaactacaaattctagggccccactccagatttactgatctactgatcagaatttctagggttggggatcagcttattaaagctctccaggtcattctgatgaacatgaaagcttgagaaccacttatgtaagtcaagtcattgctgctcaaagtgtgttccacagagcagcagcatctgtatgtcctggagcgtgtttgaaatgcagagtctcgggccacccgcacacctactaagtcagactgcattttagcaatattcccgggtatctgtatgtgtattaaaatttgagaagcactggtctaagaaacactcgccagttagtgtctcattggacttcagttttaatctttcagaggttctatgtaaaaagacaagagcacagccagagcatagaagggaagctgtgaatctgtattccgctacttctgcaggaggggttaatatgtgatctgtcaaataggtcgggcattgactcaaagaaacattaagagtagatagagtgattgtggcagtagtaaaagcagctgctgcttatcatatggttgccatgtgctttataggtatacctgcatttaatccttgtagaaaaccagcaaaatattcattcattcaacaaatatcgtattatataagcacatatgcgcgatacagttctaggcatatccctatattctagagatgtagccacccctgccattatgaagcttaactccaaagtcagacaacaaacaaaaataaataagctgatatacaagaaaatcataggtaaagatgagtgctatgaaggaaataaagcaggggaaaggaaggaaatgaagagtgataaggaagtgctacctgagatcaggtggtgaagcaggggagcctctttgaggaggtaacatttaagccaagacacaaaagaagcaaagtcatgagccatgcagatgtttaaaggaagaacattaaggagtatgcagagttgacatgtgagtgaatgaatggttagagagaagtttggaagatcactgcaggccagttcataagttaccatataagctacagtaagtatttatagacaaggaaaccgagcagggcttctcaaattaagggtgcccatggatcacctggggaacttgttaaactgtaatatggagtcactaagtctggggtgggacgtgagtttctgcatttccaacaaactcccaagagatgttgatgctactgctctgtaggccacagagtaaacaaagggatgcaggggctgagaacttattaaacagcacgctcaatgtcacacagctggtaagtcacagaggtaagatttgaatcacagatgcctgatcctaaagtttgtgctgtccattagttgcctctgagataacctcatgcctgattcacctgtaaccggtactgtgcaggatatttaaagagcctggctgagaaaagtcctggcatgtgctctgtttatagaagagccatttatcccctcttatttagaaggagaaataacaagggaaattggatgctttggtaactattgatactttgtgccattgcttatgcaatgtttaaaaaatataagatataatcaatccctgacatcttagacagaaatgatattgttggtgaccatcttggtgtacaatatataaataagcataaaatactcatgagtcttgaaatctaatgcattatatttgtagtacctgatccaaggaaggcagttattcaccaggccctgcagtcatacccctgcccttacccatttgcacccttgcgtttagttcttttcaccacatagaagatgcttggagttcccagatgtgggtgggctctggggtgtcagagatacatgcagtggtttacttgcccaaatcaatgaggcttcaatacaaaacaaaacaaagggtaggggtgtgtgtggagtttgaacacttggtctcaactttctttcatgaaagcagccatagctcccgatattaaacagatgtttgcaggaaaggatggctcctcgatttctcttgtttgatagtcactgggggtggaggggatggaagggggacatgttctgtgtatgtattgtatatgctcttgccttgatgaatgacatagtttggtttggtttgttgccctccccttttgttaattctctgtgttctttttcctttgtgctgcacaattaggaccctgcagtgggacacagacccctcagtgctccagctgcagtcagactcagaacttgggtatatgtctgctcttttgttactccttttattatttctttgctacagttgtgttgaaatgctggagctgttgttgctcttgtgttctccccttttgttgaacttccagtttgataagttcgtttccttctgttgattttccttataaagctttgaagaaagtctctctttgtggaaaacaccacaaaaagatggcttttgatttctccttattaattcctattattgcaaaacaacactcccccaaacaaaaatcaaacataaacccacacatctaattaaaagtggggcacacaagttctgcagcgggagatatgtttggctttatcatcaccatcctcccctttactaacaagttgccttaagttaactttggtctaagatcagtatgaaaatattgggtcttgtttctttacttttcttttcagtttttggggaactcacaataagcacttaatttgaattaagtttgaacagttaaagattcctgtttaaaaaaaaccaaggaaattaattgaataccttgatctaaagatatttcaaatactagatgttgagtaatgtctcctatgtcctaaatatcatctttttcagatgtaaatgtattatcacaagttaaaagaaaacctcagagatgaagacttggagtggaataaaacacacagacatatcctagaaactcaatttatttccgttgtaggattggagttagctgtagtcacacaggagatattactggtggggtgtttgtatcagctggtcatcaagctcaggagagctgattgcgcatttctcttctcaacttcacattaagttaaatcagctggaaatcagccacggtggaagtatttacaccacagaaattgcctcctttcctacaagcaatttattaagcatttaccgacagagcactggatatctctaagtgaacagcaagtttcataaccacattttatggaaccattatcttttctttctaaatataaaccaacatatcccaaaccaggcatttatttacttattattcattttgaattcctgagattcctgggcatatatctctgaggttctgtcagtttcaatgcctactgtaggtataaaaggaggttgaagggctatttgcatgttaggttaaatgccatctgcctgtgaccctttgcatatgcaaaaattcttagctgattcatgacaatactaagccaaggaaatatcctaacatttaggtaaccgatgcactatttcttttttaaccttactaaattcttggctatttagttatatagttcatttatgttatatttcaatttgtattatttaaataaccaagagatatggcttaaataaagcagagaatgtatggtaagttatagttcaggggaacttcagaatgcagttcttcaaaattatattgtgttaaaaaaacaggcaggggaaagaactggcagagactaccccatgcacttaaattaacagatttttagacagattgcagcagtgctaaattacacttgctgatgtggaatagtttggaattttcccatttatatctgttttccaagcaaaaactcatgttgactatgcagattaaaatttgtgacttattctagggatatagcatatctgtggacccaccttacctgctgcattatacttgagagtgaacccagtgtgttggagagagaagatggagactttctgttcactttctaaatacaaaccgatataccccaaactaggcatttatttatttattattcattttgaattcctgagattcctgggcatacatctctgaggttctatcaatttcaatgcccactgtaggtataaaaggaggttgaaggactatttgcattttaggttaaatgccatctgcctgtgagtgagtggcttatcttagagagtttgaaggcattttcagagaatttttgagagatgacattattttagccattttacaatttcaaatattgccttaatgaaaatttctagatttttctagagagttttatttcaccttcttgagctgtggcatgggaatgatcatagtccatagcttcctttgtcacttaatttaacacctttactgaagtataactggctttaaataaactacacatattaaaactattcaaattgatgatttttgacatgtatgcacatccatgaaattattaccacaatcaagatagtgaacacattaatcatccccagagtttcctcatgcccctttgttatctacactcttgcttcttcctgttcttccctatcccccaaacatctgatctgctttctatcactataccttagtttgcctttcctagattgtcatataaatgaaatcatccaggaggtactcctttgactgacttccttcattcagaaggattattttgagattcattcaggttaagtttatataaacagctctatcctttttatttcattgtatggatataccacagtttgtttatccagtcactttttatatacattgggttgtttacaatttttgcccattacaaatagaactgctataaacattcatgtacaaatattttaatgcacatatgctttcatttcttttgggcaaatacctcccagtagaggtatttatggttgaatcatatagtagatacacatttaactttttaagaaattgtcaaactgttttcaaaatggttttaccattatgcattcccacgagcagtttatgagagcctcgatttttccacattcttgacaacgcttagtttgagcttcttaaaagaaattattaatttgttaactattattaaagaagtatagtggtatttcattgtggttttaatttgcatttccctaatgactaataatgttgaatatctctttagttgcttatttgccatatgagtatcctctctgatgaaatgtctgcttaaatctgttagtcttatatattgtttttgagttgggttattttctcataattgattttgaaagttcttcgtatgttctggataaaatgctttatggggtatataatttattaatattttctctcagtctatgacctgtcattttcattttcttaacagtgtctttaagaaagcaaaccattttaattttgactaattacagtttacaaatttgttcttttatggatcatgcttttgttaacataatgttgatttttaagcaattattttaatatttggtagaacacaattcacctatgaaatcatttgggtttggaataatattgtggaggagattttttgctttgttttattttgagacagagtctcactctgtcacctaggctggagtgcagtggtgtgatcttggctcactgcaacctctgcctcccaggccagagacagatatctctttgagatactaattttatttcctttagatatatatgtccagaaaagggactgttagataatatgtagctctagttttaataatttgaggaacttcaatattattttccataatggcaatgccaatttacaatcttaccaacagtgtactaggttgtttcctcaatatcccttccaatacttcttattttttatttttaataatagtgatcctgattgcatctcattatagttttgatttgcatgtctctgataattagtgatgttgaacactttttcatatacatattggtcatcttatgtcttctttggagataagtctatttagggcctctgtgcatttttaaatcaggtaatttgtaattttgctattgagttgtttcagttctttatatattttggatattaaccccttatcagtaatatggattaaaatattatctcccattctatacattgccttatcattgtattggttgttttctttttttttattattatactttaagttttagcatacatgtgcacattgtgcaggttagttacatatgtatacatgtgccatgctggtgcgctgcacccactaactcgtcatatagcattaggtatatctcccaatgctatccctcccccctccccccaccccacaacagtccccagagtgtgatgttccccttcctgtgtccatgtgttctcattgttcaattcccacctatgagtgagaatatgtggtgttcggttttttgttcttgtgatagtttactgagaatgatgatttccaatttcatccatgtccctacaaaggacatgaactcatcattttttatggctgcatagtattccatggtgtatatgtgccacattttcttaatccagtctaacattgttgaacatttgggttggttccaagtctttgctattgtgaatagtgccgcaataaacatacgtgtgcatgtgtctttatagcagcatgatttatagtcctttggatatatacccagtaatgggatggctgggtcaaatggtatttctagttctagatccctgaggaattgccacactgacttccacaatggttgaactagtttacagtcccaccaacagtgtaaaagtattcctatttctccacatcctctccagcacctgttatttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatgggattgtttgtttttttcttgtacatttgtttgagtttatcgtagattctggatattagccctttgtcagatgagtgggtcgtgaaaattttctcccattttgtaggttgcctgttcactgtgatggtagtttattttgctgtgcagaagctctttagtttaattagatcccatttgtcaattttggcttttgttgccattgcttttggtgttttagacatgaagtcctagcccatgcctatgtcctgaatggtattgcctaggttttcttctagggtttttatggttttaggtctaatgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtgccagtaccatgctgttttggttactgtagccttgtagtatagtttgaagtcaggtagtgtgatgcctccagctttgttcttttggcttaggattgacttggtgatgggggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcattgagcagtggtttgtagttctccttgaagaggtccctcacgtcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttctcagcttaaggagattttgggctgagacaatggggttttctagatatacaatcatgttgtctgcaaagagggacaatttgacttcctcttttcctaattgaataccctttatttccttgtcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttgtttgtgtctctgcccggctttggtatcagaatgatgctggcctcataaaatgagttagggaggattccctctttttctattgattggaatagtttcagaaggaatggtaccagttcctccttgtacctctggtagaattgggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcagtctatgtattttgttgatcctttcaaaaagccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagacattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaagaaatgtatatgctgttgatttgaggtggagagttctgtagatgtctattaggtctgcttggtgcagagctgagttcaattcctgggtacccttgttgactttctgtctcattgatctgtctaatgttgacagtggggtgttaaagtctcccattattaatgtgtgggagtctaagtctctttgtaggtcactcaggactttctttatgaatctgggtgctcctgtattgggtgcatatatgtttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggcttcctgaatacagcacactgatgggtcttgactctttatccaatttgccagtctgtatcttttaattggagcatttagtccatttacatttaaagttaatattcttatgtgtgaatttgatcctgtcatgatgatgttagctggttgttttgctcgttagttgatgcagtttcttcctagtcttgatggtctttacattttggcatgattttgcagtggctggtaccaattgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattctttaagaatgttgaatattggcccccactctcttctgtcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctttgtatttcctgaatctgaacgttggcctgccttgctagattggggaagttctcctggataatatcctgcacagtgttttccaacttggttccattctccccgtcaccttcaggtacaccagtcagacgtagatttggtcttttcacatagtcccatatttcttggaggctttgctcatttctttttattcttttttctctaatcttcccttcttgcttcatttcattcatttcatcttccattgctgataccctttcttccagttgattgcattggctcctgaggcttctgcattcttcacgtagttcttgagtcttggttttcagctccatcagctcctttcagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaggtcgttctccgtccagctttgttccgttgctggtgaggaactgcattcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgccatgtgaggtgtcagtgtgcccctgctggggggtgcctcccagttaggctgctcgggggtcaggggtcagggacccacttgaggaggcagtctgcccgttctcagatctccagctgcgtactggaagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgctgccaccttgcagtttgatctcagactgctgtgctagcaatcagccagactccgtgggcgtaggaccctccgacccaggtgcgttatataatctcgtggtgcccccttttttaagcctgtcggaaaagcgcagtattcgggtgggagtgactcgattttccaggtgccgtccgtcacccctttctttgactaggaaagggaactccctgaccccttgtgcttccccagtgaggcaatgcctcaccctgcttcggctcgcgcatggtgcgcgcacccactgacctgcgtccactgtctggcactccctagtgagatgaacccggtacctcagatggaaatgcagaaatcacccgtcttctgcgtcgctcacgctgggaactgtagaccagagctgttcctattcggccatcttggctcctcctggtcctggttgttttcttattgtgcagaagctttttagcttgctgtagtcccgcttgtctacttttgcctttgttgcctgtgcttttggtgtcatatctaaaaaatcattgccaaggccaatgtcgaaaatctcatttcttacattttcttttaggagttgtatagttgcaggtcttacatttatatcttttatccattttgagttttttttgtgtgtacatgtatgtgtgtgatataaagatccaatttcattctttcaaatatggatatttagtattcccaacaccgtgaattgaagagactatcatttttccattttgtattcttgtctgtattatggaaaattagttgactgtagatgtgtgagttaatttctggaatctccattctgtcccactgacctatatgcctgtttttgttacagttccatactgttttgattaatatagttttgtagtataatttgaaatcaagcagtgtgatacctcttgagaatacctttctaaagattgctttggttattcaaggtcttttggggttccatatgaattttaagatttttttcctatttctatgaaaaatatcatttaagttttggtagagattttattgaatctgtagactgctctaggcagtatggacattttaataatattgttttgtgtaatccatgaacatacaatgtcttttcatttctttgtcttcaattttttttcataaatgcttcatagttcttttatgtagagatttttcaccttggttaaatctaagtttttttctttctgatgctattattagtggaaatgctttcttgatttctttttcagatagttcattgttggtgtagagaaacacttaatttttgcattaatttttgtggagtctataaagtttcctacgtacaaggtcatgtcatctacaaaaagagacattttacttctgtcttatttggatgacatgtatttctttttctgtctaatttatctggctaagacttccagtattaggttgaatagtagctttggtttcctttctctttttctttttattttttgagacagagtcttgctctatcacccaggctggagtgcagtggtgcgatcttggctcactgcaacctccgcctcccaggttcaagcaattctcctgcctcagcctcccaagtagctgggactataggcatgcgccaccatgcctggctaatttttgtatttttagtagagatgcagtttcaccatgttggccgggctagtctcaaactcctgacctcgggtgatccacccacctcagcctcctaaagtgctgggattacagatgtgagccactgcacccagcctcctttctctttttcttctatgtaacttctataagtattttctttgtggttattatgggacttacataaaatttattatagtgagctgatagcattttctcttgcatacgaaaactctacatttttatctcatttccccccacattatgtgcaattggtgttgcagttcatatctgtttagaatgtgtgtccatttacataatttagttatagtcatttttaattcatttgtctttttacttttatatttgaaccaaaagctgtttacccaccacctttataacaatgtagtcttctgtttttgtctatatatttacctttaacaacagattttatactttcttatgtttttgtgttgctgtttagaatcctttcatttcaagttgaagaactttctttagcatttttttgtatgtcagaactagtgatggtaacctctcttagcttttgtttgtctgagaaaggctttattgcccccttcatttctgaaggacaggtttgcctggtattgtattcttgattggcaggttttttttttcttctttcagcactttgaatatatcacacactcccttctggcctgcatgatttctattgaaaaatcggcttatagtcttatgagggttctcaggtagatagcaagtagccattttcttgttttcaaaatcctctctttgcttttaacttttgacaatttatttataatatgtccttggtttgggcatctttgggattatcttatatggtgttcttggtgttctttgggcttcctgaatctggatgtcttatttccttccccaggtttgggaatttttcagccattatttctctgaatgagttttctggttctccttctgtgagtttcataatgcatatattgccacttgatgttaccctgtaattctcttaatatatcttcactgttttttattctttttttttcctttttgctcctctgactagaggatttccagtgagctgtctttgactttacttctcctttcttctgcttaatcaaatctgctgttgaaacctcatattgaatttttcagttcagttattgtattcttcaggtctattatttctatttggtatttttaaatattttctatccctttgtcaagattctcacattgttcatgcatttctctcctaactattgtgaacatcttcatgatcaacattttgaattctctgttgggtaaatcacatgtctccatttcattaaggtaggtttctgaagatttatcttgttcttttatttggaacatattttcattttctttgattctttgtgttagtttctgcacattttatagaacaaccacctctcttagtcttcacagactgatgtctataagagtcaatcttcatccattaggctagctagagattctggatgctacctattccttcgtgcttccaaactgccatctgtttccttagtgggcccagggtactagagtatgctaaaccctaagagagtcctaagattggcaagattggagccagtctcttgagtagcagttggaataaatgatgcattaggtacgtgttctaatgcatcaatttattccagctctccttatgcatctccagctgtccttaatgcatattaatgtccttaggaagaagctgggaactggagtttatcacccacttgctctgcactgagccaggaagaggaactgtggcaaatgcctgtaatgctcactcagacgcaggctgttttaaatcattgctttactctttgtcacctctagggggtctagtaaatgctaggccctcagttcttggaacagacaagctagaggccagtccctctggtagcgactagaaaatttaaaggtctagatgggtagtttaagctcttctaaggagaagctataggcttggttttatttctggaatgatttgtggggaggagccctgggaagtatcctcacattcatttaaactcccagtgactagtgactgcctgccctgttagctccaagaaacaggcaagtcagaagccagatccatgggtagcagctggaaaagtcaaggtactagatgtatagtgtaacccctcccagggagaatctgagagctgtgcattttggtaaaataagctggcaggaggagtcatgggacgagcctgcaaggccattcaaaaccactgctttgttctctggagactccaagtgaccagcgaatattgggccctatcagctccccagttaggtgagttagtaactacactcccaagcagcagatgaaaaaaatcagagcatttgttgtgtagtccaactccttccaggaagaagctaaaggtttagtttctttgccagagtgagctggaggaaggagctgtaggaagtgcctacatacccatttaaactccctggggactagtaattgcctgccctgttgacttccagatacaggcttgttataagccagacccttgggcagcagctgaaaaagtcagggcttttgatgtgcaatctaaccccttctagggaaaagctaggagctgagctttgtcacctgctcactgtgtgctaagccagtggggagaagcatgggaaatgcttgagtgcctgtttaaagctgcctctgttctctgccattccaggggtctaataagtgctgggccccattggcttccagagataggcaagttaggaatcatttcctctggtagtggttttaaaagttggggtattgtgtgtacggttcaaaccctttactcctcagggagaaactgagagatggaggttcccctcaattgtatagtgctgggctgagggtagggtttatggtgagagtgagaatatgtctcagcttttcttactgttgcacccgagcgagttagggaaacgccacatttgagacaaattaagagtcctttattagccgtggacggagagacagctaatgcccaaagttctctcggcccctaggaaggggcttgattaatttttataccttggtttaggaaggggaggggtctagttagaacaattttacataagttaagtagtcaaaaagttaaaaggataaatggttacaggaaagtaaacagttccaggtgcgggggctttaagactattacaaggtgatagacgtggggctttgggcattatcaatcagacgaattcttggggactgcagatatagcttgccacagtatcttatcagttaattgcattcttggatgtgctgggagtcagcttgcacaagttaagtccttgaggaaggggctgccagtgaaagagccaggatggagtttgtctggttctcttagctaagggagaaacaaggctaggtgaatgaaggaaaaaacaaggttgggcattacattacctgtgctgaagtgggaattttctcagccatccgacatacagaaatctctccactagtttctgtatttttctcagaggatgtcgattcatgtatagctgtttatttgatgctctatgggtggagtgagagttctcagcctcctattctgtttttttgctgaagtactcctgcatgtttggtaattttttatttatattagacattgtgaatttttttttttaggtttcagatacttgaatttctataattttcttgtgatttgttctgagatatagtaaattaactttgaccaagttttatcttttaaggtcttgcttttaagattttttagttgggacaggagcagtgctcagcttagggctaattcctgctactgaagcaagtcccttacatgtattctacacattgccccataaatcttaaggttttccagtttgactggcgtgaacagaaactattcttattcttgtgtaaatgcccagaactgttatctgtaattgtttccagatcattctttccttggcctcaggtagtttcttcacataaatgtactgatcaatgctgagctgaattctcaaaggcaaacttctgagttttcttttgtgcagatttcttctctctgccgtattttcctgtgaattctaactgcctggtctccctggactctcaactctgtctctacaacttagagagtctgctggatttcacctgagtttcctccctacaccatggcctggaaactctctcaatgctgtaacttggggcagttgtagggctcctcttacttgtgtccctccctcatgtatcactgttcctcattgcctgacctctagtggcctgtaagttgttttattcagcattacatattttaaatttcaggtttctgggtaaatttggtctctattactccattttggccggaaacacaaatgtgtcacttgattctggtttgtatgttaactatgtgattagcaaagcaaatggcagcagagagaaaaaagggagatgatatggctttcagaaaaaaaaatgacttcaagaaaattgtaaataaaatgagaaaataagtgcaactcaacttgtctttttaccaggcaaatacatacggaagtaccaaaaatgctttgctttctttcttaggccattataatagattaggtgaattgaagatactgaaagggaaagatgaaataacaggataaaaagagtaagttaaaggatcacaggagagaaagaactaatatagcttggaagtgaataaatatgtcattgaaatttggaactgcaatgggaaaatttgagggagggattatgtttaaaatgttttttggtgtgtcttatgaagagaacataaatgcaaatattcccatgagattaccagtcttccagaagatgggctgagaacaacataagaagagcagggctgggagagaagaaaagattctcaactttatatagataacaatgagcaatgagggtattttgtggcccttcactccaaattattaaacctagtaccttatagaatatttattggcttcagaagcctcgtgattatatttcctttacgtattagtatatcaaactcttgatagagtttttaaaaatattaggaagcaaagagaatgaaggaaaaccatgaagctgtgagcaaggatttggctgttccttcacagaagaaagaacttagattttattttcaatgtttgagagacactgttaatgtacttgcctagtggattcttcctgcctgctgcacagacaaaaccagttcactgagaccaaggcattgcagtaaagaatttaattgatgaaggcctgctatgccacatgggagacagagttactactcacatagtcccctgcaaaattcggagactagggtgttttaaggatagtttagtgggtcgggcggcggggggttagaggaatgggttcttttgattggttgggggtgcaatcgtaggggtgtggaaaatggtcctcaaccactgagtctgttttctgggtgggggccccaggacggactggtggaaccaagagtccagggtctgggtggtgccatcagattgtcagaaatgcagaagcctaaaaagacattttaaaaggccaatcttagattgtacagtagtgaattggggaagctgcaaatcttgtgacctccagaataatggctggtaatcgtttaactatccctacatcttagcagaattcaggcccctctcattttcctaacctgatgacctttcattagtttataacagtagtataattttgggaaatggctattttcatttaaactataagctaaatttattccaaagtagtttggcccaagcccaggaatgaccaagtacagtttgaaggttaaaggcaagatgagagttggtcagatcagatctctttcactgtcataattttctcactgttataatttttgcaaaggtggtttcactagtaggtggtgacctcttctttctctaaactgtcttctttgcattcttggctgaaagagagaatgtgtattactctagagtctaccaggcaccattccaaactgctatggtgaaataaagagatcactctgtcaagaatagaagtaaaaccaactatataaagaaatgagagaagcatataatcctcaggatggtggtaggtattacagaaaatctaactaggaaagttctagaggtctttttacattttaaagttattgccatttgcctaacagaacagatgtaaccccattagcctttaatgaagaaagaccttcatttggcttattctccaagctttgtcaaatattcgtatgcattaagtttagatatctgatttgaattaattttcaaggtttgtcatgtaacaatgcctggtatgttcttgagaataatgccagttgaattctttgagcaagttgacaacctctgcctcttcagtaacactcaatcacactttccacagaaattgaaatatgaaacagcatcttgtaatatgtatgtgtatcaaaatgtagtagcaaaatgtatttcagaatctataaatatagatttatattctgacccatgaagaactgttataaattggttttaacagaaccaatcaaaattttgtcacaagagaggaaggaagcattttgctcaccatttgtaataatcatttatttgtccccaaacatttcttgagaagcttctatcaccaagtgtttgttctctaccctcaagaatcttgagtaagcaattatagggcattttccattccatagtagcaactggattttcaaagaacaatatttctttttcattcaatttcagaaagatgtaggccaattgttaaggaggtgtgcttatactttggtacccagtgacttgaagaattctataattttatagttttatgttggtacaaattctatggaagctttttcataagtatcaaggtagtaaaaggtcattcctatataatttttaatataatcattgtcatttatatatattattggagaaaacacacttctgtaccttccatccttactattctgaacttttaatgtcctttgtaaagtgagcccttaatagcagaacctcttccagtgttgccaagttctattataatcatgactattttgattcttctctcatcctagaaatttacttgtgttatgaaattcaaagctaaccctttggttgtgcctattgattgagccagacttgacatttgcttctgttcaggaaaaatgcttttgctgccaaactaatatctctgcacagtaagaagcaaataccatggaaatgaaataaatacttcctaaaatgactttttaaatgtgaacatagaagaatggaagctcatccttcttgaagtagtcagaaaaagtcaaccatcaagctgtttcccagtacttggagaaaaatacccattctgaacataaatgataaatctctctctctgtgtgtgtgtgtgtgtgtgtgtgtgtgtgtgtgtgtgtgacgaagggggccacaaggccaggttcatgtcctcagtgtggtgccccatgctcaccattcctccatgtggtatcccatacccaactctctaagaatcagtccttcagatgttacaccttgacacctcagtacattagaattcagtagttgaaaaacaaattaactctgtcattgtaaaatgtctgtcatattacatgagttcctgtgccattagctttctacattctctttttctatagatccaacattttctctatgactccattgggtggctcccaggtcctcattttgaattttgtcttctctgacctttggtcctgcatttcttatgatcagaaaagcccttatcacaaactcatccaccaagtatgcattttgttaaccccaaagaaaaggtatttctctagatttctttatgtcttccagttacaccagtcacttttcttcctacatggtgtgaacctttgaaataatctctaatttgtttccttttcttcaccctccatatcaagtaaactaagatctgtcctaaattcttttccaaagtctccaatttgcagcattctttccattccagtgctgttgccacttagtgctttctcgtcaccctggaccaaatctccacacttcgttagaccatcaatcacagatcttttctctggctgctccctttgaattgtttatcctagattcggttttgttcctaaacctacccaaccatccgcctttgcttgtaggttgtttctcaattccattttctccaccctcagcttctaaggtccagtgactttccacacctaacattggcccctcatttgtcagagaagggtttagactatatttttttacatagtttctatacaaacatgttttaaatgttgtcttgcagctgtcaatttcttacccagcaacttttaataactcctcactgtctacagcataaagtccaaattctttaacctgatacttaaaaccctctactaatctggcctcaatatacctctctaaatttatcttctcttgctctcaaatcaaaacttatattctgaaaaccttgtctctcagacataaaatgtgaatttagtctccagatctttgtatatgccaggagatctcgctaggatattgtccccattcctttccacttaactgattcctgcctatccttgaaattcacaccagagcttctattctctatgaaattctatttcacttatccacaataatccacccattatactctcctgccttacttattatgtgactcacccatgttggctcttattatatgctaccttttcttctttttttgactttattttttaatttacaaataaaattgtatgtatttaccatctacagcatgatgtattgaattatatatgcattgtggagtaactaaatatagctaattagcatatgcattacctcacatagttatcatagttatggtgagaacacttaacatccaccgtcttaccatttttcagtaacacaatacaaatggtccctgatttacactggtgtttgacttacagttgtttttttttttttttttaactttacaatgggtttattggaatgaaacccaattgtaagttcagaaacatctgtatactgttattacctatagtcatcatgttatacaatagatctcttgaacttacttttcctgtatagctgaaattttgtatcctttgaccaacatctcccatctttccttcctcaactgccccagcccctgataaccttaccttcctactgtctactttatgacatgaactttttaagattccacatgagtgaactcatacagtacttgttgttctgtacctcgcttatttcacttaacaaaatgctctcctggttcatctatatcgttgcaaatgacaggattgtctttattatggctgaatagtattccattgtgtaagccacattttccttacctattcatcttttgataaacacataggttgatttcatatcttggctattgtgaatgatactgcagtgaacatgggggtacaaatacctctctgacatgcttattttattttcattggatatttatctagtagtgggattgctggatcatacagaagttctatttttaatttttgagtaacatttatactgtttgccataatggctatactaatgtacattaccaccaactgtgtgcaaggattcccttttctccacaatcttgccaatatttgctgtcttttgtccttctgatcatagccattctaacatgtataaggtgatagctcattgtagtttttaatttgcatttccctgatgattaatgatgttgagcattttttcagatactcattgaccatctgtatgtcttctttaaagagatgtctactcagatcctttgcccatttcaaaatctggttattgttttcttgctattaaattgagttccttatatattttggatattatcccttaatcagatgtaagtttgcaaatattttctcccattttgtacattgtctctttattctgttgattgtttctttttctgttgagaagctttttagtttgatgtaactccatttgtctgtttttgcttttgcagcatgtgcttttgaggtcatttcccaaaaatccttgtccagaacaatgtcacggagctttcttgttaggttttcttatagtagtttcatattttacaattaagtctttaatcaattttgagggagttttttggatatggtgtaagataaaggtctaattttattcttctgcatgtggatatccagttttccaacaccatttgttgcaaagactgttctttccctatagtgtgttcttgccacctgcataaaaaaaattggttggctgtaaatgtgtagatttatttgtgggctctcagttctgttccattggtctgtatgtatgtttttatgccagtaccatgctgttctgattacttaaggtttgtagtatattttgaagtcaggtagtgtgatgccttcagctttgttctttttgctcaatgttgctttaactgtttggggtcttttgtggtttcatatgaattttaggatcgtttttcctagttctgtaaaaaatttcgctggtattttgatagagattacatagaatttgtaggtcactttgagtaatatgggcattttgacaatattaattcttccaatccataagcatggaatatctatcaatttatttgtgtcttcttcaatttctctcatcagtattttatagttttcagtatagagatcttttatctttgttagatttattcctaagtgctgtgttattttggtctctattgtaaattgttttcttgattttttactcagttcactgttagtgtgtagaaatgctactaatttttgtatattgacttttcatcctacaagttaacggcatttgtttattatttctgaaggttttttagtgaagtctttagggttttctatataaaagattatgttgtctgcaaatgggagcaatttaacttattcttttcagatttggatcccttttgtttctttctcttgcctaattgttttgctaggacttccaggactatgctgaatagaagtagcaaaactgcatatctttgccttgtaccagatctttaaggaaaagcttccaacttttccctattgagtatgatgtttgctgtgggtttgtcatatatggcctttttatgtggaggtgcattccttctatacctaatttattgagggtttttatcatgaaagggtattgaattttgccaactgctctttttgcatctattgaaatgatcataaaagtttttgtacatttatagtagtcctctcttctatgtggaggatatgtttcaagactgtcagtgaatgcctgaaaccatggatagtactgagcccaattaccagtcagaccatgtttctgttcatgtttgcctgccacacacacaaatgtaatgccttttccatcttaactaagcatgtgtcatgcattgtggccataacttttgcagtttaagatctgtcagcaaaactagcaagggtttccttttccttcttcacaatttcacagataaacgattcattcttaccatagaacttagcagccccaccatgtgatttttcttctttccttattgagaatgtgtaccttttcacataaatgaaacgttttacagtttctctttgacataagcaaattgccagcatcactactcttgtgctttggggccattattaagtaaaataagggttacttgaacagaagcactgtaataccacaacttttttttttccttgagacagggtctcactctgtcacccaggctggagtacagtgtttgtgaatgcagcccactgcaacctcaacctcctgcgatcctcctgcctcagcctgccgtgcagctgggaccacagcgtaccctacacacctggctaattttttgattttttgaacagaagaggtctcactttgttgcccaggctggtctcaaacccctggcctcaagcaatcctccagccttggcctcccaaagtgttgggattgcagacatgagccaccatgcctggccaatatcacaacatttgatctgataactgagatgaatactaactgactcatttgtgggtagcatatacagcatggatatgctggacaaagggatgattgatgtcccaggcagggtgaagtgggacagcgcaagattttatcatgctattcagaacagggtgcaatttaaaacttatgaattgtttatttctggaattttgtgtttaatatttttagatcacagttgactgtgggtaactgaaactatggaaagcaaaaccttggataaagaggggctactgtattgatttgcgttcatgggactatctttgcatctctgggatgaatcccacttaatcatagtgaatggtctttatagtgtgctattgaatttgatttgctagtattttgttgaggatttttgcatctgtgttcatcagagatatatgactatagtcttcttttttttagaccagagtttcgctcttgttgcccaggctggtgtgcaatgtcatgatctcggctcactgcaacctctgcctcctgggttcaagtgattctcctgcctcagcctcccaactagctgggtttagaggcatgtgccaccacgcctggctaattttgtatttttagtggagacggggtttctccatgttggtcttgctggtcttgaactcctgaccttaggtgatccgccctccttggcctcacaaagtgctgggattacaggtgtgagccaccatgcccagccagttttcttttttcaataacattcttatctggctttggtatcagggtaatgctggcttcataaaatgagcctggaagtgtccctctcttcagttttttgcaacagagaaaaaattgctattagttcttctttaaatgtttgttacaattcagcagtgaaagtaaaaagccctgggcttttctttgattggagacttctttattactgattcaatctccttactcattattggcctcttctgattttctgtttcttcgtaattaattttttgatagattgtagatgtcaaggaatttatccatttcttttgggttattctatttgttgtcatataattgttcataatagtcttttatgattctttgtatttatgttttaccagttataatatcttcttttatatttttgattttatttaagtcttctcttttttccttagttagcccagctaaaagtttgtcaattttatcttttcaaaaacattaattcttcatcaatcttttgtactgtttttctagtctttatttttcttctctaatttatttattattattattattttgagatggagtctcactttgtcgcccaggctggaggtaatggcacaatcttggctcactgcaacctctgcctcctgggttcaagcgattctcctgcctcagcctcccgggtagcgaggattacaggtgcccgccaccacacccagctgatttttgtgttattagtagagatggggtttcaccattttggccaggtggtcttgaactcctgacctcaggtgatctgcctgccttggcctcctgaagtgctgggattacaggcgtgagccaccgcacccggtgtcttctctaatttttatttccttctattaactttgagcttcatttgttcttgtttctctagttccttaaggtgaaacattagattatttaatttcttcttttttgatgtagatatttattgctataaacttttattccatgtttttgtgcgttgtgtttccatttttgtttgtctcaagaaatttttacatttctcttttaattcctctttgaccctttggttgctcagaagggtattgtttaattttcatttatttgtgaattttctgaaattccttctgttattgacttctagttttataccattgtggacagaaaagatacttgataagattttagtttttttagatgctatggtttaaatgtttgtctcctaaactcatgttgaaatttaattgccattgtgacagtattaagaagtgagatctttaagaggtcattaggtcatgagagcctttccttcatgaacagataaatgtcattatcatgggaatgggtttgttattataagagtggattccttataaaaggacaagttcagctcccctttgtctctcttaccctcttcttgcccgtctaccaggggatgacatggcaagaaagctcttgccatatttggtcccttgatcctcaatcttagacatcccagcctccagaactgtgagccaataaattgctgttcattataaattagccagtttgtggtattctgttataatagcacaaaataaagtaagacattagatttattaggactttttttgtggcctaacaatgatcttttctagaaaatgttccatgtgcagttgagaagaatgtatatcctacaactgatggatggaatgttctgtttatgtctgctaggtctatttggtctattgtgtaatttaaaccttatgtgtctttattgattttctgtctgccaatagtgggatgttgatgtcccctacgattattttattgcagcctatctctctcttcagatctattaatatttgctttctatatgtagatattcccatgtcaggtccatatacatttataaatgttatggatataacaactgtggaattgatccctttatcctcatatgatgaccttctttgtctctttttacgttttgacttaaagtctattttaacatgtctaacatgtatagctactcctccctcttttggtttatatttgcatggaatatatattttttcatctcttcactttcagtctgtgtgtgtccttacaagtgaagtgagtctcttgtaggcagcgtattttttatccattcagccacttatgtcttttgattggagaatttaatccatttatattcaagataataattgatagatacaaatattctactaacattttgttaattattttttacttgttttgtagaccctctgttcttttcttcctgtcttgctgtgttcctttgtagttaagtgattttctctggtggtatgtttttatttcatgctttttattttttgtgtatctactataggtttttgctttgtggttaccatgaggcttacagcaaacataggtatagatagtttatattatattaaggtgataacaactgaattttgattgcaagaagaaaactctgtacttttactacactctcctcccacattttgactctgtgtcacaatatgtattttcttatattgcatatcccttaacaaattattgtttctcttgttatttttaatagtttttcttttaaccttcatgttaaaaatgttagtgatttacacaccaccattgcagtattagattattctgaatttgactgtgcacttaactcacttttaacagtgagtttcttagtttcagatgtttttgtgttactcgtgttaaaataaagatttaacacaaattaaatttaatacagtttaattgagcaacgaacagttcacaaatcaggtaggcccctcaaccagaatagattcagagcaactttatgctgctgcatgattggagaggatttacagacacaaaaaaaatagtgacgtacagaaaatggaagtgaggtacagaaacagatgaattggctatagctcagcatgccacaattgagcacaatataaacagttggctaccttttattggccaaagcttggtgataggtatgagagtaggttacagtctatttacacatcccgataggttgctgttcactatgtatgaaggaaccattaggcagaacttaaaatatataaggagacagctttaggctaaacttaattttattttcattagcatccttttctgtcagcttgaagaactcccttcagtttttcttgtaaaacacgtctgatggtgatgaactccttcagtttttgtttgggaaaatctttatttatacttcatttctgaaggacagttttgctggatacagtgttcttactttgcagattttttttccctttcatactttgaatatatcaacccactctctcctgatctgtacaatttctgctgagaaatttgctgctagtcatattcgaaatccattatgtgttatttgcttccctttctatcttcagaatcctctctttgtctttggtttttgacagtttgattacaagattactttgggtagctttgtttggattgaatctgactggagaccattgatcatcctgtacctggatatttacatttttctccaaatttggaaagctttctgctgttaaagtcatgtgttgcttaatgatggagatatgttctgagaaatgcattgtttggtgattttgccattgggaaaacatcatagaatgtacttacacaagcgttgatggaatatatcccctatgatgctcctaggcggtaaggtatagcctattgctcttaggctacaaacctgtatgacatgttactatattgaatactataggcagttgtagaacaatggtaaatatctgtgtatcttaaccgtatctaaacatggaaaaggtacagtaaaaatatggtataaaagataaaaaatggtatacctgtataggaacttaccatgaatggagcttataggactggaagttgctctgggttagttagtgagtgagtggtaagtgaatgtgaaggtctaggacattactgtacaccatagactttataaatactacacttaggctgtactaaatttataattttttcctttcttcaatagtaaattaacctcagtttactgtgacttttttactttataagctttgtaatctttttagcttgttgactcttttgtgataacatttagcttaaaacacaaatacattctacagcagtacaaaaatactgttttttttaatattctgtaagatttttctatttaactttttttttcctttttaaacttttttgttaagaactgtgacataaacatgcacattagcgtaagcatacacagtgtgagggtcattaatatcactgtctttcacctccacatgttgtccccctggacggtcttcaggggcaataatacacatgaagctgtaatattctatgataataatgccttcttctggaatacctcctgaaggacctggctgaggctcttcattagaaatgtcacacttttcagaaatatgtcgatggccgtttctttttttcatcatacattcgcttgtaagcagataatgtactacagacattcctttctattaatgaaaacattttggtgttaaggttcattttcaaaatttttatggttgctgttgaggtctgaaaaatatttttgtaaacttttcacttttcattttcttcttcagctgtgtgttcctgtttcaggtttaacaactcttcattagtcagttcctcaggaatcacctctagggattcctcaatgccatcctaattccaacccaggttaaatttggtttgctggccgggtgtggtggctcacgcctgtaatcccagcactttgggaggctgaggcaggtggatcacgaggtcagaagttcaagaccagtctggccaagatggtgaaaccccatctctactaaaaatacaaaaattagcagggcgtggtggcaggcgcctgtaatctcagctacttgggaggctgaggcaggagaatcgcttgaatccggggggcagaggttgcaatgagccaagatcacatcactgtactccagcctgggcgacagagtgagaatccgtctcagaaaaaaaaaagaaaaaaagaaaaagttggtttgccatctcaaccatagccttgttgacatttgtagcttcttcatccttaccaaatcctttgatgtcatggagaagacgcttgagtgttttcccgaagtcattcatacactccttggtgacataactctaagcccaagcaaggttcttgacgcagtcatagatgttgtaatccttccagaattgcacctgtgtcttctcagtgcctcctttagttgcagcaatagcttggataaaggtcttcattaggtagtaggcctcaaaagctgctataattttttgattcattggttggatcaaagaggtggtattttgagggagaaacacctcttttatttgggatgaagatcaccaataaaaggagtatgtgcagaaacattattaatgataaaatcttgacagatatgttattctctaaacaggaatttttcattttgttggcattgcaattcaggagggcactttggaagaggagctgggtcatgcatgacttcttattgttcctgtagtacactggcaatgtgtgcttattgatattgaagactctagggttctcactgtgcagaacataatgggtttcaatttgtagcctgcaatattgcccccaagcaagactcttatcctgtccttgaatgccttgaaatgtgatgttaacttagcctttttatggatgtaagtcctttcaggcattgtttccaccatagggaggtttcatccgtattgaagattcactctgacaagtaattttcctccacaatcagcttatctagagtttctaaaaattcttcaactgtcttcacatcagcacctgcagactcacccatcactttcacattatgtagtgaataaagattcttaaatcatttaaactacctagactagcagtaaattcagcatcatagtcacatctagccttttctttcaacgtcacaaactctttgctttgtctgtgatcattgtggtcctgagagggatacaattctatgcctggttttcaatccaggtcattagaagattttttcatatctgatataggcccttcttgagtatttgttagtctagttgccttcaatgaagtagatcctttaacagattccatcactttgttcttgttcttcaagagagataatagctgtggctgaaagggacaggcctgactagtgagcaatagtcataactgattttccacctttgtagtccttaattacttttaactttatttccaggtcaatcacttgatatggcctcttactggtaacattagcagtggattttgtatgcttaggggccgtgatgaacaaaataacttgagattaagtcaagcacaagagaaaatgatgcatcaatgagacatagtaatcatgagatgtatgtggctgctgctggcataacactgcatcctgttgtacagtaaactttttttaataagtagaaagagtacactctaaaataacaatcaaaagtatggtaaatacataaaccaatatcatagtcatttattatcattatcaaatatataatgtacataattatatgtactatatttttatatgactggcagtgcagtgggtttgtaaacaccaatagcaccacaaacatgtgtaatgtactgcagtatgatgttacaacaactgtgatgtcactaacttataggaatttttcaactctaataatcttatggggccaccatcatacatatgatgcattgttgaccaaaacatcattatgtggttcatgatagtatgtctttaaataagctttctacccttttatcttttttactccttcttaaactcctgagactcaaaatttaccctttaattctattctgtgaatcccataagctttctttattccttttcattcttttttcccttacattgtttttatatttattattttaataatatatttattatattatatattatattaatatataatatataattaatatataaatgtataagatattaatgtatttattatatattatattaatatatttattatatttccccttatattttcaaattacctgtcttcaagttcataagttcttctgcttgatcaattctgctgttgatgttctctgttccatttttcattttgtttttgtgtctttcagttccagtatttttgtttgtttttttaaaatcatttcagcctccctgttaaatgtcttattctggccacttattgttttccttatttcattgaattgtttctctgtattttcttgaagtttgctaagcatcctcaaaacaattattttgaattctttgtcaggcagttcatatatctccttttctgtagggtcagtcactggcacattattttgaccctttgggaatgtcatgtttgcctgattatttttgattctcaaggtcatgcatcagtgtctgtgcatttgaaggatatacatgcttattccagtctccacagactagctttgtctgataagtcccttccacattcatcttacccagagattctgggcagccatctggcatggctccaaagccccagtccactgtggctgatgtggtgttggggtatgcatgaagcctgaggcggcttcagcaggctgaaagcctttggcagctgaagcctgcctgccactgagagctgtctggaatctcctgccactgagagctgtctggaatctgaggctgctgaagtctgcatgatagtggtgtgaatcagagactgagtccacctagcaggcataaagctggaggctacaggatcctgcctggtgctggggcaggtctgtaggctcagtttgcaagtaccaggctggcatctagggtcatgagggcctgcctggtgctggattttactttaatgagcctggtgttaggatccaaggaaaagtcctgtgcttgcttcccgctccttctccccagttaatggtaactctctttgtactgtgccacctggcattggtgatgtgggtaatataaaactgtcccttttgccctcttcaatgtgtattttcttattattgtgctacaaccaggttctatgattgctccattgttttccttagctcttatgaaggtattttcatgcacggttattcaaattaatgtttctctgggaggacaattgctggagagtcatattctgccattttgctccacccctctcttaccttttattcctatttactttttgattgatgtattctatctcctcattctctctctatcataatgatctggcatagtgctttgcccatcatttgcagttgcttatatgatgttgaccaaagtagttcctttgccattcatccaggaaactgtatcccacccacgtaaaaatagtgtagaaggaagaaaatagcaccattatcgctctcattctgaggggctcatctttcagaaactcacccgaagaaattttagagtactaggaaaatctatggcagcatctttaatgtatctgacgatgaaatatcgtgatgtgaatagcaggaataaaacttaataaatattattttatccttggcctaagaatatgaagatactcttttattccttggggtcttgacctactttgtcatctggccaaataattctttgtctctgagaatacctttcttagtccatttgtgctgttataactaaatatcacaggctgggtaatttataaataatatagatttatttctcacagttctgaagattaggaagtccaagaacaaggtactggcatttggtgtcttgtgagggccttattgctgcaccctcacatggcaaaaggggcaaatgctgtatcctcacatggcagaaggcagacaggcaaaaaattcctaagctagtttcttgtagccctttcattaggcattaattaattcatgagggaatagccttcatgatgtaattactttctaaaagaccccccatcttttaatactacaattggggttttcaatataaatttgaaactatggggttttcaatataaattttggaggagacacattcacaccatagcaacatctgttcctggttttatctgcttgcctttcaggaatcattcctgctctagaaactgcctagtattgaaatgaccccttttggtttcctggcttctgagtgccacactctggcttctgattcaagctcctgcctctgccaccttatctacctctactcctctcttgccaccagatctaaccgatgtaccatcagcattataatatccagttgttaaacactgtgattgctattcagagaccattgctcagtgttatttgtgattcacagtttatggaatctcaagaatttcttcaattcctgaagtgtattttaattctggctcttctgtctcttggtacacgttcttgcattctcatactaaaacaaaatattcaactaatctcagagtagatatatcttgcagctttaccttccaatatttgtaatatgcacaaaaggtataatattctctgatatgcgcctttatttaggattagctggtgacatctatggaattctcatggcagccatcttacctagaacttcggctgtctgaagccagttctccagtgctgtcatattcctttataagtcaaagaagtagtacagctctctttttgcaattttttttttttacttttcttaaatatgaagcgcagaaacagcaagttggctatatataattcattgttgtcagaaatcagagtatccgaatgtgaattgtatagtatctaactgattcaggtggactttagtgacgctcttgctagtggtggaagtcatgcgaaggtgttctgagagctttcataacccctgggaaacttgcaggtgatggggtctctccccttgaatccatccttcatctgtgagatttagcacctgcttggagcaagtggcatcaatgaaaatcaatattcatgacagaagcctttctctttttccctgttcaatattatctctgaacattaagaaaattaagcataggaaaactggatatccactggcaaaagagtgaagttggacccctacctcacattatatacaaaaattaactcaaaatagaacacagacataaatgtgagagctaaaactataaaattcttaggagaaaacataggtttaagtctttgtgtccttgggttaggcaatgatttttttagatatgttaccaaaagcacaagcaaccaaagaaaaaatagatatattggattttattaaaattgaaaatatttgcacttcaaaataaaccataaagaaagtaaaaaggcagcccacagaatggatgaaaatatttgcaagtcatgtatttgataaagttctaatatccacagttataaacatttcttacaactcaaccattaaaaaaaaaacaaataacccaattttaaaatggacaaaaattcaaataggcatgttctccaaagaagatatacaaatggtcagtaagcacaaaaaaagatactcaacatcattagccgtcagagaaacacgaatcaaaaccaaagtgagatatcacttcatattcactgggatgctataatcaaataaacagataataaaagttgaggaggttgtaaagcaattagaacgctaatacactgctagtgggaatgtaaaatggtacagacactttggaaaataatttgacaggtcctcaaaaagttaaatatataatcacctgccatgtgacccagcagctccactcctagatatgtattcaagataattgaaactgtctacacaaaaatgtgtacagccatctctccatatcctcgggggattggttctaggaattcccccattcccagttactaaaacctgagtatgctcaagttctttatagaaactggtgtaatatttgcatataatctatgtacatcctcctgtataaattaaaacatctctgtattataatacctaatacaatgtaaatgttacataaattgttatactgtatttttaaaaatttttatttttaaaaattgtgatattgtttatctttgaatatttttgatcagcagttggttgaatatgcacatgtggaacttgtggattcagagggccaactgtatacaaatgtttgtagcagcattattcataataacccaaagtggaaacaaacaaaaagtctaacaactgatgaatggattaaaagtaatgtataaccatacaatgaaatcttatccatcaatagaaagaatgacataatgatacatgctacaacattgttgaatcttgaaaatgttagactaagtaaaaatagtgagacaaaaaggctacatcttttattattccatttatttccaagtaagtagaaaacatattattagtggttgtcaagggctaggcgaggcgggaatggggagtgactgccagtaggcacaggatttttgagagggtaacgaaaaggttgtgtaattagatagtggtgatggttgcacaattttgtgaatatactaataaccattaaattatacagtttaaataaggaaatttcatactgtgtgaactttattttaacaaaaaaattaaggcagccttgatcttaagtctctggtcaaccacctctgctgcttctccgtgcctttcataaccagctccccatccagtccttgacatgtcaaaattatttttccatttaaatttttggcctttatttttcaaggtaactagaaagtttctttgaaatctagtgggttttctttaggccttcatcacatgtaggcacaaaacagtgcctctcctcttatttcaggatgtagatgcaatgattccagaagctaacgatccattgtttatggtcctgaaaggaatggagctcttttcagaacatgtggagaaagccagggcattccagcttagtaaataactctatgctttgcaagaattattcatagtactaaaaatagtacttaaagttttcataacatcccaaaatatcattcacgtttttctcaaaatttcctttatctttgaagtgagagaagagccacatagaatatattttttagaattccattggtaatgtacatgtttctcatgcttttatttgggagtaagtttgtataatcctaactttcttcagctttagtagctatcgtagatcatccttatatcacacttggagcttcacctttttttggataatacaactttataagtagctagcaaagccatgctaaccttattgtgagtggatagacaaaagtgtcaattgaaccagaaatggaaaggggaatggggacagtgattcatacaatggagtagttttcttcttgtgattcataatgtccaatcaaggacaaatggacagaacctgggtggattggactatgctagtgttaaattggaaatctttgcaccttgagcagtggcaaataaccttctcaaacttcaagtagctttattttttattctttagtaagacctgatttttcttttcagaagaaacatttcaactttcttgcaatatggctttgctcagccagctttcccagccaagttgacaggacaaggtgaaaagaaactctcaggggaaagtcaaaccctagctctggggagatgttggctccaggtcacttcaggacaagaccaagtcagcttgtcaaggatctgtggttccactgcccggtctggaatcatctgtctgactttttagttttttatctagcaaaggttcttgagccagtttcttaatattttgtataccgcaatctactttctgtagccctcttcttctcaccttttccctcatctctttacctggcttgtttcatagaacttcataatgaagttcaaagacgtctgcccattcagtggcactaaagcctctagaatagcctgggatctgatggcagggtggggaagctcaaacaggtctgcctaaacaatgaagttttcatctctccactctatctagtatttttaagccagtgatactcaacctttagcaggcatcagaatcaccagagtaaggggttgtggggaaagggggaaggtggacaagcttcctaaaacagattgccagaccccaaccctgaaatttctgactcagtgggttggggtggggactgtgaatttgccttctaaccgtctcccaagtggcactgctgctggtggggtcaggcaccacactttgggaatctctgctctaggatttctcgaattttggtttactcttggcacaattaatccaaatatatgaagctttattgtactgcataggtgatattgaatgtttgttttcccacggttacttaaagcattatagttcagtaattttaaagtttcaataaacccttttattttaccaaggtgaaaatacaccacatgattttaaaatgatgccgtgtcaaccaggacatacataatttgagtctcaatttatatttctacattgtttctaccttttctccttctcttcccttttttcctctctaccttcctgcctcaaacatttatttagtgcctgctatgtacctgacgctaaactaaggcccagggtatggcataaattagtaagggataaataagtatctttgcagtctagtcatgggtgagagacatgaaaaagaagtgaatacggtcatgtgtcacataatgatattttggtcaatgacgcactgtgtattatggtggtcctgtatgattataatactgtatacttactgtaccttttctatttttagatacacaaatactcaaccattgtgctacaactgcctacggtatttagtacggtaatatgctgtacagggttgtagcctaggagcaataagctatcccatctagcctagacgtatagtaggccataccatctaggtttgcgtaagtgcggtctgtgatatttgcacaatgacaaagttgcctaacatgcaattctcagaaggtgtgcccatcatgaagccacacatgactgtacagtgacatgtaccaagggctatggcagcagtatctgggtgtacagtgaacagggcataagctatgcaggaggggtggtgggatggcaggaaaggtagcacagagtcggaactgaggaaccagcatagagtctgcagcctaactagaaggcacgggaactgcagtggtatgaatgccacagtgttgtcttgctcttcctcctttgcttagtttaacttagagaaatccctaagcaaaaggtctttgctatgaaaggacgacaccttctggtcatcctttctggactggctagggctgggagtgattgtatggtacttaactcagaaacataatcctttcattatgtcctaacaatctaaaccaggctacttctcaataattctttctcatgcttctaaaatgaccacacgtgcttggaccactatattaggttttaagaagcatgcctcaatgagtggatggtcataaggcattagagaacacgcaggaaaacaaggtttttaagtatagtttcaaagtttttaagtacatggccctgggacttactcttgcatagagccaaagcccaactctgtcactacctttgtgattttggaaaatttcttaacatcacttgaacctcagttttctcatctgtaaaattggaatatgagataaaattttaatgaggataaaataagatgatgtatgaaaagcgtctggcatattgtaagtccctggttactaaaacagcagcaaaataggcacaaagaatagaagcatttgatataaatgcagcttcatccatccagagatcatatggaaagatacagtaatctaccagtaccctctaagaagtgttataaggaattgctttaaaattataaattatttgagacagattcaccctcaagccagaagaaccacaagcttatcagtgtgtcagatgatcagtacattgggaaaacctaatgatgacaactcagcttttattttgatgtcttaggtacaagtcagaccctgaactcacaaacatagcatcagtgaaaaactggttgaaacttttcaatggttgttgagaaaagaaaaggttttgttttagtgggataaacacacttactccacctacgttttgaaaacagatgtttcaaaggaaaagaagttaaggaaaagcaaatgaactctcccaagcagccacatcctatccatgtgcccatataaagaaattaggagtatgattctcattttgttgtcagagatcatcttcaactctactatcttaaggaatctttaatgtaggacactcctaaatctgctttctctgattttcttttacaaatataaacattattataatcatcagaacagataaagtagagctgcttgagccaagagccacttgatatataccaggcactaaactaagtgctatgtaagcattagcttcattcagtcctcacaactcaatgacaggtacccattttacagataagaaacatgaggcttagagaagtttgtcacttgtccaaagttttcccctaccattcagctgtatgttcaaagcagaactatgaacccagtttcagaatgagtgcatgacatcaccattgtgctgtatggtctcacctgctggtttcagtccgccatggtggagtatcaaattacacatcagcctcctgttgcccagcacctgttgctggtcccaaacgagatagggctgcagcttacgtcatgttagcaggatgccctgaaatccctgcctgtagaggtagctaccacttaaccagagctggagctccctgggtctcatgcaggtgcccagggcagttgagggtttagggtgatctctctgtgctcaggtggcctcaatttgaagtggattattttccacttccttgtttataataaagactgatctactggggcctcagaaagacactgggctactaagcagcggagaggctttgcctcaagcagtcctgcaatgtcttttcatgttttcttctttaggtgcttcaagaaagacccacttcaggcaggaaaacattcttttctgacccagggaggttttaaaataataccttgaatgtcttactttgaaactttgaggattttccctcatttggtgattttgtttctgatatatggtatgtgctttccccatttctgtgtaagaagggagcaaggtttgtcacttgtgcaaagctcagcctgggcccagcctggactctcttgcattctgtgtcccagagctcccagtgaaacaggcccatgtggttcaggcctgcgtggagcctgggctccagtcacggtcacttagaacacagagacagccagcgaggcttgtcctctaaccagcgtttgtttgtttatttgcttgtacctactttgagcacatcttagatctcatctcaattgtgttagtaactcatagacaagaagaatttttgttttcctacagtgtttgggaaattgtatgtgaaaattcctaactgtgccatgcattttctcactttattcctattaataataatttaaagaaaaagaaataaggctgtgccatccgctagtaacaattaaggacaataatatgcatagaatatacttctgttgctcctagagagctagggaatgcaagattttggctaaatgggtagtataccttttttttctttttctcccacagagacgcatgcactccatgcctggaaatttttagaaatagaatatgtccaatactaataacataataactatatactaaaaacaatgttccagaagctgttttaaaatacatatgtttgtaaattatgtacatatgactacataatatatatgtggcatatgcattatgtgtatgtggtacatagacattacccataacaattagaaagtacctctgtctccgttttacagatgaggaagctgaggcacagagagattagtgacttgttcaagatgagacacacgctggtaaatggtggggctaggggttatgtatttaatcaccaggtgatactactatacctccacgactggatgtttcctgggtgtctcaggaggcacttcgatttttgcagtaactcaagaactcaccagtaagaaccttagttaggagttcgagttggtaggaaaacaacggaccaagactcataacctttcttctacaatttacgagttgtatatacttgggcacatctcttaacggaatctcactatcctcatctgtaaaatggagattataacatctatccacatacttcatagaggtgtcataaaggcacgtaacataatgaatctaaagacccctgaaaacccttgaagtgctacataaatattcagaaatggtttcttacatggtcatggttaggtctggaatgctgtgctaaggctttatcactctgagcccagtgccccctttcactcatctgtgctatatcaatgtgtctttcaagcaaattcacatgctaatctgtgttagttcctattctgcagaaatgagaagtgttaaactcattctttaaatataatcccctcactgctatgatagagaatgtgttacaccattaaagaacccacctctctttttttttttcaaatttaagaagcattactttccttttctccttctttcctaagagactagaatcctgtattgcaaatggaagttccctcaataaattttaactgagtagaatctgggatgctcagaatggaagaggtctcttgtaagctggaccaagactttacagataggaaagctgagggtcttatctgacatcacccagcctattagggccaacgtgggccaagagcccacgtgtcctgacttccagcccagagccagttctgcttcatgaccctgccccttgcactcagaagctgagggtatttgtggtttgtttgttttagtgctttcttttattactgatagctcttctgcaaggaatgcctcccctctctaagcatttattctttgttacttacagaagaagactgcataaactgggcgtgtcaaaggtcacccaagtggatttcctgccaagggaagtagtgtcctactcaaaggagacccagactcctcttgccacgcatcagtctgaaggtaaactatgtctttggcttactttccatattatctctggagaaatcgctgggaagtaacatctttcttgttgatttcctcttaccataagagctcttcatgggatacaaacataatgacactgaaagccaaagcctcttctgagtttgaaagctatggagagggaactcggtgatactcttccaagtgacctggcaactttaaattagataaactaaagaggtttatctcactacatcgaaatcatgtgaggagaacaaaaatcatcaaagaacaatgtaatagaaacagtgctgaattttatcaataagaatacattaagcatacattaagaatcttaagcatacattaagattcatcatttacatggcttagcaaactatagcccacccacctgttcctagaaataaggtgttgttggaatacagctatatccaaccattgacttctgtggttactttcttgctgcagtggcagggttgagtagttgtgaaagagaccttatggctcacaaagcctaaaatctttattataacctggccctttacagaaaacctttgctgaccactgatttggtttgccaattgaggtaacaacacacgagagtttctgaccacaatttaaaagtattttcccatgcaaactccacataggtgaatggaaattgaactccataccttctttgtgtatgccagaaaaatatcaagtgaaaaagtcacatacgggtatcagagaatcataaaaatacactcatgagagaagtcgaagttgataaatacttcctagaattcaaaactttatcaaagcaagattatgcaaaagcagaagagggagatgtattttgaaaatagggtaagtgaaagtttcattgttagaggctaacgttgttatagcaaagcaaatactctttttactttatgttattttattcttcggtgggtgaagaggatgttggaattctgggttccttgttgctatgtagtaagtatggacaaaagccatgaaatgcaaaaatgattagcatttcccccttagtgatttaccggaaatataaaaatcagtgcatttttgtttatgcaagctacaggttttcagttttggttctaaataaataacgccaaaagcaaagtgaatcagattccttgaagtccggggtgccgttaggcattctgaaaatcttgcctatacaagctgttgtggggacagttcttcagtagcagggcctccatttctcaagccccagtgaaatgaattttagaagcaaacaagtagcaccctctgctggtgagcttttaaaccaaccaacccaacaaatgagacctgtatattaacgtggctgaaaatacagttagcgagggggaaagaaagaaaagaaaaagaaaatacaaaattagaaaagcctgtgagagttcacctagtctatccttgggcctccagacaagaacaggaagatcgttaaaaaacatcctcaccacccaaccaaaacatttgtttgacttaatttgctgccagaggtatttgcagagctgtagctggaggcatgtttatttagcccaaaacttgacccatagcataaagttatacaactgaaataggagaaggagtgaattattttttaaaatgtgtacttaagatattggaagtggtaaagaaatatttacaagggaagataaattaaggatgaaaaggcatcagctctaaagttttaaactggagcacatcaaaaggaaaaggctgtacattccattttattactgcaaggagagcttgggagccctcattatgctgtggtccaagcagcaggaaagggggaatttatttctcagctattggcagaagttctttctgttttgttcacaagatccatcaagcttttttgtggtgaagggcatttacatggttcagattacaatacagaacccaaagctagctaccatagttcttgacatttaagcaatcctggatggatttggacagaaaaacctttcaatttgggttcagcaaactgcccctcaccacaggcgatgatgccttgacccttggctgccggcagtcacccggctgcccggccatagagggtgctggtgctcactttcacctgctgtggggaggtggttggcaggagagctgcgtggagcagtggacagttggcactgaggttctaccatgcggcagatgtgggttggctccactgtggggtttgagccatggcaatgttttcatgaaaactgcgcctttcagcggcaggaaacaactacggaattttatgacacaatgaggctcttgggtggctaacatttgaagctctggcatatataacatccactttggcttgctgttgcccacaatgtaagaaggcatgctgattattttttgtcattgtttgactgtggacagtttaatgataatcaaactaatgatctcagagcattgatttgttctgcctctaatggattctagtgcattcaagttcttacacattcccattttacttttgaaaatgaaggggaaggcactttggatttgcccaagcttaagcatcctttctgtactgtgcaccgtaatgaacattctcatcatagtaagtattaatttttgatcataatgatctgttatgagaaacactccagacagtgatataaataagcaagatttaagtataaattctccatgaatactgttctttcaacaaggttagaccttccttctctgcagggaaagaaggccaagaatggccaacactgacttggagaaggatacctttgccccaatatatttgaaacacataattttattcccaagtagcaagaaaggaaaacgaaattatggtcccctccaaggctgcctctctgttgcctattatgaacccatttctgtaccaaccatgaggtcctgggcttagggagccagtcttttgcatctttattatagtgagtgagtgcatggcttatcctgagtacccaagaaatgctgttgaacgacaaagataatgccagacatctctagaaacaccaagttcactatgttccccctgggggaatgagaatttcttaatctgctggaaagatgcaagccacactggaggaaggaggaggaaatttctacaacctggtacataatcatagtttgttttgatagtcacctggtatcttgtggtcaaggtttaatctctactcaggcccagtagcaaaccaagacatctctctcaaagggagagtaatgcaataaagaggccacattattattctaaaatctaagcacttcttctgagactcacctcttagggacatttgtttgatttgccatagacacttggggcaccattgggtcagctggaccataatttccaagtagtatagccatttgaaagaaaaactttcaaaccactgggtaaatggattgaataaataggtgcaaatgttgaacatgttgcctgcaaaacccagaatgacccactaagcatttcgactcttaatattagagaattaaggtattcacatatactttggagtttaccagatgactagaccaatagagactttcttaaggtagcgagtacttatgttttcaaagatttttcctccatcctctggcctacataatgtcttaactaggtcttaaagataccagctacagcttcctctccaggtcctgctgacatgatgctccatgttgaaggtgagattgacaagggctacagatagagaactggctcagccctgaggtaggatgatgaagatgcaaagagaaaggctgcaggtctttggctgtcaagcaaggcttagtgtagaacatggtttggaggtactcccaggcctccgtattcttacctacattcaatttcccattatttcctgatcattgctgtcactttcacataagtcacctggtgacactagcaattccacagaccttattcagaaacccacagaatttaaactttgcatttgactttgacatttttgtagatacttatcacaagcagagaaagtccatgggtctatgcctagatctaaaatatagagacttcaacctgtcatctatttcttacagctgtccagtcccattagaagtatccacctcatcctagtgtctttaaattcttcatgccactcacactattcaatagcagtgaaaatttgatcccctaaatccttcttttcaacggacacttcattaaagatcaccatagaagaaaaattatgtagctatttgttacagctgacagattcccattcctgaactcttactgaatttttattttctttagcatcagctatggcagataaccaacatcagcttcccacgtgactatctcctgatggtagtttctgtaccagactgagtttgtggttgctgacaatagaaactaactctaattaagtttaaacagaaaaaaaggtttgttgagaagatatgagatacttgatagaattgacaaaagaaaaaaaagccagagcattaggtttgaaataaaaagtaaattaggtagctgctatcgactggattgtgtatccccacaattcatatattgaaggcttaacccctaatacgactatgtttgtaaatagggtttttaggaggtaattaaggttaaatgaagtcataagggtaggatctctaattggtggccttattagaaaaagaagagagagagagagagagagatctttctccctgtgtgtgtgttcaccgaggaaaggccatgtgaggacacagcaagaaggcagctgtctgcgagccagaaagagagctttcaccagaaaatgaactggctggcaccttgatcttggacttcccagcttccagaactgtgagaaaataaattgtccttgtttaagccacccagtttatgctatttttcatggcagcctgagcagactaagacagcagctaacacagcaagatcataccagttaaccttcctggttagaagacctgagcctcctgacttccggtcactggatactctctgttaggctcatgatttaaactctgtagtcactgctggcttggaaacctctaactctctctgcctcttgacagtgttccctcaagggagtccattagccaggactaggttacatgcccctgtgtcagctgtgagggacaaggcagagaaataactgcccaagttcagcttcccataatgtttggggatgctatgactcaactttgatctatttttatatccttccttttagaacaatgggtgtttggatgctaagtggccaagaatatatattggaaaaatgcccactttggtgtaagaaaaagaaaaaaaagggaggtaaagagaaaaataatatttattatgtgttcagcacactcatatacattattacgcttgcagcattgctagaatttactcaccttataaatcagaggtgccgagagaatgcagttcctttattttatctgcagccatttataataccactagttgacatggagaaaatatacaaaataaacaactttagttcactctcatcttttaaaccgtccctgttagtatgttccattaatcttgggtagaaatgcccaaattcatagagtccccctctcatctgcatctctctctgagatcatggtcaattgtagagggaagaaagatgaggtttacatgatctaatggccttggtggagatagggaggatgagggactctggccttgtgctagtccctggcagcatgctggctgacatctgttgccctctggcatgatgtcctttgtccacctgggcactggcaccctgtgttagagtgtgtagctggtgaacttgtgatttgttcttttggcttagtttggcaatgttcctagggagcattggctatctctcttttgatgatttagtctcctctcagctgtcatggtctccagaccttgagttgatgccttgtcctttctccatcctagaggtctaccttcagcccatgccatgcctttatccaccacagcagatctcttggcatactgactctcgctttggtgcccatgcctcagaatatttaagggagatcctcacctgttcttttctcagtcttatcatgccagtcacccccagggaggctcagatgcctatggtgaataagatctattgcatggtggtctcttttcagattcccaaaaaaggagtgtggttcaagaaccctgtgctcattcctcctcttagtttaacactccacctctcctaatgcttcccccagaaagtgaaaatccagatatatctgaaactttgtctcttcttccgaaatgctcctatctggaaataaattcccctgtttaacttccttcaatttatatcttcattctaccatggagtctcaaggttttactgttctggacagaaggagtgatcttggtagttattgatattttaaatggtaaggaaaaaaactggaatatcctttctccctcaattaaacttggctctcaaactacagtgggattacaaaattcaatgttttgagatggaagctgagttttaccttagctgttttattttcattctatatcaaattctaatctctctactggcaaaaaaaatgccctaggtacactagggtgaatatcattacattcacaaagacaaacagaaaagcatattaataattttcaaatataagccccgctacacacaaaaattatttttgcctacctctcataatcaatgacacagtcaagaaatagcagaactaaataatattacaaggcatagcaaacctttaattccctggagagtaacaactgatatgttgacttacttaagaaacatctaaggttccacttccagcataaagtagacacaagagatagagcacatggggcatgtgagatggtccatgaatctacttcccagtaaaattggtaaaaatgataacaacaacaaaaccgcacaactatttaaaatatctgggagcagtcctaatagcatatagcaagtaaaaaaaagaaaaaaagaaaaacatttatctaataaaactaatcacaacttggtaaaaacaggaagattctatggtatttgaaccatactccattccctccttgcccccaattcagctttaaggaaattacttcaggtggatgcagcagaaaacacagggctacctctcctgccagctcccacttggagagctattgtatcttcctggaagaggcaagacattagcatttctcatactgccccagctacttgtttcagaagataagttccaagcaagtgtgagtacaaggtggggactcccttttttcagcccaacactaacttgagggatggagattttaccttggcttcaacatgctgagaacatgggaccccaactgtcttctccatggctcatgtgtaaagcagaggtttcatggtgggaaaagcaagctaagtagaccagaagcaatagcagtaccctactctcccacacagccagctgctaaagcaagggtgtcactcagaaagaagtgtgccattgtcccctcccccagctccagaatcttggtgcaaagattttgaccagggagagaggcaagtcaaaatcagagagctcagaatgtcttctcaaaagagctaacatgattttcaatgttcaagcctaagggcatcctcaaaacaatcaagatagtggtgtaaagcaattaagaaaagactggtagatgtgctaaatgtgtagacaagctgaaacatagctagcttaccagacagaaccaggaaaacagacagctaagaagagcccttctgggatcacaacacatctcaaaaactggtctcaaaaactgtaaattaaattcaggcttatttcaacctgtggagaaaattgtgccccagggcagtgttgaaaactatagagcaacaattatggaactcaatggcagcaattagtgaaactgagcagttgaagtgatcagagaaaggaactgctaaatggactacaaaaacctgttaccgcaggataactatgcacatgcccaaggctgcgcccttccaggaccagtatgagaggattcacactgtgggaggacaggggagaacagatttcaccaaaatagcccaaccaatcactaaacaaataagcaagcaaataacaataacaaacctgggggttggggggactggtatccagtgctgctacaatatattatcaaagtcaatttcttaaaaaaagaaatttgaggcaaagaaaccagaaagtctgacccctacacaggcagggaagcaggcaacagaaactgcctgtgagggcaactagatggatttaacaaagacttcagagttgtgtatgtgtgtatgtgttttttcaaagaactaaaagaaaccatactaatgaagtaaatgaaagtatgattactatatttcaccaaatagagaatgtcaacacagagctagaaattttttggaaaaaaaaggaatcaaatgtaaattctagagttcagtacaaaaactgaagtgaaaaattcattaaaggcacataaacaaacattgaactaatagaagaaaagaattagcaaacttcaagatagattgatagggagtatgcagtctgaagatgagaaaggataaacaatgaagaaaaactaagagatcctcagagaaatgtgggataccattaagcaaatcagcctacctgtaacaggaatgccagaaggatagatcaaagaaaaaggagtagaaaatactcaaataaataatggaataaaatttctcaaatttgatgaaaaactttaactataaacctaagaggctctaaactccaagtaagattaaagcaaatagttccatagacacagcatagtacaaatgctgaaacccaaagacaaggaaaatatcctgaaagcagcaagagaaaatgaattttcacttacaagagaacctcaataagataaactgctgacttcttatcagaaataattatgaccagaagacagtggtgtggtgtattcctagtgcccaaagaaaagaagaaaaaaaaaaaaacaactatcaatcaagaatcactacccagcaaagctatcttttaaaaatgaaggtaaagtaaaaacattcacagataatcattgagataatttgtagtcacagacccaccttacaagaaatataaaagaaagttattcagactgaaagtgactgaccccagagagtaattcaaatctatagggaaaaacaaagagcacaagtagaggtagctatgtaactataaaagatagtatacataaatatttcttttttcttttccttctcttaacttatttaaatagcagtgatataaaacactataccaataattgtattattcagcctataacttatagaaaggtaatatattttctaataacaggacaaagaaggtgagtggcagcactttgttatttacagaaattctccattgttctttttttttgctgaaatcctgtagtctatagtaactagcattaaaactcttaaatgaaaaagagtcttatattttggggatagtagagaagtgaagaagaagtaattatggggagaggaacagcaaaagtaaagtaagtgataaaataatcaaagagtaaaaagagtcatgcttagctcttgtggcataaagcaagaaagaaagtcataacaaataactagtcaaagacacggaaatgagggcaggagagctctgtgtggcctccatacattttagacagttaagggtcaaaatctgggctatctagttgaaggcattagaaattcaaccatatgacctaggcttcatggggggtacattaagagaggaatgcctacttccctttttctggtatccagaaagagcaagcttccctcaaacttctaacttgtatgcctttcttttctcctcctaatagagagagaattgtaggaaggtaattgtccaacattttttgattggatgtaactaacttatcaatggttctaagcatgaagaatttggtctatttatactaacgttctccccagaccagttagagttacgtgtttgctctgccatgtaggagctgttccaaggtctagaatctgcatggaagaagtagtaagtccagttttacttttacagtaacttataattgtcagcctattccttattactagtaatgatgatagtttggcctttatttgttttattcctgttcttatttttcaattaattcagaacttggacaggaaaaagtggtactatttcaaaaccccgacaccttggtacattgcctggaaatctaacccagtcctcccacatggtaagagagaattccaccaaccgaacacacttcctgtccacatctgatgtttcttccaatgtgaagtccgttcgtggaatactcttagcttcttgccacccctttaccactccactctaccctgcatactccacccccagaggaggtggaatgatttatccaattggtaggtttggataaacgacccgggcagtttcaggccatctccagtttttttcctgggggagccagcatacctgtaggggttacaagttactttcttctcctttgtgccatgagtcatactcaagtcacatgcaagaggggatgcctgtcaggtccagccttacctgtgagagagtgggtaagtctgcctatttcaggaaatcaattagtagatccatttggctttcttcataacctacatcttcttactttttttttttttttttttttttgagacagaatcttgctctgtcacccaggctggagtacagtgacgtgttctcagctcactgcaacctccgcctcctgagttcaaccgattctcctgcctcagcctcccgagtagctgggattacaggtgcacaccaccgtgcccagctaatttttgtatttttagtagagatggggtttcaccatattggccaggctggtctcaaactcctgaccctcacgatccgcccatctcagcctcccataacttgcattttcactcgttcgttatcaacaatgaaaatgttattttggcctccctccatttttttatctttccctaatttctcatttggatgctatttatttagtcctcttaagaatctcaaacagtagaaggaaaattatgtcacgatgtcagttctgaagaaatcaaagtactgaagataatgttaatgaccataggtaattacacaagaaagagtaacttaggcagaagggagagggttatattctaggaacaaggaaatagcccatttgtagaagtggattacagggtcagagtggaagcagcaataaagtcaccttgatgctgagccctgaaatccttccaattctctatgaatgtgtgtcaatgctgagcctgtgtgtgaaggtactaactgtgtaggtttgtgagggaagagagccaggaagcttgctatacttgatgacttatttgaaaaggaaaaagaaaaaaaaaagtaaaacctgatcactattaccataaagccatagcatgaaataagattttctgtaaaattgttagcacagcattccagttttgataacacttcagatgattttgttgcagtaaaatatatcagactgaaaacctttcctttgcctaaaggaaggtagttcttggactatttgggaacaaatgatctctttcaatagctcaaaacttgtagtgtgacatttgttttcttgtgatcaatagagcaagtgttcattttcaccatgagggtggcatactggaggctcaagctaattatttttctggtaatgggaaataagattgagccgatggctcaaagcaagtgagaataacttttgattccctctgcctgattattctctagtgtcatatggcagcccctggcagcccattcacatttcctgattaagtaagcagtttgagtcaggcatatggtcatgcatcagatagttctctggataatattagttccaaggtaagaaagaaaatatggttaaatgtgtatgagtttataatttatttactgttcacaggggtgggatttgccttgcacattgctaccctcatagcttccatttgtttgatatatgctctggctgaggacaccatattcatatgtattttttttatcttcagcagaaccatttaaaatttccttcctttcctatttccttcagtatgttctctatttccaaaaccatcttctttccctggagcaaccattttcttttgtttaggatcacaaatttcacatctcctgtcaatctttttgtcaagaggatattgtgaagataaaatgacaaaatggttggaaaaaatgcttttctttgaactattatttcaataataggtattgttttgctgccgaagactgagaaaagttttatggataccaattttcccctcataaagtagatcaagacaatgttcttgccaaaaccgggtacttcttagtcatgttgagctttgggaggtgtctattttctccagaagaagaggacaaagagatgcaccatatttcttaaagtcctggataggaagtttgagcatctgtttccctctatccatagttcattcacagtggtaacttcagcagtcatccagcagaactaaatagtgtccccatcatcttcaggtgctctgaataagtagtgatttgggctgctagaaagatccttgggtgggctggcagtaacacatcttccagtaatcattactagaagtgtcagcctaggtaaattcatgttcatctgggaccattttctcttactttgcttaaatttaacccagatcttaagatccaagtgttatattgaacattggtgaggtacagcgaaatttgaagaggtgggaaaaagttttcctttccacccttacagagacaacacgctgaggaaataggactctcccttcgtctatttaggtaatccttggcttggcatatttgggtaagaaaatgaaaggtttgcctacatagttgaaatctctcgtcacattatatcatctgaagcctatttgtacgttgggatcattttatttggttttggttaggcataaaagtgttctgtggtctcctcttttttcaaggccttctggcttttggaaaattgagtgatttcatccctgtccgggtttcctagtgaaatcttgtatttttactcaaattacttgatcaattagttatgtcagctgcccaaaatgtgcctttttattaatagcaccttttatcaactcattggaattagaaattgcaaccatggtttgaggctggtaacatcttgcaataatttataaattttactttttaaaaagacctcacaattgctcatttgtgaactttttggatgtgtccctgtgtgagaaattgcatttgtattattattagttctgacaaactggattagatcttggctattgttaagtggttctatctgccctcaaatctactgagagacacagcattttaaatgaatttaattaaaacggcatgtggtttatagagctgcctccagttagtatgccattcttcttgactgaatagagtttctactaatgtataatgatgttttatgtgagagatgtttgaaactccttcatagtagccccgaggtagtttccgtggaatgacatggtggtgaaattttaaaattctaaaaaaccttttatacttaagtgagtcatgtttacactaactaatgtatgcataaatgtgttaaatatgtttgttgaagctgtgagagacatggattgtatttcaacaccagcaatatgttggcagtgagagatttttaagaaattcaaatctgggagcagtttggaagatctgagaaaagatatatggataccaataatatgtattattctttgaagtatgaaaaaagaccactgtggaacttcctcttaaaatcagttcctttggtcaactagttttaatggttctcccctaaggaataagaattatacataaagacgattctcagcatcagtttaaaacaaagtcttggaaaatatcaatgatagaagtttatgtttttttaatgaagattttttgcatttttgaatattttaaaagaataaattgttcaataaaactttatagagggagtcaatgaagccatttgactgaatagactcaaattctggttctggaaattgatctttgatgataatgataggataactgcagggaagtcgtcttgacccattttcctccacagtcagtcttctgaaatgacactactgagaaatgcagtctttacatcatcttcattaagtacacaacaaaatgtctggcaatgttgtagactccagcgggacatggttagagaagaagtggttcagcagaagggagtaagctccaggtaaacatgcagcacaaatgaggaagaatttccaggacatggaaactaacgggtaagagagatgagctcagattggaggagctcacctcagcctctcaaaatgctaggattacagacatgaaccactatgcctggcccttcatttttttttttttctaagagacagagtcttgctgtgttgcccagactggagtccagtggcatgatcatagctcactgtagccttccagtgagcaaggaaggaaacaatgaactttccatgggaagagagttgaaataaaggaaggtcatgagaaactcaggctgtgatttcttgagaggaagtcaatgaaatgaactacaggcatgaacaatgaagaaaagttaaaaggataatagagacaacagcttggccgggcatggtggctcacacctgtaatcctagctctcagggaggcagaggcgggaggatagcttgagcccaggagttcaagacctgcctgggcaatatagcgagaccccgttctccacgaaaaggaagaaaaaaaaagacaaaaaaaaaaaaataagcgtaatagagacaacagcttataggctacatacacagcagtattctctgtttctcctcaacctcagtaaaagctaatctacctcatagggctgtcatgaagatcaaatgtagtcaatataaaaaaaattcatgtaagatgcttagtacaatacatggtatattacaagtactcaaagcattttaacttaaaaattaccatttgcatgtattctaactagatgtctttcttaatgtttccataaaagattccatatattgattcaaaattaacaaatatcttttcatttctagaaaccctgtgttttctcctgatctgaatggcatgtcattttagaattcttattgtgagatgtttcttcttcttctttttttttgaaatggagtctcagtctgttgctcaggctggagtgcagtggcatgatcttggctcactgcaacttccacctcccaggttcaagtgattctcctgcctcagcctctcaattagctgggaatacaggcactcaccaccacacctggccaattttttgtttgtttgtatttttagcagagatggggttttcccatgttggccaggctggtcttgaatgcctgacctcaagtgatccattcgcctcagcctctcaaagtgctgggattacagacatgagccaccatgccctgcccttcatttttttcttcctaagagacggagtcttgctgtgttgcccagtctggagtccagtggcatgatcatagctcactgcaggctcaacctcctgggttcaaaggatcctccctcctcagcctcccaagtagctgaggaaacaggtgcatgccaccatgtccagctaattttttaatttcttaattttttgtagagacagggtctcactgtattgcccaggctcttttcaaattcctagcttcaagcagtcctcctgccttagcctcccaacgtgctaggattacagatgtaagccactgtgcctggtcttgatcttagcttcttaaaaaatcagaagtgttttaggtagtggtatcttccaaaaatgtcattatcagaaagaaagacatttttaaaaacccacaacatttttattccttgcacttaattttttggcctctaactttgggagatgaaaataatctctctgaagaaaaaataaactaccaaaggtcttattataaatcctacttttaagatctgggtaacactgtttaataatagcatagcagctatcctttattgagctattacttgcccagtacaatatgcaatctacatatttcctctacagtcttcacttctatgctaaacaaattgtattattctacaattttataaagaaactaagactcaggccggacgcagtggcccacacctatgatcccaacactttgggaggccgaggcaggcagatcacttgaggctaggaaaacaagaccaggctggccaacatggtgaaaccccgtctctattaaaaatacaaaaattacctgagcgtggtgtcatgtctgtagtcccagctactcaggacactggggcaggaggattgcttgaactggggaggcggaggttgcagtgagccgagatggcactactgcactccagcctgggtgacagagtgagacctgtctcaaaaaaataaagcaaaacaaaacaaacaagcaaaaaaacccatactcaccaaaagaaaaaaaaaattaagacttagagaacttaacttgctagcaaataaccaagccagaattcacactcagtgcttcctgactttaagtttcttcccatgatgccattctgcctcaaaccagacagccaatctccttaagaagacaacaattttttatcaaaatattttgacattagtgaattaaccaagtatgccacttgtctgactgtgcaaatccttaccaaggaagcaaagtggaaaaaaaaattgaggaaattccagacaatggaaacacaataggcaaaaagacatttcagttttatctggagaacatatgaaaggagcagcagtgatcacagagaacaagctggaaacacttccttgtgagtgatggtattctgtttccatggtaactagacatggcagaggaagtcaatgcctcgtttctgtttactcaatctgtatgagctcagtgtatacgacagggcagttttcaacaaagaataattcagtgagacagccctgatcatgtcacccctgcctaaaaactttccaggattcttggctaagtgcaggacgcctcgtgggcataggaggtcctctactcagccagtctcatctcctgctctctacagttccgtctctatgctctggtccattctgacatgcacccaatccgggctgcatattagagtcacctagggagctttaaaaatatacagatgtctgggcttcacgaaccccagggattctgatttgatgatctggggtagggtcttaaaatctctccaggtaattagaaagcacagccgggattgagaagatcactgatctaatcaaagaggattctaaaaactacttcattctcctgactctacactttatactaacgcccttcctttctcctgaaagatcttttctctctcctcccctttcaccttctctggccaactataccttttaaattcttttcatcttgtaaagtgtttctccaatgccttgaagcttttcttaattccccgtcctctttttagttgaacatagtatctctttcatttaaactttaaaaatgtgtttttacccctcttatagcatttatatttcctatcactacctcctctcacccttctctatgagcaaggactaggttttgcagatttcttgatatactaaaggctcaataaaaaattaaatacctgtatttcaaaggttgcaaaatatctgtctttggagaaaagagttaatatcctccatttctgatgatgcttgaattgagttcaagactgggcccaaagtccatcccctaatagtgagaatgcttattttagagcctgcaagccccccggtattgtattagaatggtgtatgggcttgggtgcattattttcaggagagtttccgtagctttaatcagactctcaaagttacccatctatgattcattaacatgttaaagctactatcctacaagatgaatcttcagaggctcagtgctcagtggtgacagtggccttgatttgacactgtttactggacactaaccttccatttctctttctgccataattttaggccacttcacctccatttaggttgaatgccttcatgaaaatgttagtactccaaagactaatcgagaataacacctatcatttggatgattaaatatttttaaatgaaaaataaaattaggccaggagtggcggctcacacctgtaatccaaacactttaggaggccaaggtgggcagattgcttgagcccaggaattcaagacaagactggccaacatggcaaaccccatctccacaaaaagtacaaaaatctagctgaacgtggtagtgcacgcctgtagtcccagctacttgggaggctgaggtgggaggatcgcttgagcccaggaggttgaggctacagtgagctgtgatcatgccattttagtccagcctgggcaacagagtgagaccctgtctttaaaaaaataagaagaagaaacaaaattaaaggtacttttgttattggctcagaaaaatgtgaattcccatcttggttaggtgataaatgcatagtgtctttgccaccattgaccaccacagagaaaagtgctcatatgcatgtgtatgttgtgtgtgttttgtatgagtattttagcaaaatgtgatttttcttagacaaaaaaattgccaaaggcctggttgtctgcaaaaggaataaaattcatttcggcaggccacctctgagtttcttaggtttcattatttgctgctgaaatatttgagactaaaacaacaacaatcaaaacatgacttagtagctgttcgaagtaatttttctacttctgggcacaaaatagccagaaaagcgtctgtcttctcaattgaactgatttgtaattctagaatgtaagaggaaaaaactggaaggacctccacttaaatctgtaattttggtaattctgaagtaacgtgacacaaggaattttgatcattgctcagttcagcctgggggaatctcctttcaaggaatgagaaatgcttgggagaagtcattggaggaagctgcaattggggtttgacctgaataaattgaaatagaacatgggagatattacctagtgagcctagtagaaattagcaagctgaagataagagttagcagtatatatattcacatatatatggctgtatactcaaaattgttgcaaagtgtgaacatcagacttaatcaaatgacatgctgatatgcctccttataaaaaagggttggcattaaaattcagaattttcaaaatacaaaaattagaaggtgattactcacgtttttaaaagaactctttgccttaaaaagaatctaccacattattccattcaaattaccccttatagaaacgacttcctgttcaataaatagttctgggacaactggcttatcatatgcagaagactgaaaatggactcctatgttacaccatacacaagaatcaactcaacatggattaaagacttaaatgtaaattacaaaactataaaagccctgaaagttaacctaggcaataccattcaggacaaagaaactggcaaagatttcattttcataccaaaaacaattgcaaaaaagcaaaaattgacaaattggattaaacttaagagtttctgcacagcaaaagaaaccatccacagagtaaacagaaaacctacagaatgagagaaaatatttgcaaactattcatcatctgacaaaggtctaatatccagtatctataaaaaaactttaacaaatttacaacaacaacaacaacaccccattaaaaagtaggcaaaggacatgaatagacacttttcaaaagaagacatacatgtggccaataagcatatgaagaaaagctcaacatcactgatcatgagagaaatgcaaatcaaaaccaccatgagatagcatctcacaccaatcagaatgtctattattaaaaggtcaaaaactaacagatgctggcaaggttgcggataaaagagaatgcttacacactgttggtgggagtgtaaattagttcaactgttgtggaaagcagtgtggcaattcctgaaatagcgaaaaacagaactaccattcaatccccttactgatatatctgatgtaataaatcattctcccataaaggcatatgcatgtgtatgttcattgcagcactattcacaattgcaaatatatggaatcaacctcaatgcccatcagtggcaaagtgaataaagaaaatgcggtgcatatataccatggaatactatgcagccataaaaagaatgagattatgtcctttgcaggaacatggatgaagctggaggccattatccttaacaaaaatgcaggaacagaaaggcaaataccacatgttctcactttaagtgggacttaaatgatgagaacacatggacacatagaggggaacaacagatactggggcctccttgacggtggagggtgagaggaggaggaagggagaggatcagaaaaagtaactattgggtactaggcttggtacctgagtgagaaagtaatctgttcaacaaacccctgtgacacaaatttacccatataaaaaaccttcagatgcaccactgtacctaaaataaaagtttaaaaaataaataaaattaaattaatgagatgctctttaaagtatgttaaaattgccatttggttaatttcagaggttctcacacttcagtgtgcatcgcagtcaccagaaaggtatgttaataaaaattaggttgctcagcccccaccctcagaatttctgattcagaaggtttgggatggatccctaaaatctgcatttcgaacaggttctctggtctgggcaccagtttgaaaactgttggtttattaaaattcttcctgaacgtagtttattagaaaaaaatctatgatgtaacaggaagtaaacctacaagtgatttttagtggatgtgatgtgctgaattgtgtatcccccaaatttcatatgctgaagtcctcatccccagtacctcagaatgtgactgtgtttaaagatagggtccttaaagaagtaattaagttaaaatgaggtcattagagtgggccttcatccaacatatgactagtgtccttataggaaggggaaattaggacccaggcacacacagaggaaagcccatgtgaaaaaaacagggagaaggtggtcatctacaagccaaggaaagaggactcagaagaaaccagcctgctgacaccttcacttggatttctagccccaagactacgaagaaatatatttccgatgtttgatctccctagtctgtggtcctctgttatgggtctagcaagctaatacagattgtgggcttcaaaataaaatagctatttagaaaatgtattcaacggttttgcgtttggtctaagggtaaaaatcaaaagtgatagtaaagtaagagaagcaaacagagtaaaatgcactcttaacctctgcttcatgtccacttttgcctttgtagatgtctctgggcatctgggcttggaggagatacctgaatttatgtttaatcaggggacactattggtgtcaggttggttcacaaatgtgggagaataagagagctacatggaaaggaagagtccatatgaacagaatgaagtgtgtggcctagggagagttttaatgttcttgcatattcagtgtctttatgaatagtataccaaatatacaggggttataaattgggggaaagggagcatgatgcagagtgtgggtgaagagtgtgttttatttggtctgctcactgtttgcacaatttgaagttaaatgatttggggtgtgtactctatcctcactcctcctttggtcacatatccaccttcttcacgcatttgttctgcctggtctctagatgcctttcagtgggtgacccccaatttcaagtatcctatagtggttattgtcccctacacagtacatgttagttgtaagttctggtaaattttgtttttgtaacttttttttttctttttgagacagattgttgctctttcacccaggctggagtgcagtagcatcatttcggctcattgcaacctctgcctcccaggtttaagtgattcttctgcctcagcctcctaagtagctgtgattacaggcatgcaccaccatgcccagctaattttttcttttttttaaattgagacagagtcttgctctgtcatccaggctggagtgcagtggcatgatctcagcccactgcaacctccacctcctgggttcaagcaattctcctgcctcagcctcctgagtagctgggattaaaagcacacactggcccacgccaccatgcccagctaatttttcttccccccgagacagagtcttgctctgtcgcccaggcgggagtgcagtggcggtgatctcggctcactgcaagctccacctcccgggttcacgccattctcccgcctcagcctcccaagtagctgggactacagatgcctgccaccacgcccagctaatttttttgtatttttagtagagatggggtttcactgtgtaagccaggatggtctctatctcctgacctcatgatcctcctgcctcagcctcccaaagtgctgggattacaggtgtaagccaccgtgcctgacctaatttttgtatttttagtagagatggggtttcaccatgttggccaggctgatcttgaattcctgacctcaggtgatccgcccaccttggccttccaaagtgctgggattacaggtgtgagccaccgcacctggccctgtaactatttttattataagaattttctcctagcagtagtgatggaaataacattagcaatacaaatgctatcttatagagggagaaaatgaggaggcccaataccatttcatgagtgagtcagaaggtgaaatccacaatcacttgcttttatgctttgctcaaagtggcaggctccatggcctcttaaaaaaattgccatctttttattataaagtaataaataaattgcaaattctgccataaactctttcctcgtgacctttcttaaatttgttttcttttttcttcatttcttaataagtctttatatattttggcacagtaagctttgaaaagggagggttaaaaatagcttcctggtttcagctaccaaacacaagcatgttttggagctctcccacaacaggctgatttccaaagaaacacacatttattcatcctgaagggctgtgatgttgaggagtcagacaaaaaattcaactattatgtgaagacagtttgagaaatataaataagggagtgctttcactagcacttgcagtatggatttgtgactcaagaaagtcctgttcatgtgtttcttcattttttccctgggtttccataatcagagaagggaaggacaggaaagcatgtgatatttatatagcagaaatgatactatattaaagggtttctttaggtgttaaacagtttggcttgcaaacgtctagacttttttaaatatctaaaaatgacaaatcttaaacaccactcccaataacttccttaaaatttgatataagaaatgttgcctgggctttatagtcccataattgcttggctgagaacatgtgccttactcctgttcctatacaaggtccatcatcttgctggcactccatgaatgtcaactaccaagtgtacagatttaggtatcaaagactgctgatgatgcaaaacctagagatctaggaaatactgaggaataatgcagccagactcaaaaggtttgtttctttgagctgccagagctagtaatgtaagtggaaaatatagttaatatagacagatgtcaaacaaagccaagtggaaagaacaggaaacaaaaatattaaatgaaacagtagagtgtgcttactgggttgggacttggagaattgggtttggaatctctttgcagtctgccctgtgaaagactgaaagaaaattttgaagtgatgtgaaaatttattcggttcctcagtggataaccctttcccaaacaatgagaatctctgatgaagcctctgctgttacttatgaagaaatttgataactatttaacatgttgatattatactactatcaagtgatattgtaaatacctgcccttccctcatccacccatgcaaagcatcctggaacatcccagattattagttgctgtagtccatctagaatgctataatgagacaccataaactgggtagcttataaataacagaaatttgtgtctcacaattctgaaggctggaaagtccaagatcaagattccaggagacttggcacctggtgaagcctggctttctggtttatagaaagcatcttctctgtctcctgatatgatagaaggggcaagggatctctctagggtctctttataagagtaccaatccccagttatctcccaaaggacctacatctaatacccttaccttgggggttaggatttcaatacctgaatttgggggggggacataaacatttagtctattgtattagcactgcaagcatagggtgtaagagtgtgtatcttcttttcaaacttaggaattagctatttcttcatagattcttctagttagtaataggttggtgcaaaagtaatcacagtttaaattttaaatcattataactaggctcaaacacatctttattaattaaaataggaaccattacaatcaacacatttttgccaactggaaataagtttgtttattcctgtagcataaaaatctgtgcttcgggattcaatgaactcttggaaagcattttctgcatcctgctggttgtggaaacattttccatgtaaaaagttgtcgagatgcttgaagaagtcagttggtgagaggtcaggtgaatatggcagttgaggcaaaacttcttagcccaattcgttcaacttttgaagcattggttgtgtgttgtgcaatgagtggtcaggcattgttgtggagaagaattgggccttttctgttgaccaatgccggctgcaggcattgcagttttcagtgcatctcatcaatttgctgagcatacttctcagatgtaatggtttcaccgggattcagaaagctgcagtggatcagactggcaacagacaacctaacagtgaccacgacccttttttggtgcaactttggctttggaaagtgctttggaacttcatcttggtctgaccactgagctggtcatcgctggttgttgtataaaattcacttttcgtcacatgtcacaatccgatggagtatagttcattgttgttgagtacaataagagaaaatgacacttcaaaatggtgatattttcaattttcactcagctcacgaggcacccatttatcagctttttcactcttccaatttgcttcaaatgccaaacaaccatagaatggtccatgttgagttcttcggcaatttctcatgtggttgtacgaggatcagcttcgacgattgctctcaattggtcattgtcaacttccgatggctggccactatactcctcatctcaagtctcctgtctcctttggaaaacttcttgaaccaccactgcactgtacattcattagcagttcctgggccgaatgcgttgttgatgttgtgagttgtctccactgctttacgacccattttgaactcgaataagaaaatcattcgaatttgctttttgtctaacatcatttccattgtctaaaataaatataaaataaacagcaagtaataagtcattagcaaaaaaaaagtgagaaatggccattaaagtgatatataacataactacatttatttaagaatgtattccaatatcacacagcaaatttcaacaatgcaaaaactgcaattatgtttgcaccaagctaatagtatcctgtcttatgccactaattaccttagggctgagtgaaagcggggcctgctagccctgatgatggaccctcagttcagagtcagcttgagagggaggcaagagaaaccatcttctccacctttcccctcctagggcagttatctgagagaagagccggcagaaggcatttagccttcagtctgtgaagtgttggtgctggacaaattatagcagaagctgggctgctacagagtaactagggttggcaatagcttgcttgttgatggccactttcttaggcaagtccagacacagtatatagcggcttcaggtgggactagaacatccctgcagcaccatctgcccaggcttgctcggtgaagagccctgagccctaagccctaaatcctaaggtggtgtcagtttagcttaaaggaaggtggtcttcttggagaaatgtgccaagcttgagagcgtcctaaacatcatggcaaaatatgaggcaaaagggtaaactgacgaggattgttaacaccaacattactaataatgcgtgcttatattacttaatgtttctatttgctagatatcaagccttaacactgactactttaaattcagtgtttcattgaatcccctcagcaactttatgagttaagtattattactattcctattttcagagaagataactgacaaaaagagagtaagaagtttgcctaaagttacagttattaaacatttagaattggtttcacacacagctcagtccgactcagaatcccatactctttcccctaaactatgccacctgtaaacaaacacaggcaaggccagtgagaaatcagaaaccaagttgcttattatttcatggtgttgctgtgtgttgtgggaattacaaatgactctaaaatattgtttctaccctccaggagcctagaatgtcaatccgtgatctttctcatcaattctgtttatgttttatttatccccatatgaaagctaaacagtaaaatttattctgtatccaactgaagggcatgtttttaaatttctaaaaccccaaatatgtcaaatgttagtaaacactgctagactgagaacagtgaaaataacttttaaatacttgttcgatgccattgcttataacttgtaagaccaacatagaaatttatctgtagtttatcagtgaaagttgatagaccaggattttatcagctaagaaaggagggatatgccagggcctatggaattttaggaaaaagggaagcctttaattgggtgaggaaaagtagaaattgagttataacctcttccatgggtcgtttattagcacatggtcattaacatctatccccaggttcctaagcaggaagcaggaaaagcaacaaaccagagaaagtcctgagccccctttgaactttatagaaaggcactttataaatcctaggaaaatgaatttatgttataatttgtctagagtgactctgagttaaaactcttttgaaggtagggcctgtttgatacaccatatagaaagtcacctctctccctgccccccagacagtgtagcccatcctgtgttgacttgtcctctattgaccatgattttttttttttggcattctttcctgtggatctagattaaaagtattaagaaatacaccttaaagagaaagagcctattcaataggaggcctagagggcaggaaagaagaatttagccctttgtcatgaagtggaatgagtggtcctccctgagtgttgattaaacaagattataatcagccatgtatggttgcgacttaattggcaggcagatctgcttgctgtgcagagcagtatatttgtatgtgctcatttttttaaatgtgttccaaacccttatagttgagttgattttttttttttgcaataatgatatgctttcagtagcgtgtcattttctttacccttgtagagagataacatgcaattagggagtgatgtcagcctgtaacattttggtgtaaaattttggtcacaccaaaatactgggctccttaacaaagctggcagacacatcttttggcagcagctgctcgccatgtgatttaaaacttcctgtcactataattgatgtgtttttattctttccatttcctgaagcctgatcagaattaaaattgctgttggaatttcctgtcaaagcaactcatttattctctgagctctgcactttgattggacattgccttcagcaatagtcaggtggagattgctgggaattattctctccacacaggttagatggccacgcacggcacatctgcaaatctacacagattgtccatcatgtggtaaacttgtcctaatggaaactccacatgccaaatgttaatgatttgaatatcaaacttggccacctgctggggcctctgggttttgtgttaatttaggaaatcccgtagagttttcagccaattgtctcaccattgaatttagattgttgttccaaggttcactagtgaagcatctcagaacaagactctgatctgtccctggtttagataacatgactaaaaatgtttaatttttaagcccatttctccatcccttctgttcccccatatgctatttacatataacatcttggggtgattgggggtataagggatgaatggttctgaaatatgccctagtagatacttgctcacagatgtgtggccaagacaactacaaaaattcagacgtgggtaaaatagtaggcagtggaaagatctaaattctacctcgttttatttttatatctgaaagtaaatccataaaattacttctttatgcaaaggaaagaatcactaactttcctcagtgtatccactgcacagaggatttatttatttactttttgattgtgagttcatcttctttacaaatgactgttttccagttgaggcaggtgaaagaaacgctttcatgagcttaaagaagaggttgattaagtttaatgccctggacaataaggactatctttacttatcctggtgattagactcgaagatttcattatggaaatgggaatctctttttttaaaaatacaacaacctatcctataaaccacaacacaaagacgtttttaaaaataatactttattgaaaactcaatctggcatttaaaatgcttttgttttgtcaccaagtaaaggtaggctttttgattttttttccaagtacttgtaaaatattgtttttaatatttcaaaaatgtgaaatccacaagtctcagaccttgttttgagactttgcttacccccaccacctaggacagtgccttacaaattgtagatactcaattgatatttattaagtgaatgaaggaagccctgtagaattgtaaaatgtcaaagcaatggggaagggaccatgttacatctggagacagagcttccaagcatagtaatcttgctctgcataaggatttctgaccctgcttatatgtcagaatcaccagaggggctttaaaaaacaaccacaaacaaactggtgccgggatgcctccatgggccatgaaatctgaatcttctgttggtcactcttgggctgaaatgatgttcaagtcagaggtcagcgtttccccatactgggcacccttgagattgaatcccaggcacattccactccagatggccaggtctgatgtgttggttccaccaagtcagaatcatcctggacattttttatatattagcttgagtcaatgactccttgaaaaatggagatggagaacagcagttggtggagagagtgaaccactccttcaggcacgttgtgagctgaactaatttaaaatcacaggtaaggataatgctacatgtggagtgtgttagaaaccaccactttcattcaatgtttctagcatgttaggatatttaaagcacggaggggaagaaaaattacatcactagatttttttctgatcttaaagtaagttttgaatatttaattcttttctatgaatattctccaggaacttctaccattgttatctgacttctattctacctctgtatgtatctcttttgccttcttattccccaaagcctctgattttagagcagcttgcagaaatagtggtgaataatgtgcttattatcatgtaggtgctcgcctgtattttgtatgcaaggaggtatctgttccatgggacacatgagtttgccctgacgatgacccagaaagggtctgcatgtgtatttctgctgccttttccggccacagcttggggagcttgtctgtagagggcgtccgaggctccatggatagtgaggtccatcctactgcattttcaacactgctccatagcctgtgctcagcatgccactggaaaggaatcctagctgtattctcttcaaatttcccttcccctttaattcttacttccttcttgtgacattctgctattctttgccacaaaccattgcaaaacaacccatacaagagtttttgcctcctccttggctagggtagaaggctctttggaaaccacaaagccacatctccagggaacagtagctttattaatataataatcaccaccatcatggcctggatacaatatacacattactttagaaagaaaaataaggactatctggggtttgctggagaagctgcacttgaggttagatgtgtatagttaaatttggagtcaagctgaggtcattgctaaggagatttggagttggaaatccatgtggaaaatggttgccccatggaagttatcctctcaccattaaaactcattttgaataatatcagttagggaaaatacgagggtttgatcctgtaagacttgggcttttcttgatgccctggtttacttggaaaataagttgtatggtatataatctttgccatccatcctctctttctcaaaaaaatcctagcacaaatggaataaaaaagttttattaagaagaatcataccatgtatgtttcatgagattttcattctaaataacatataaggaatgagttgcacaataccaaatattttagactgtgttccttctaaataagttgagtgtatttaatgaaagattttctccaattgaaatggaataagaagaaaatattaaaaggtcctttaatttcttatttggttgtttcttggatatagaggaggaagaaaaaataaagtgtggcaaaacaaacaaacatggcatcctcctttttaagcaatcatgtcagcttggatggaaataacaaaggatcccaactaagtgtgccagagcctccggcaaaggcagactgctgacatggcagctgtatgtttccagctgattttaggcctagataactatccctttcagcttaaatgatgctctacagtcattgactagtgcccagttaggttggagcacagttcttttggaacctgttcagaccaacttggactgcctgtgagatctgggccaagatcagactggtttcctggagcctgaggcatagtacaggctgtagtaaaagggacagagttctctgcatgtgtagtagaatgtatcattgcatctgtttgctacctttactttttaagaataatcacaaatgagtgagagctacactgtattcttcagactgaagcagggtgtacaccaaatatcttttccaataatctgtaaattcaacaggttatttttcttttctgttttaaaaatagcttgtacttatccccctcctctccaacccaagtgtggctcttgaactattttcaatatattgcctttttaggatcccaaattctccttttaatgtgaaacttgctttaattgaccaaaaatgccattttcaaaatgttcaattctctgcaaaagcattgcttactgacagtgcttattgatgaaggctgtggaatctaaaggatgtcaacagatgaatgaagcctagtatggtgagatgagggctgccatctgcttaagggttggccaaacacctggataatttaggctaaaagaccagccatttcttcattctgaatacataacagaaatcactgctttttaggtttggcctcaatcaacaacaagaactgatttccctggtgatgctgaacaaatgtttaagagagtaagatctgaaactgattctccaactttagtgggccagtgcataaaatgatccaggttttctgaatgcacatgagctgccagatgggttgtttagtataagcagtgcaatctttgtttctttagctgctgtctgcaaatattggtatttaagggcggctctaaagtgaccaaagaaagtttgtgaaattcaagaggctgtctttttcctttcccaaaaaataattgtttttggtatatgagcccaggagataattgcatgctgacttcttgttctccagtggcgtgttttttcctgctattgagcagaactgaaatagttagcatgtagaaaaatacatggaatattaaactaaaatatgtctgtctagggatccatttagttgcctccaatagctcctttctttgtgaatgccattatgtttatatatatttaaatgccccctttgctacactggttttagcttcttgttagcatcacttcttgttagcatgatgttctacagcacaaggcagctgaagaagtgaaacatgtgttgaagaatttatgcagtgtcctcagattctttcattaagagaagcaagaataataggtgcatattataagcttgctgtgttaagcaatatgttattgctatgcttgacagacatcttgtttacattcatgttatatattggggaaaccattgcattttaagaacatggcatttttttatagtattatttatactgtgcctcatatgcatgggaaacgtagtcgtctaaaaacatgatatgttttaaatccacttgtctcctcctcctaatgaaatattccaagtgctttccccccagcgtagggagttcaacgtgttctttattcaggccattctaattactgccagccacattccctcaatttattaaaacaatggcccagcttatttcagtttagtttaattcatgtgtgaaaactttacccccatcttattccatggagaacagtatgaaagctatctttctagttggtccagtgtttttgtttttagaaaagcaccggctgtttccaggctgactcaggaacatcattaatttagttgagccttgtgcaattgttaatgggcatgagatagcctagtggtgcagcctcatctggagtgcaaaatattacagtactccatggccaaatcttggtagcaagtattttttgctatctttaccctcactaaggagaaacgtgaagtgtgaggcaatttagtatagttagtattttagtagtaagtaccgtatattgaaggtgggaaataagaacatatttaccttctcctagtttttacatcttttgcacactgaaatcaaactgtgcttctccaaagtgttttgtgccattttacccaaatgcttccaacttatttagggaagtgttcattttaagagtgtggcaccttgtattttctgaagcatccttttctacctccaacagggagcagcaaggctagtcacagctagttctagctggacagtaatccatgccaaggactggaacccagaagaagtaaaagtgaagaaaataagtggagctggattaaaagatagacccacacacaaagaggcagacaggagacttaatgtttgcaatgtttcagcttgtgggaaaaccaactgtcatgtgaatattctgcaaagaacagaaatgatatcattttattagcaccacaattcatagtttattgaatgcttccattttccaggccttgctaagtggatcctttatttaaatttatccttataacaactctgtggggaaagttcaatcattcctctttgataggtaaggaaactgaggcttacagaggttgtggagctgtgtgagggtacaaccaataattagtagaagcagaatttgaatctctgtttgactccaaagaatgagaatgtgcatcattggtagggtgtacttagttgaatgctagaaagcagtggatgctgctgtgagataacttggcttagagcagaaagcaactcccaaagagagcctagagacaggtgggtggagaggagcagcagtatcctgagaatgtgttgacagtttggcaacattttatggctagatcaaaagatttctagtccagttttgccttatttttctggaggcataggtactaggcagctgataagtgggcttggttagccctttattttagggtatatggagaagtttagactgccctaaatctggcaactgcattatggtgcaagggcatcacatcacagaatccacatgacattacttccagagtactgttaccaaggacctggaccctagccagacctcaggcccttgatcctcagttcctctttccctgctcatctgtgtaagatggaggcagctgactcccagagcaactgctggatgggctgatggacagaaggagatgcaccctagtaagccataagtgatatgctttgcctagctaattctgcaaaagagaagtgacagatactcagcattgagaaattggtcagattatttataacaaaatgggaggagactggagactgggagatgaagagacacattttcagccaatggcagatgcaggacatcacagaacattctcttaggatttgcatgttggttagtattggggagattttacatatatatgtaaaaatacatatgtatgtatacatatgtgtgtatgtatatatatatatacacatatacacatgcacacatacacacaaagatatatatatacagacatcccaataataagctttctgtaaatagcagaagggaatgtgatcttgaattcttggaaaactttttccttgacatccaatatctctgaaaagaattgtcagttaaagtgtatgttctaaaaacttttagctccttctttggactatctgcctgccacttgattgtttactctctgacccactggcatgatatttctatattgattttcccaacattccttttgtcacatctctgttcaaagtttcagaatgctgaagttgcctatgcaaaaagtcaaaatgccttatcactgaaatcagtacttttcacaagctaatttcagcctgcatttccaggttcatttctacagtttccctgtgtaagttctctagtttaagcaagtgggtcaatttattgtttctgacccttatttaaagtgttgttttcacttacaatgcctccactgttttctttacctgttggaatgccaattggaagccaaattgatggcctagaattataaaccatgacaggcaacagacaaggtgcattttggcttggaaagtaattgaggtcataaatagcagtagtttcagagtggatgaagtaaagaggttcccatgttgcgtgtgcagaaacactaaggcaagccttggtccactgggtcagtgacatcggaatggaataggtcagtaccctggatagctcccaggaatacaaaactcgagtgctgacaaggttctatacttggagttgtagacctactcagctgcagactcatattttctgcacccctttttcttaaaaaggccactgtcatttttcctctaagtttagcaactagagattctaagactcatgctaatattgcccttcttctttcctgacctatgtctcaaactcacgtggggtccctgattatgctgaagggtttatcctccattttattgcatgagatgttcgccagggggtttgtctttcttcgggtagggatagggactggacttctactaacgccccattgtgtctgggcttttttttttttcatagatggcatttcattatcctgtcaacactgtgagcagattaaaattttgcccatccttcaagattaagtcccactctcacctttgctttgatctctccactgatcagcccaatataaaagtagctctctctcatcttaactagaacactttgtagtctttatagtcattcatttcaatattaatgatatactgttctttataagctatctttttatctctctgtgttatagctctccaattggcttggatgcttcttggggacatgcttcttagcaacagggcttcccaacggtaaggacccagtgaggatgcactgcagattattgcatgaactatattttttctgggaaagacagagagaacagtttcaagttttctgatagacatgttcagtcagtagcccttttcaattatatgtaaaatatatttcttgaagtttctattatttctggaagccttctccttgttgtggtgtaatgaatatagcatggactgttgtgagccaaagagacctgggtttgcattcttatttcaccacttataactgtgaccttgggcaagttacttaatccccttgagctacggtttctgcatctaggagtatggaaacagaattcactgcatatgatattcgtaaaaagtaaatgagatattgaatgtaaagggtctcaatcacttgtcacagagtgagaggcttaattcttattgatgccttttcctttttttatacatctgtggctcttgctttttaatcaaacttttctgagggtctttaaaacaccacctttacgtattttccaccatgtgctcacagtgagtccttgatctcggtgaaggacttatctttcacttccatttattcctagaattagccttaatttttttttcattaaaagattgagacttagttgctttatttgttattcaaaaaacagacctttaagctgtatgcttatatttactggggtgggagaatttgtctttgaggaaatcagggtggagtacatttgctcttgcttcttttatttatagaaagccccattatcaagcaacctgaaaaactacagtctactatagctccaagaaaattaaatgcttgtgacaaacagaggtctcaggacacacattgggcagcccagtcttcattgcttgcaagtggctgattctcagagactgtgaaggaaaagtcttagaataaatctgaatatttatgaaagaaaaccaaagcattttagctgggcttccatctctttaaacaataccagtcacagaaatgtggtttcatagtcatttaaaatacagtttacagaggaattaagctaaaccacttaagctctccaagcagctgtgctttctcagcttccttaccgagagctgcttgcagaacatccgctttgaaatcggcagctcagtcaaaaacagagctgttgatctctgagctacttgctttttcttgtcccacacttctcaggtaatgcaaaacagtggaaaaatatttggatacgagcatatatccttgccccgctttttcatgtttgaagcagccttactctcatgagtgtaagtgagcacctgaaaatgagttaaggtcacacagtgtgtgctttcataagccaccatataattgccagaatgaccgtttatattttgggggaaactttaggacttctgtcttcccggagaataatctggcacttaaagctgtgtacagtcagcctaacctcctctcacttgcacatgggagcccttggactcagcccgttggtctcttcactcttcactatggtcaaatcacattcctgtccctgtgcctgtggtcttgctcttccctactcttccagtgacattccctctgctgtttaactagccccaaccccacccattccactgctgaaagcccaagactcatctcctcacaaatagttcctacagcctcttcagttcagtttcccgtcctcattctctgccttttaccaggactgtatcggttcatttggtccttgttctcaagtagaccacagggcagtctacttgagaatgaatgtctcaatcaactgttttttttttttttggtctcagaatatatatatatattcaacattcaataaatattgtttaacagaattatcagttacatggaaaagtagaaaagcattgtcaaattgagttctattttttgaaaacaaaatatgagtagcaagaaataaatagaatgaaaacaatacttgcaaattatgtaagtaaattcaaccaaatgtgacagatggaaatttttataattgttaactatgttttatttactttttataacatattttaactaatacaaaatagtgtttaggtgttggcaaatttagttaagcagtcatgggtatcttatttaaggaagaagatcatgaaatgctctttttaaccttgttaaacaaccacgggaggagatggagactacccgtgcaaggagactgcacttatagagtttaataaaaatgtatctatcataaacttagtttctaaaacaataaaatatttgtttatagaaccctatcatggagctctctagttttgcaaatgagctatttttccacatttcattctataagcaagcatttgacacctaaatagcgagctgtagatttaacatctattgtgttataccctaaatatcaaagatttaaaaaaacactggtaggcactattgatgagaccatgaaaagagttttgaggaaaataatgcagccttttgtaccagaaaacagtaataataaaaaaagtgaatgactcatgatgctcataatacaccaaatggctaaatattactggttgaacaactcttcaactctgatttcctgagcatttttctagctaatctgtaggatttagcattcagtcgtctggcctctctgggtggggcgaggggtgggggttcatccatagccaaatgcaggagagcctccttgattgctcactagcagcccaggaatctaggactcctggtgattttccccagcggttggtttagaaagtgtgcaggcttagatacatggagagcagagtgctcggcagggcatccccagtggagcagcactggaaagctggcatcaccacattatcatatccagagtcatagtaaaatgtaccttgttaaatgtgatcttggcctgtaaagaaacaaaagactacttttaagacaaaacataaactgcattacaagccagggagtagggttgatgggaggactatgggacggcagtggggggaaattagagagttgggcacagctctcccagacagtgtctgaagaaaaaagactgtgtttgttcctggaacagaccaaaaagggaggatgtgaagactgatgaaataccaaagagagacttgggataaagacagttctaattgaaagggaaagaatggcaggacaaaagttcatggggaggagaaagaggagctcagtaatgagacagcagaaaaaaaaaaaaaaacccagctgaaaactctggagaaacttggagggtgggaggggggtggggggggggggcggggcgggaagggaaaatacaacttggatatttttcgaactctagcagcaacaaggatgtttcctaaccacatctttggctgtgagaaccttgttgttggaaattacatgtaaaacaaaaatgtgtccagattccattttgtatctattcatttttaaacctgtgtttattgggcatcttctgtgtgactacattgcactacagccggggtttcagggggcatggcttgggcatgctcacactctgctgtcctggaatgtgaaggaattggatcctgggccatgaaaggaaaagaggaaggaggaagagaaggacctggcagaaggaatgagggtgaagctggagtgacttttataaaatataaataaatcgcatcacccccttgcttaaaacccttccgtggtatctggtgctctttttttaaggaaaaattgtattattttaattatttttatgtacagaaaactcaacagtgtacatttaagccactttggtgtgacaagttctttaacctttgcctcttcgagcttggcagtgcgagccacagacttgggacccagcatctggttgctcttgagatcagtccaaactccttgctaggtgctttgagacctgcgttacctggactgagcctcgttctccatcctgtttcatctgtctttctctctctttctcagatggtcattttggggttgcgcttgattcaagtgcacttcagaggtggtcctgggtcagaagactggctgcagagctggccccactgttaggccactgcaagaatctccttgcctcttttccttgcattgtccccaccttgtcacccctatagggatgctgtaaggatgaaggctttgctcttgctttgtttgacctatctgaattggaggactcagaattcttctttctcctttcatttccactcaatattgagtccctcctaaggcctgtgaattatttcttcatatttcttggatcctgtacctttcatgtcattcccagagctaaaaccctaactctagccattattacatcacacctgaaataatacagcttcctaaatgctacccccatctgttcctcctcccacccagattaactggcattcaggacttctgtgtccaggagccagatgttttgtattttctgttatattatctgacagccctagcccttcatccatgcatgtataatccatgtaaagtggacacttatccctggaagtggtaagtcttgagctgggctctgaggcatggattaaggtttagagaggctgaagggcaggacagggcctcctgggcattagcaagggtttggaggcaggtgtgctggggccagtaagtagagcagagagtaatgggaaatcaggttgcattgggctttggctgccttgtcaaggcattagaagaataggaatcagtacaagaattatggacatttataggttacagactgggttcaagtcctattgctgtcacttattagttacatgaactttgaaagtactcagatttctcacctgttaaagaggcaatagcacccctcacagggttgttttgaaaatgaaatcagatcatacatacatgtagctcacagttgctcatgactagcatgtagtagaggttggccgtcgtaatattggccatcatcatctttatcatcatgacctttgtcatgatcattatttttttggataatggtgaatattaaagatttggaattttttaaaaacgagaggtgagaaaggatagcatggtaaaagctatgctttgagggtgtcacatttttaggaggttagcttggaagagttctgaagaggcattctcactcaagtgtggggatagctgggctactctgccaacagctatgatgatgtttccagacacagtataaaaaaatagaccaacaaggcttgataatccacaattgtcaaaaattagaacagagcaggagtcttgaagccagggaaacttcacagttttggaggttcgaacttgtcagtgaccaaagtgaagtgatctgaagccaggaggtaagtcatgatggcgaggagaagtccagtccagaggaggaaggcattcagattctgagaatgaggcagattattggagtggggccggtggagagaccccacagaggtgacacaggtgacactgaggcagtggtggtatgtacttctctgcttcagttaagggtcaaaaaaggctgaccagaggtgagaagaaggaaagcaaggagggaaggaacaatatcaagcactcctcctgagaagtggctgattggaaatgtgcccatgaaggacacagaggcccaagcttacatttaggaaatagttgaaacactagggaagcaggaaataacacactctaaggcagtgattctcaaatttgagcatgcatcccaatcacctggggggcttgttcaaaccaggttgcagggcctcatcttttgaccttctggttcagcaggtctgaagtcaggtctgtgagttgcacgtgtggtgaggtcccaggtcagcacctgctgctgctggtctaaggatctcatcttgagaaccactactttaaagggggctatcctaccaataagataaattagaaaaatgtgtatagctagtgtttcaaggtcactgcaactagttacagattatctgtaagaagacttcagagatgataaagcatgccctaatctgcaggatgaattcccaagcactcaaatttgtgaacaggtaatccaaactttttaaggctgcttgtttagcactcactcatcacttgaacatcattttttttttcttttttgagaaagaatcttgctctgttgcctgggctggagtgcagtggtgtgatctcagctcactgcaacctccacctcccaggttcaagtgatcctccttcctcagtctcctgagtagctgggactacaggcatgtgccaccacacccggctaatttttgtattattagtagagagggggtttcaccatgttggccaggctggtctcaaaatcctgacctcaggtgatccacccgctttggcctcccaaagtgctgggattacaggcttgagccatcatgcctggcccacttgaacatcttgatgctaagaaaggagaggaaaggcagttctggagtgaaggagtttatctggcttgttctgttctccgtggtatgaggacatttgcctttgatacgtttaatctctcttgttcagggtgtgcagtgcatgtggctcaggttgaagagctggtctttcccactccttgatttgcagggacatagagtgaataattaataatgagaaatcatgttctgatcatgtgcaggttctcctgccagaagaatgcccattgaggcacctctctagcagtagagaaggaaccgttctagccagacatgcaggcttgccccctctttgaccaacatgccaggcagctttggaggcgggaggaggaaaggcaatctgtttgtgtccattgtctagagtctcattagcaccagccctggtcaaggactaataacccacacttttgtccttcctctgcctttgtctgaatcagcttctaaacagtgggaggaccacctcaaaggcaggagattggtgggctacagaccaagatggacttcctgtatcttagtattgtggcagtggattggtttcatgcatccttggaaatagttactcccccatgctcccaaaatgagaaccaacttttgcaagttggctaaaaaaaagaaagaaagcaagctagttaaatccctttgattaatgctctaccactattggcaaaaatagtctgttaatatttttatgtagacttttcctttggcttgtttgcttaaggtgagctagtgtctctttcattacttgcacctctggttaggagccagagcctagttcatggttctatcctgggtgggaaaaaacagatgttaatgtgtttgcatcttcatattcatatagaaatattattttttagttctcttgaaatttcataaactgatccttgctaagtaaagtggtcctgatctaaaaatagaacagagctcttgagcggaggtgggggcatggtgccacacatatgaaagagagctggacatggtaatatggtttggctgtgtccccacccagatctcactgtgaattgtagctcccataaaccccaggtgccatggatgggaccctgttggaggtaattgaatcacgggggcaggttttcccatgctgttctcgtgatagtgaataagtctcacaagaactgatggttttataaagggcagttcccctgtatgcactctcttgcctgctgccacataagacatgcctttgctcttcctttgccttcttccatgattatgaggcctcctagccaagtggaactgtgagtccattaaacctcttacctagtctcaggtatatctttattaacagcatgagaaaggactaatacacatgggtaacacatagaattagggaaatggcatccttgccagtcttttggattatgagtctgatttttagtctctattcactaataatgctatgggtttaataattcagttgtctgtagttgtgcttcctaatctttttgcattaatatcagagtatttgcatggaacactgggataaatgaaggaggtagccccatcctcatcccagggctgaggatatcagttgcttacaacacacttgtgaccccttagtggcacaccaggtgagaagctctgatcttgggcagaattgtgcatttgatctgtttgcaagccttttagctttgacctgtttcatggccagagctatacattcacccaggcagggactgggttgataggtttattggaagtaccaggcaagaaggcctgaatggggcaccagacctgttactcctggaaaaacaattcaaagcacatttcatctatgacatcatgaatcatattactattttcattttctttactcactaggaagctttaagccacttccagtagctgaataggatggggctgctttcttgtccatggctctaatatttcccctcattagaacattcctgattatttactgtatccttttgtattatggttatttttataggccacttgaaatcctttctgcgggttgtggattatggaagagagcaaataatttaaaaagaaagctcaaaatacacttcttacccatattgggtcagtcatgtctttttttgatgcagacaaaatattttcaccctttaataaaattggtaactgaatatggtattagtcataatatgaaataatgttcctttttaaatgtgatgatcatcctgctttatttccccatctgcaagatgagaataataattatccctttgaaaatatcatatggtcaaattagttaatgttggacaagcatttcaaaatgaaactacctaataatttattagtggctccactggtgtgcaatttgagaatgaagtctgcgtttgaggaattggcatttgcattaattcatgttttcccttaaattcattacagaggtctagtctgaattctcccggctgggtgccagctgtgcccatctgtggcacatggtctcgtggccttttcctccagaagtcttgtttgagtaatcagaagtcatgtcctaaaagggaaactgagcaaatgaaattgctcatgtacttctcttaaatggaatcacttgtttgctttttaattaagatgagacttttgattaaagcaaaaatctggtggcattttattttctactctgtgcccctcgagatccattgcttgaccctgaaatgaatgatctcagttatatcttaaatgacatagtgaattaactgtatttcatgtgccagcatttccttcatgttacttagataattaagttcttcctaattcagaaagcgtgacatttttgtatggtcacaaagacagccaaggaggacaaacacataataacgaactatagtaatagctatcattcattgagcacttttgttccagaagctttgtgcattattatctccagtacaaccctgaaaagtatttacagatcaggagcctgagatcagaaagatttgactaacacgaacaaagtcacatagctaaagagatgggttgctgggatttgaacttacatctatctccagagctttgatttttctgtttaatttgtattttataaacccaaatcattgaagcatatttatgttttatttctatacacttcaggtaaagctatttttttaaacaatttattgaataccaagaagagttatgtcctgatggagtggggtcagattaaatgattctcctgttcacttggagctataaaactatataaatctatatgtgtgagaaactctcactgtatttaatgtgtttttttcagtgctactgtctacaggactctggcaaattgctgtcaaataaaagtcataaattcacagaatgcaattcctcgttgtcaatgaaatgaaatgagaaaatttctcttttcactcaaatgggctatacatttatacgatctaaattcccatattaacaaaaaaaattttagttgtttgctttccagttaggttaggatatttcttctgtttaagttgggatgtgccaataaatagggtttcccattgcagctcacaggcagagaaagtgaaactgcgcttggtagtcttttcatccgtatctgttcaacaacaacaaagtgatctccccaacctgaaaagagattgatttgccttcaagtaaatacctagttatcagtactcttagaatctgttgacttttgaagctttgagatttgatttttctctaagaatatatgcccagcactataccattctgtctgaactgcttaacaaagaacatctagaagtcatactggtgcccatatttaaaatatttatttaaaagaaactagccacagatggaaatatttctaactaaaaattatctttctcaagtataaaaacatttctcaaaatgaaatatttcccatataaagtcacttcattgtgggcttagagaactttattttccattgccaataaaagcctttgattggcgagcttttcttcgccttaaatttgaaactggagtatgtaagcagagtgtggatctgagtggaaaaactggcctaaattatgtgagtttcagaaatatcactccatgtttatttgaacagtttcctctaaaggggaaaattttgtttaatatttgaatatgtttatttataaaaacgatagaataatcagtagacatttgtgttctattagatctgagttgttctccattttctttttgtgttttccatataagggccgaattttcatatatcttatgacagagtacttacctgaccattgagaaatagctacgatttcacatctgacctttattatgtgaccattcattgtttttttgacatacgcagccttccctcggacatttccctgtctcttaaacccagttttgccgctttgtcctgtcttggattccgcacgctgcacaaaaaatggccagtagagggcgctgctggcttactttttagaaaactgctcacagcctgatttcagcactttcaaaaacatggaaattatcttaattcagtcaaagcaatcagaacgagaaaactgtcttaaattcatcaaagttgtttctttgtgtctttttctatttcgtttccccaaaggcatcaataaaaccaggcaattagtgtttcttcccttttctgcggagcccttagctgacccacagtaaggatgagtatggtagttgagggcaaccgggtgtgattatctaatttttccatcagcttgaggttcttatgtgaaagttgtattcatggagagccaaaagaaggggaaaataaaagcctgtttacactttcactttccaaccggccttgccagttatcccctgacctggtgcaatgacgagaaaatatctgtgcgaccttggcctctggattgtggactggggacggggtgtccgtggcttcggtagcgagaagcgggtgggaggggcatgattttatagactcaaaagctttctctcctttcaggcaggcagtgctgagaggtgatcggaggaagaccttttatatcccttccagcacctccattctttgagatgaactattgacagtccctcaatatttataaaatattataaactgctatgtaaatacagcgtcaagtcgaactttctagccagagctctcccgagtacccttccaaagaaaatgctatgcttaagcacctcctcctgagacattctggaacccccaccacttatataggtatatttacagaaccccatccccaatcccttcagtcattcaaaaacggtacaagttgctgaagacgttgtggtgaaatagaaagtatcaaaaataccacgggaattgcatttgctagtcatctttgtgatggcgtcagtttgtgccaacagcatcgtgataaagttctcagtggatctgaactttgcttcatgtggtttttcttcaccttgtgggcactgggcactcgccgtccttcatagctggtaggtgccacttttggccggccctgtagctggctgcagtcggctgtccttccacaggatgaaaaatgtcttccattagctaatggctgtgttctccgtgaaacattctgccccttggcctggggctgcaggagagcatcaatcaagtctcttagatgaggcctcagaggaccaagggaaatttgtataatcctgaactgtaaacatgaggaccagtggttgaggtttttggatttgaacaacatttaaaaatgtctatttgagtatctaaagtaaacctttattttaaagagaagctgaggcttgctgggtggccttcaggaggtcagctgacctttctgcctccgtttccctgtcttcaaattggtggagggagcaaaaaaccttactcttctgttgcacaggagaatccatttaatcttgattgattacattaaataaggaagtcaggctttctttatgccacttcacaccttatgggccacattataatttccctgcctctcggtctaagtgtccactagtgatcactgcctggtgtggttttttgttggtgttgttgttcctgtgggtctgtagttttcctttcagccatttcctttctcttgttcttctcctccccacttgctaaccaaggaagaagggctaaggggctccccacccttcctggcggtggcaaaacagcttcttgttcatgagggaaattgtggaagcatagatgtaaaaaggagagaagtatgtgggtgtgtctgtgtgtgcacacatgtgcatgtgtgggtgtgcatgtgtgtgccatttagcagttgcctttttttgtgatggtttgttgctgttggcacctgtaaaagcagtcaagctgaagaaattcctttggaaaaagaaagaactaacttcctagaggtgaatggaaggttgctgaggccttaaggcgaaaatttatagagagctgagttttctctgttttcctttgcattgcttatttgaaattcttcattgttagaacacagttttgtttaccatgccccccattattttcccttaaacaataccataaatattatcatttggggaacaacctcaatttcccagaattcatgacttttccattttaatagacaatgtatcagaacttaaatcttgtgagatcttcttaaaagagtacttctcaacagttttaggaactgttttttactctagcctttgaggacaagatgggagggacactgaagaagttgttccttttgtacagagtaggcaactcagaaatattatggaatgacagttgaatgacaacatgctgattgtttgctcagtaataaactagagttttgctgtgtatttttatatattcatataaggctatgcattcttgcaaattagcaattaattctactgaaatatctgaataatgttttccataggttacactatccccctcacaaaaataaaaaaaaactagacataatattttgttgctgaccctatgttacagacttagaggtttttccaaagactaggaagaaagttatttctgggttggctagctagaaatatgctatgctaattttatctctaaataccatatgatatccattctattttcataaatatagattaatttcacaaacagagttaatcacgtttgatgtttggtttcatgtttctaaataatttaaaaatcagcttcttttcatggccacttctaggtaaatatgtaaaacaaagtaaaagagaaaaagttatgacatcatatgagaaaagctgcaacaattcatagttttaattaagaggactagttggactctgggcaaacattttattgtccaccaactaagatgtcctctctgtgtgagctgtcacataccaaatctaaaaatctgtttttgatatttaaaacagctcaaaatcaacatgaaaattggcatgctcttctcatatataatttggggaaaaatatgaagtgagaacaggaaagatgtattaacttcttaaaaagtaatctttaggagcaaactgaaagagttcccagtggtcaaagctggaactacttgagcaatgaaatgaatagcgtattattggattattctcaaaagtagaaaatacatagccaggagtccataataaagtaaacgtaaatgatgtaataaataaatataaagagagaaaatagacaaatctcccatacagaaggatctcagataatttatgtaaattttgtatcttcaaggaggtgaagcatagctccccacacctgaagtgtggggttgtgcatagcaactcctttccaaggagcacaatatggaaagcgggggaaggagtaatcctatagtcgaggaactggacagacactgcttcagccaggcgatcaaagtcaacatcaacagcaatgaatcatgttagtagcatgtgcctttagaatgagatgaggagcatggcactttacttctgtagtcttcctcccccacacccacaaaccccgtctaatcatgagaaaaacatcacgcaaatttcactaacagaatatcagagaaaatacctgacctgttttcccaaaaattctcaaggttatcaaaaacaaggaatgtctagtggcacctaaggagacatgatgaataaatgcaatgtggtaccctggataagatcctggaacagaagaaggacattaggtaaaaattaagaattgtaagtaaagaatggattctagagtgtccgtattggttgagacaaatgatgcagtaacgtatgatgtgaacaatagggaaaactgggtgaggggtccatccaaaaggagactgtattgccttcgcaagttttctttacactaaaactattgtaaaattagaagttcatttaaaaaaataattcttattatcatatactgttcctacatctcagtgtcattattttcctaaatcttggttgatttttaagagatgactttaaattagacaaaagaaaacaggttctccaagatttgctatcatacacatttattattgtcataggtgccatttgcagcgctctgaataccatggttgcctttgcttataaatagacttataattttatcttacagaaggtgtttattaagaatccaaagtatgagaaagttcattccccatttttaggattgtcatgactatccttggaggaggattctctgagtaacttagtagtagatggccgctttcacattcagtcaagaattgtgtaattttcagttgatggtttagaaacaattaaatggtctccccctttctgtgcacattgctattaatgttacagctatgttcataaaaccaagattgttatagtctttatcgacatgacattgtattttcttgcattagtaaatccagtacttttaaaagaaagttaaatatatttcctttgaggtgaaaaaacgacttttccatccaaaaactggaactgttcataagatgtgtaaaatttaccctgcatattgataaacctatcaagattttgggggcttcattgtttcatgactataaagagtatgttattatgactatgaaagttcaaaaatattacagattcctaaatatgccatacatctagaggacaaggagacactttctgggagagcccttgtgtgaggcccaagccccaatttcaatccattattacctttgtattcatttcagaccaagtctagctctttccacagtttccatcttagtgttcaactacagtctgggacagacttttctgcctacagaaagaaacacatggtctgggcttcatcatcaaaactccttgtgtgatcttggggtctttgaggagccagtgggttcttcaattgttctcttgtctgcacacaccctggtcaccttccaaaatgaaatcccgggagtcaaatgtgcaccacatttatgagcgtgttgactgaccagtgactcatgagactatcacacaactcatgatgaatatgtcgttttcctctttaaaatgactgctgtgcaatatggttgtgagcagtgtgatcctacagtttccttttaacccagtaaatacttgctgtcttattctttgaaagaatagtttagtcattttgaaagaactgagtgagcaactgctttgtgcaattactgagtattgtatctagacttgagacaaaataatgtcctagtagattttacttcatcttttaaacacacacaagaatttaaattgttaactagaacacacttgaattttcccatgtttaatcattaaaaaggcaaaacttaatttcatcaagtgcaatcaaagaatttttcatagtagcaattaaaaaatatgaaactggaatttcaatgacacaaaattaaacagctgctgtgttatatttttaatcttcattcaaatcaaatggcaaatcgcatttttcttcaggatttttttttcttttcttttttaatattagtgtgtgtaaaggtggtttcagtaattcaaaaaccttctgaaacatgctgcggtatatttggaaacatatttcaaacgttactctagagtgagtaacccttgtatttctgtaggacacagaaggcaaaactctttggagaaggactgattggttagcttgctttggcatgagggaacttccaactatattgagctgtttaactaaggaaaccaaaacctattttgctcggtttgcctttctttctgtactccatgtgtggcatttaccataagagaaagtaaaaaccacacatgaagcttgtgtccttctcattccttcctatttccatgctgggggagaagggctatttttgtgatacccagacttccccacacttttatgtgtaagacaacgagctgggacatatgtagctgatatataattagccaaatggtatctttttcaccccagcacaaacacgttccctctgattttcctcattgacttttaggtttaggcactaaggaaaagcagcagcccccggtcaaaccaggactccaggttttgaaaaaactacttaaatacttttaaaaggtagaactatttaattatttgtcatttcaaagccttccagtccttcttagtttacctccatttttttttctaaaaatggaaattgagttctttggtcttgagcactcttagttctaaagacgtattttagctcattagttctcatcaaacttctctcctgaccctattctcagagcggatttttctaaagtcatatttgcatttttaattcaaattaaaattaatttcaattaaaatttgttttaattcagagttttaatttcttcagggaccttctgttttcatatcttttttcttgttgcacaggggattgttctgaggcttagctgttctcacaccagccaggactacacgtacagtgacttaagtggtaaatcagtctttgggtaaagacttcagctcaccattttctttaattataatttactggataataagggaattgctttggctagtagaatttatttgaccaggataaggtaggacaagaactctgacttattcaatgtgaaaacccaatgaccattaggacatagttaataaagcaatctgaaagagtcactgatagtaatttttttaaaaaatagagagaccccctacactgaccttgtaaatagtcttagtgcccaaaagaagtaaaatgttggaagaaagccagtgacaaagaacttgtatttcgcttattttgccatcgatgccttatgaggtttcttgtgaagcttaatgagacagtgtaaaccctgctttgtaaatgtaaggtactatccacacgcaaaatattattattattactaaattataggttgtgttacatggaggaatactgtactcaaacaatcatttttgtgggataacaacattttgtagcttatttgcaaaagttctctacacagttaaaacaatggtatgttgattggaaagcaatttaaactttcccataatatttgttcaacattcttttcattgctttaaacaagatgcacccattcagaaattatataacatcattgtacaaatggcatttgagtgaaagggaaggttataatgaagtattatctaccaatacatttttaaaaattcaggtcctgcataacaattacttactggaacttaataggcataatggctatcaggaagtgacaccaaggcatgggaagaattttgtatgttcttcatattgggcacctctttatagccgtattatttgccaaggaaaaacaagagagggtcattgctttgtactttggggccattattgagaacagttttccccattggagtgtgatgtcatcgacctattggaaagcatacatgggcactgaatggatgatttacagagcatctccccaagtttctttgcactgctgggtttatgaaatgaacatagtgattctgagatacaatcttctgtgttttgtatctcaaattgtcccattgctttggtagtcctgattaacatcttaatttctaaatgtgtgttccttccaatacaatagccactagacatatggtgctactgtgcatttgaaatgtggctagtccaacttgtgatgtactgtaagtactaaatacacactggattttgaagatagtgtgaaaagaatggaaaatatgtcaataatttttatatcggttatgtacggaaattatgttggattgttattagagtatattattaaggttactttcatcttttctttttgctttttgaatgtggcactagaaaattttaaattacatatgtggcttgcattgtatgtccatcggacagcagtgagctagatgggatatggcatttttctgcttctgatgagaatgcgaaatgtggaaacacattaggtcactcattagaacaattctgagtgttccttaaacttcagctaattttgatgggaggctgagaattagatcaagctctgtttatccaaaaacaaagatgtggaaagctagtacagcacagtggttcaacttggaatctgctgaagggggagtatctgtctgatcctgatttgtgaaagaaataccgtaaactgcatgggcaggaatggaggttacatctttgatctatcctagtcaaaagtgggctctctcctagagtctcttaggtgactattaggtggccttagccaaagcttttataatcacacagactcacccaaggacagccctctgatctctcaaggagaatgcaatacaacatagactttggcaactgaaaacctcaaacctaatccttggtgacttaaggtttctgttggtattcacagaaatgcctttggcttgtcaaaatacgagttgcaatatttgctttagtatctgctcaccatcccatcccttctctctaaactcgttcattaccattaggatattctgggtggctgggatggttcatgtaagtggggacaagacttgccaatatgttatcaatgtcttgagcttaaaagtacatgtttggatgttcaccagagtgaaaatttgtgtctaatcaccccctttccacctcccttttgatgaaaatcatcaaaatgtgagatgaaaggatctaatgggttgtctgaatgtttttcccagccctgttggaaatgattgaggcattggctcttcaacatttcctctgagaaagcaattccaaaggttggtgtcaacttacagcttagtaatggactaatacacattatcctgtatgcaactctaaattatagcctgccagctgtgattctggaagtttggaataggttccttcccgagattctaaacagaaatggctttgaatgttgcgggcatgagtctgtctaacccttctaaaggtggcataaacgctgtaacatttctattgatttttaacatccagctctctagaaaacagaaaatagccaaaatttgacaggcattttacaaaataatctgatccttcatagatgcagagtaagagctttgttcacaagtgacatttgtgcttaaacttggatcaaaccttccttgtttctttcttatgccagttttattatgtggagttgaattacattttactggatttaaaataatgctttaaacgttattttgtcttctttagtttttctttttatcatttaaatatctgtagcctcaaactcataaaaggagagtacaaacttctaataaagttccttaatatttaccctgatgcataaattaaagaaatccaaatttaaacaaggagccctgttgcatatatttagttgtcaaatataatgcccagggttggcaagggtgtgcattaagcagctccagaggagagtgctacaggagttaaaaatcatcttcatcttgctgaaaggcagcttggttttactgatcatcataagatttcaaacaatgtacatactgagcaattcaatttctgggaattgttcctgcaggaagtaattaagaatgacaggaaagatttaactagactgtaagaatgctcattgcagtattctttataatatcacaaagtaaaaaatctagaaatactattactggtagactagctatataaattaagatgcatttatactgtgaagtactatttagccattttaaatgacagcttataatatattttaagttaaaaaaagttacaaaataaatacattacaaaaatgtatgtgaatctgatttgatactgataaaatgatatctattttatacacatgcatagaaaagactgaaatggttacaaaaaatgattaatgttggttatttctgaatgttagaattataagggttttgttttttatttttagatgtatttattttttccctttgagaaggtacagtaactttggcttcatggacagttttccgaaactgttttcaaagacattaaaattttcctcatctctctatacgtggttagatgaataaaaggtacataaacttaaagtaaggataagacacaagtgagggatgtgaaggaaccacactgtgattcagactacctcctctacctgtctattaactgtcttaatagctacactgttgaccttgttcttttataatcataatgatccacctgccctctcctgagactctttttcaacatggacagcacttgtcgtccctcccatatcatattgtgtttaatttaatctttagcagatagatacagagtgtgtgttcaaactagttttttcatttgttaaggtgctttggaattgtaatccaaatttcgaacaaattatatactcaaaatatatgacaatacaatgaaatttttgtaaaaatattttaacaaactgacctcatgagcaaaaactgctgtagtttttaataattctgtttacagatgattttattccagtatgtgaatcttcccaagcaaagaggggaaaaaaagtgttcatttttaaaaatgacatcatggaagtccttaaagcatctaatacaagttaatgaactctgcaaccatttatactagccctaatatattatatatacgcacctggaaagtcatccaacagatacttacctgaacttcaaaaagttgtcagtctagtaggggaggtgaccgtccatacaatgagaggcagaacataacaatagtcagaagacaggcaaatctaagggctacgggagcgtcacaagggaaagggaagtgttagggatggggtgatagtagaggtggcatttgtgttaggacttaaggccattattggattaactgagaatattgaatatgaatagtggattagttaaaaatactatatagatgttaaatttattgagcttgataactgttctatgggttatggaagaatgtatccctttaattaggagatacacgaagaagtatggggatgggggagagagtgagaggatggctgagcaaatgataacatgaaacattaacaatagttgagtgtgggggtaaagggcatacagacactcttcatactatttttatttttgcaatctaaccgttagtttgaaatcatttcccagtaaaaagtcttttaaaatccagctctcagataagaggcaacagaggatagctgtccttattcactgccttctgaagaccagaactgatgccagctgcttttttatttcccccaaaatgtggttcacgctagttatttgttgacttcaccaaaccaccgcataatttcacacaacccaggatggagggtagcagcgtctgtttcacagaacccaaggcctgaaatagcaggagggctgtgttgtggtgtggcgtggaagcctgcgccctgccagccacacttggcctggtttcagcagtttgctatcagaccctacattatggaagaacagccagggcaaataaaatggagagtcagacttacaaaacaaagcttcctgcctcccaactagtactgccttgcttcctccttcaggatagcacccatttctgtagatatttcctggtagaaatgttgtgacttccctgacattgctgttaaattgtagttcctgcaaaaggaggccaagtcctcatttctggtgtccagataacctcctccaggtattttctcaatatggttcagacctaagttactttatttcctgtgccttttaaagacacctctattcaaaaaacacattttccagagtgctgtaagttttaaagaccccaagtgacaatgtgcctgaagaggaaatcagccccctgttagtgcaaggagctgagtggctgaagaagcccagactgtagtgggcttgggaactggctagagcctgttctctgcacgggctcccactgccacacaggctgcagggggagtatcagtgccccaccccactccccagattccaagggcgcacttaatgttcaccacgtgcagtgtttgtcacctgggcttcagtgttagtgccgccaggttccagcagtggctgttctctgttgccttttacctgagagctggcttttaaaagactttttactgggaaatgatttcaactggctaatacggccatgggcagttagtgagcttcactaagcctcagttttggcatccaccaaatggagataataatagtctccagctcctagagttgtgaggatgaaatgcaacagacaatgcatataaattatgaagcataagtggtggttcttgctgttttcttgtgcttgttaagagtattactatgtgagcctggcttctttcctttctccctcccttccgtccccaaacttaccggtattacacagttgatacaacagtgttcaagatactcctcgtttgaagataagagtcctgcaactgggtacgagtaaagtgtcctttggaaaactgtgatgtactcaacaaatgcataaagatgagcatgttttaattgtccaggcccacacaatgtggatgattttcatattctatcactagtattttctgctcttccatcctgcaatgccctaacctcccagggtgcccatgcctagaatatccctttccttcaccctgtatttattgaactcagtcctcaaaggctggctgagtgtcacctactgtgatctttgctcacaatgagagcagaagaaattgctcctggaactccctttacctaacactgtaatatgtaatactttttatgttttatgtaaccttattacataaaatgatatggttttgctttttatactcatctctcctacttgaatataagtttctggaggctaaagcttgtcatatttttcctagttccttcatagagcctggaaagtatgctgctcattaacaattgtgctggggttgtttgttgttgcttgtaaattttttgaaagcgtaaaagcatgcaggaaagtactcaaatcaggagtgtacaacttgatatttttgacatgaacataccatgaaaccagtcttcagatcaagattcagaatataaggagaaacccagaagtccatattcagtctctcctcccccaagggtaaccactacatcatagattagttatgccccttattaaattttctacaaatgtcatcatatggtacatatgcattcatggctaacatctttcatttcacattatgtttcagaagcattcatgctgttgtatgtagatgtggttcattcactaccatgactatgtagtatttcactgtgtgactatgccattatttatttatccattctgctgctgatagaccttgggaagtaactgttttgtgaactgaaatgaatactaacatctggctcttaagaaatatttcccaaggaaagggtgacagcacagaaggttagattcacgaatgctagagaagtagccctgatttctcactttttcaaagagcattgacagatggctccccatatcaagagccagcacaatctttcagaatcaggacagcccattttcccagaccatgtgatatttattctattctagcctggctggttgctaaattggtaaagatcagagagcttttgggcacagtggtgttcttagaattctgttttgctattaaatattggcctacaaatatatagctaaatgtgttttactaatgattggggtggcattaattgtaattacttgtcaatctaacttgttgctggtgtcttaatttccagcatatctgagaggtttttaaaggatttcactagcagtttggtaagtcatttgtcaataaatgatgaaaaggttgggctatttatatttcaatgttaccattttaatgggcaactgtctatgtactgtccaccgcagaaatgctttttcctcccttttcttgaggaaagtgtctaaggtggagggaggtctggttgctatggatatctgaaattttatgtttacaatttaagaggtaagctgaaacctcactatttggtctccacctgagtggcattcacatttagaaattacaagattgttattggctatctggagcttgaggatgtggctgagtcctggcagttaattaaaactaggctggttttcaatatcagaattattcagcctgttttggtaggatgtccgtaaagtcctcactaccttgcaatgtgtttttgatgtaaaaaaaatatttaaaaaggaaacataacagggtagcttgtcctcatttactggagaggttggttgctccataagcttttcagagtgggattctgcccccattgtttcttgtctgttagctctgtaggttctaggctacagtatttcagtgttcacaggacagctaattggagaacaaagccctggcattttcctggaaggaagattgcttcatgtgatgcttattgggaagatcgtagaaaaactggttaattcagagtattgctgcattaaatgtcaggtgaaatattttctaattattcttttattatcagtttaatcttttaaatatgtttttaagtatagaagtaactcatgaatactttttttttttttggagacagagtctcactttgtagcccaggctggagtgcagtggcgcaatctcggctcactgcaacttccattccacctcccagttcaagcaattctggtgtctcagccgcctgagtagctggaattacaggtttgcaccaccacacccagctaacttttgcattttttgtagagatggggtttcgccatgttggccaggctggtctcaaactcctggcctcaagtgatccacccactcggcctctcaaagtgctgggattacaggcgtgagccactgcgcccggcctatgactacatttttaacttaaaagaatctaataatactgataaagagaaaattccacttgacttattttcatcagttctagtttgttccacatagatattcctttcatcagactagtttgtattgttctagttcagaggtcagcaagttctaacccaaaggccaatccagctccctacctgtttttgtaaataaagttttgttgaaacacagccacgcccatttatttacatattgtccctggctgctgtcacactgcaacagctcagctgtgtagccgcaatacagaccacatggcccccaaagcctgaaatgtttactgactagcgctttacagaaaaattttgttgatctctgttctagatcattttcgtttgcattttttatatttaaattaatatacagctaaatgttattttactattgattgtggtggcgttaatcataatgacttgtcagtctaacttgctgccagcgtcttaatttccaacatgtctgaaaggttttaaaggatttcacaatatgcaattttatatttactatttatatatgtataattgtgtctatttttacataaatggtattatatagtacatattgctcaatacctatttttccatttaacagaataccttcaagatttgctgttcatgtcaaaatatgttgctctctacctcattctgtttagctgtcacatattgtccatagcaggataaagttaaacttattttatcatctcctatgggtgactatgtagcttatattcagcttttactgttgaaaggaatgcagcaataaaaactggcaaaagtctctatttctcctaccagtactggaaaatcacatacacactatggcggcacattttcacaacagagaaattaatgtgataatcatggctactataaagaaaaaaggggttaattaacttggtcagggacttcaaacatgacagtgggcattattcagaatggacattttatgcttctaattgctgggcagggactactctagggaaaggcctgagcagaatggaaaaatctgtctacctaaaggacatatgaaggaattagaagtgtccttgggtagggtatttgtcagcttgaccccgcctgagaaaatgtcaagatcacactgcatatattagaaacatgaaaccattgaatatgtcaagcttctaggaacttccacaattatcaagttgaaccctttccatttttagatgaggacaccaagcctcacaaatgttaagtgatttgttcaagatcatagtagtaggtttcgatcatggcttagcttgtccactgacactagaaccaggggctaaaagttgaaatacctgatttttacaactcagaaggcataagacttacagtagcacatcattttaaagttttctagtttgtcagactatctttatttattttttaattttttttttttttttgagatgacaatgtctcactctattgcccagacttgagtacagtggcacaatcatagctcatttcagccttgaattcctgggctcaagtgatcctcctgcctcagcttcctgagtgtctgggcctgcaggcttgtgtcatcacacttggctaatttttaaatgttttagtagagatgggggtctcaccatgttgcccaggctggtctcaaaatcctgtcctcaagcaatcctcccaccttggcctcccgaagtgctgggattacagatgtgagccacagcagccagcacagagaatctttatttatactttttaaaaacataatctctaaatatgaaaattcatattagagtagcttcatttgtgataaaatatcagctgtcattgtctcagcaaccacagcaaagaagagtccaaatgaatccacagccggtttgagattctcattcctaacaatgccagtctgtttgttcatgtgtattaaagtatcattagaaaggaagcagcctcagatgaagccattttagccattgatgtgtctcaaaagggttaatcagatacagaaacttaacaatttctagaattgtaaggaaataattttgtttcttgtaaagcaagagtaataattgatgctcacgtgaattgacatttttggtagcttagaaatggcaccaaatgtgggttttggcaaaacctatattttcatgaagaaatggcttttaaacatgttggcatttctgttcatgatagacacaccatttgaatccaaacccttgcagaggtgacatgacactgcactgaaggcagtgacacattttttttaaaaaaaacttcacataaaattatgtaaacacttaaagtgaatgagacacctgcctttgagacacccgcctttcagtcgcccttgttatgccacccacagccttttctccttggctattcttagcaggatttattttgagcctagtggtggtaaaagatgtaacataaaatgaaacccgacacttagagctccctattattaattcataaattcagtctgggatcacccattggtgccaatgaaagattagcctagagaacaatcacggttcacattctatacagtagtatagaagaaagtttgccactgataattgtatttatgtaagtgctagcaataattgcctggtggtcttggaacagtgataaagaagaaaatgaccagagtaaactctgctgttcaatttcttggactaaaaactgcatggagacaggaaaacagcctgaaaacaaccaaccatggcccccctcaatgatttggagaaatgaaacaattttggacattttcttaggttaatagatggttactgagtacttctggagttcctctagggtataccggtacactattaggtactaggggtcacatgttaaattacaaacaaaagctttggttcccaaattatagcccttgttaggaaaagcaaagaaacaaaacatgatcaacatataagtgggaattttttcttagtaattcaagtaattcttaaggcttccattatgtaaacctgtggctgaacttataaaatactgaaacaactcattgaaaaccaatcagttacatatccacaaataaaatggtatgataaatagttctttctcatagacactgttagtttgttgtcttggcttcatatgaacagagaatgaaggcaagtcctcattgtaaaacaccaaagtcatagaataaagaactcccagaactggaagagactttaagttcacctggttaactgccaatatcatcacatgtattatccacctggtggattttacttgttttaaaatccctgcctgacttctccttgcctctccttgaattttaaaattgctatctcatactatcacttgagactgcaaatcctttttcatactagcaaaataaaaatataagaatataaatatacacaaaactacaaagtaaaaggaaatgacttgtagcatctcaaagttaagaaaaaacaccgaggcttttttgttcttcgtttttttttgtttttgtttttgttttttgttttgtgtgtgtgtgtgtgtgtgtgtctgtgttagaaacacttaacataagatctactctcccaacaaaaatttgtaccataaattattgttaactatagatacaatgtcctatagcagatctctagagcttattcaccttgcttgagtgaaatgttatgcctttgattagtaacttcccattttcccctccccctcagcctgtttaccaccattctgctctttgattctatgaatttaactattttagagacctcaggtaagtggaatcatgcagtatttgtctttctgtgactggtatatttcacttagcataagatccccaacattcattcatgatgtcacatattgcagaattttcttctttttaaggctgaatagtattccgtggcatgaatataccacattttctttatccattcaaatgtcaatgaacatttaggttgtttccacatcttggctattgtgaatagtgtttcaatttacataggagtactaataacacttcaagattatggttgcatctcttttggatggatactgaaaagtgtgattgctggatcatacagcaattttatttttatttttttgaggaactgccaaactattttccatagagactgcaacattttgcattcttgctaacagtgtgcaagtgctccaattaaaaagcttatgcacagcaaaggaaacaatcaacagcgtgaaaaagcaacctaaagattgagagaacatatttgcaaaccataaatctgataagtggttaatgtccaaaatatataaagaactcctacaactcaaaagtttttttaaaaaaactaataccctgattaagaaatggacgacagatttaaatagacatttctccaaaaaagacatacaaatggccaaccaatacatgcaaacatgttcaatgtcaacaattatcagggaaatgaaatcaaaaccacaatgagatattgcctcatacctgctagcatggttattattttaaaaagacaagtattagtgaggatgtggagaaatttcatgtttttttggtcttagctgaagtatacagtaacacagataatttctttctttccattaaaggagctagtcagatgtgacctcacgtacctcacatttctcataatactctcatccaactgctaaataggcaagcaaatattaaattcaagaatggtgtgtctgcaagagaatagttattatagagaagtagttactgagaaattaatgaaatatgtgtatttgtcatataaaataaagaactcataagagttcaattatatacatggctgatatgctgggaaggacaggaaaataattgggaaaactaatgtcaaaacgatagctgagtttttagtaatgaaccatttccctggacttgcattgatgatagtcacaagtagagtagctataatctaaacacttcttactaaaaataagatcctagaatatccatagactgggaagttggccatagatagtgcccagatttatagaaaccaccacagaatggcttttcatctgtatctggtttttaggtgaaacaaggtgtgtttaaaaagcatatactggaaaaagagaaaaaaagaaaaaatctgtagaggaaaaatataaggaagagaagaaaattaccaaaaaagagtactgtaattagtacattttgtgtaatgagatgatctcacgttcagaaaacaagaacaagatgttgtggaaaaagcagaggacaatagtttggaaattaaaaatacgattgttccaggagaaaaaaatcagacatagccagaatatggaataatctataagaatgtgaatgtctactaaaagggaatgtcattttttaaagtgtgtatggaataggtgggggacatgattggggacaagactgtattaggttaaaagattccaaagagaagtaacagttcattgtagcattattcacaatagccaagatatgcaaacaacctgtttgtccacaaaggaatggataaagaatatgtctcacacacacacacacacacacacacacacacacaaatactattcagcaattacaaaaaaagaagaaatttgcaacatgaatgaaacttgaggacattatgctaagtggaattagacacagaaagaaaagtactaccttatctcacttatatgtggaatatataaaaattaaattcctagaagcaatgtcaattaccagaggccagagtatggggaaaatggggagatgttggttaaagggtacggagtttcagttacgtagggtggattagttctagagctctaatgtgcaccatagtgactatagttaaccatagtatattggatacttaaaatttgttataatagtggatcttacatgttctcaccacatggacaaaataggttaactatgtgaggtgatgggtatgttaattagcttgactgtagtaatcattctgcaatgtagatgcatatcaaaatgtcacattgtatacctcaaatatgtacaatttttatttaaaaaaatttttccaaattcgatgtatggaccttaatttaatcttcgttcaaaaaaaaaaaagcacctatgaaagacatttagcaaacagctatagatatatgcatgtagatcagatattagagaatattggggtattatcattaattttcttggtataataatggtattatgattggtaggagaatgtgcttgagttatgagatgtttgctgaagttgttagtgatgaagcatcattatagctgaaatattctaaatggttccaaaaatattaaaacaaaaaaatgcaaaaatattattatactttaccttttcctattacaatgacaatccatttttaatgtagaagaaataaatatatacagaaaaacaagaagaaagtttacaaccaaccataaacacagctctcctccagacactgctaacaccttgatgtttgccatgtatgtataatatatacttatatatgtatacctccataatatataatatatatacactcacacacataataccctaatttattgtacccatctcctccagtgagtggagttttacttattacttgggcccacttcttccttttggtgcctgaggctttccttaagcgtgcaaaacttggggtgcttctcaattccctcttgttgagaccttagcagtttgttttcttatccattctgtcaatgagattttcctctcatttgcattagcccagaagggcaaggagcatttttatctagatgagtgtatcttacacataacaaattggttgcatatctttgctcactgatactttatttagcaggctaatctgataaactatttctcaagttataataacattcaccatggtggtaaacttgataaagtttctgagtctcgaaaaacagaagtcaattgcttgcaactacattgcattgtaggtaatccaataaagaatttcttttcatgttgacaggataaaaattggcagggagcaggggaaggtgttaacctgttagggaaaatgcaggataatcacatatggcattttattgctttggaatctttttattgtaatatcctcattttggatgaggtaacttggcatcagatagatccagcttcaaataatggctctgttactttttcaccttggacaagttattgattttttctgcccatttttctcatctgtaatatggatcatgaggtatgtatggaaatctcataggtctgttgtaaagatgtaatgagtaataaggtcatgtattgaaagctttttgtaaattattaagtgctaatggtggtgattggggtgggatgtaggtagtggttgtggtagtggtagtagcaagaattagcagtagcagaaatagtgacacaagtaaaaatattagcaatggatcaccttatttatttttaataaataaaaaaccattttttgtgatgttagggtgtcaattttggatctttcctgctttctcttttgggcatttagtgctatcagattccctctacacactgctttgaatgtgtcccagagattctggtatgttgtgtctttgttctcattggtttcaaagaacatctttatttctgccttcctttcattatgcacccagtagtcattcaggagcaggttgttcagtttccatgtagttgagtggttttgagtgagtttcttaatcctgagttctagtttgattgcactgtggtctgagagacagtttgttataatttctgatcttttacatttgctaaggagaactttacttccaactatgtggtcaattttgaaataggtgtggtgtggtgctgaaaaaaatgtatattctgttgatttggggtggagagttctgtagatatctattaggtctgcttggttcagagctgagttcaattcctgggtatccttattaactttctgtctcattgatctgtctaatgttgacagtggggtgttaaagtctcccattattattgtgtgggagtctaagtctctttgtaggtcactcaggacttgctttatcaatctgggtgctcctgtattgggtgcatatatatttaggataattagctcttcttgttgaattgatccctttaccattatgtaatggcattctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtttcttttaattggagaatttagtccatttacatttaaggttaatattgttatgtgtgaatttgatcctgtcattatgatgttggctggttattttgctcgttagttgatggagtttcttcctagcctcgatggtctttacaatttggcatgattttgcagtggctggtaccaattgttcctttccatgtttagcgcttccttcaggagctcttttagggcaggcctggtggtgacaaaatctctcagcatttgcttgtctgtaaagtattttatttctccttcatttatgaagcttagtttggctggatatgaaattctgggttgaaaattcttttctttaagaatgttaaatattggcccccactctcttctggcttgcagagtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggtgttctctgtatttcctgaatctgaatgttggcctgccttgctagattggggaagttctcctggataatatcctgcagagtgttttccaacttggttccattctccccgtcactttcaggtacaccaatcagacacagatttggtcttttcacatagtcccatatttcttggaggctttgttcgtttctttttattcttttttctctaaacttcccttctcgcttcatttcattcatttcatcttccatcactgataccctttcttccagttgatcgcatcagctcctgaggcttctgcattcttcacatagttctcgaaccttgactttcagctctatcagctcctttaagcacttctctgtattggttattctagttaatacattcgtctaaatctttttcaaagttttcaacttctttgcctttggtttgaatttcctcctgtagctcagagtagtttgatcatctgaagccttcttctctcaacttgtcaaagtcattctccgtccagctttgttccgttgctggtgaggagctacgttcctttggaggaggagaggcactcgctttttagagtttccagtttttctgctctgttttttccccatcttcatggttttatctacttttggtctttgatgatggtgatgtacagatgggtttttggtgtggatgtcctttctgtttgttagttttccttctaacagacaggaccctcagctacaggtctgttggagtttgctagaggtccactccagacactgtttgcctgggtaccagcagcggtggctgcagaacagtgggttttcgtgaaccgcctatgctgctgtctgattgttcctctggaagttttgtctcagcggagtacccggctgtgtgaggtgtcagtctgcccctactggggggtgcctcccagttaggctgcttgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccgggctgctttgtttacctaagcaagcctgggcaatggcgggcgcccctcccccagcctcactgccaccttgcagtttgatctcagactgctgtgctagcaatcagtgagattccatgggcataggaccctccgagccaggtgcaggatataatctcctcgtgtgctgttttttaagcccgttggaaaagcgcagtcttggggtgggagtgacccgattttccaggtgccatctgtcacccctttctttgactaggaaagggaacttcctgaccacttgcgcttcccaagtgaggcaatgccttgccctgcttcggctcacacacagtgcactgcacccactgtcctgcgcccactgtctggcactccctagtgagatgaacccggtacctcagatggaaatgcagaaatcacccgtcttctgtgtcgctcatgctgggagctgtagaccggagctgttcctattcggccatcttggctcacaattaaaagaactagaaaagcaagagcaaacacattcaaaagctagcagaaggcaagaaataactaaaagcagagcagaactgaaggaaatagagacacaaaaaacccttcaaagaattaatgaatccaggagctggttttttgaaaggatcaacaaaattgatagaccgctagcaagactaataaagaagaaaagagagaagaatcaaatacacgcaataaaaaatgataaagggaatatcaccaccgatcccacagaaatacaaactaccatccgagaatactacaaacacctctacgcaaataaactagaaaatctagaagaaatcgataagttcctcgacacatacagcctcccaagactaaaccaggaagaagttgaatctctgaatagaccaatagcaggctctgaaattgtggctttaatcaatagcttaccaaccaaaaagagcccaggaccagatggattcacagccgaattctaccagaggtacaaggaggaactggtaccattccttctgaaactattccaaccaatagaaaaagagggaatcctccctaactcattttatgaggccagcatcatcctgataccaaagcttggcagagacacaaacaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacatatctcaaaataataagagctatctatgacaaacccacagccaatatcatactgaatgggcaaaaactggaagcattctctttgaaaactggcacaagacagggaggccctctctcaccactcctattcaacatagtgtgggaagttctgaccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatatgccaataacagacaaacagagagccaaatcatgagtgaactcccattcacaattgcttcaaagagaataaaatacctaggaatccaacttacaagggacatgaaggacctcttcaaggagaactacaaaccactgctcaatgaaataaaagaggatagaaagaaatggaagaacattccatgctcatgggtaggaggaatcaatatcgtgaaaatggccatactgcccaaggtaatttatagattcaatgccatccccatcaagctaccaatgccttccttcacagaattggaaaaaagtactttaaagttcatatggaaccaaaaaagagcccgcattgccaagtcaatcctaagccaaaagaacaaagctggaggcatcatgctacctgacttcaaattatactacaaggctacagtaaccaaaacagcatggtactggcaccaaaacagagatatagatcaatggaacagaacggagccctcagaaataacgccgcatatctacaactatctgatctttgacaaacctgagaaaaacaagcaatggggaaaggattccctatttaataaatggtgctgagaaaactggctagccatatgtagaaagctgaaactggatcccttccttacaccttatacaaaaattaattcaagatggattaaagacttaaacgttagacctaaaaccataaaaaccctagaagaaaacctaggcattaacattcaggacataggcatgggcaaggacttcatgtctaaaacaccaaaagcaatggcaacaaaagccaaaattgacaaatgggatctaattaaactaaagagctcctgcacaggaaaagaaagtaccatcagagtgaataggcaacctacaaaattggagaaaatttttgcaacctactcatctgacaaagggctaatatccagcatctacaatgaactcaaacaaatttacaagaaaaaaacaaacaactccatcaaaaagtgggcaaaggatatgaacagacacttctcaaaagaagatatttatgcagccaaaagacacatgaaaaaatgctcaccatcactggccatcagagaaatgcaaatcaaaaccacaatgagataccatctcacaccagttagaatggcaatcattaaaagtcaggaaacaacaggtgctggagaggatgtggagaaataggaacacttttacactgttgatgggactgtaaactagttcaaccattgtggaagtcagtgtggcgattcttcagggatctagaactagaaataccatctgacccagccatcccattactgggtatatacccaaaggactataaatcatgctgctataaagacacatgcacatgtatgtttattgcggcactattcagaatagcaaagacttggaaccaactcaaatgtccaacaatgatagactggattaagaaaatgtggtacatatacaccatggaatactatgcagccataaaaatgatgagttcatgtcctttggtgggacatggatgaaattggaaatcatcattctcagtaaactatcgcaagaacaaaaaaccaaataccgcatattctcactcataggtgggaattgaacaatgaggacacatggacaccggaaggggaacatcacactctggggactgttgtggggttgggggagggaggagggatagttttaggagatatacctaatgctaaatgacgagttaatgggtgcagcacaccagcatggcacatgtatacatatgtaactaacctgcacattgtgcacatgtaccctaaaacttaaagtataataataatgaaataaaataaaataaacataaaaataaaaaaataataaaaaaattaaaataaaataaaaaaccattttttaatacaaatgttttgaggatagtgtgatgttaatcagatgcatttatggtagtgtatttttagacactctacagatgactgtaaaataaattgtatgtatttggaggtagaggggggaaaaaagaagtattacttgcccctagaattttataataaaaactaatgtttattttctatttcactgtctctagaaagagttctattttattgtaaattataagagcagtttaataataaagtcttctaaataaaacatttccactaaatttatagcatcttctatctctgctcaagattcccaattttgcataaatattccttcagtttaaatttatatttgtcgtgattcttaaatcttgataaaagagaaaaagtactcctttagaactaagtgatatgtaacagctctctcatataataaattaacttcagaataaccttcacataatgcattcattttgtttttcctttgtttataaaaaaaagtgctcttgggaaatggacaagtttctgaaacactcagttcacagcattcacttttttagcattaaacatcaggtattttatgacccaactggcacataatgcaaaaatatatgtatatatatcttttctagtggaggattaatgaggtggatgtttattttgtggttatttttagtgaagaattagtagagtggctgtttaaagaaaacacactaacacatcaacaatatggaatgatatattctattataaagatacatggacatatatgttcattgcagcactatttacaatagcaaagacatggaatcaacccaaatgcccatcaatgatagactgaataaagaaaatgtggtacagagataccatggaatactatgcagccataaaaggaacaagatcatgtcctttgcagggacatggatggagctggaagccattatcctcaccaaactaacacaggaacagaataccaaataccgcatgttctcacttctaaatgggaactgaacaatgagaacacatggatgcagggaggggaacaacacacactggggcctgtcaggggggcagggggagggagagcatcaggataaatagctaatgcatgtggggcttaatacctaggtgatggtttgataggtgcagcaaaccaccgtgacacgattacctatgtcacaaacctgcacatcctccacatgtatcctggaatttaaaataaaattaaaaatatatatggagagaatgatatttaagacaaaaagatgttctttctacctatttagattgtttaatcttcaattagcgtgtttggaaaagcacataagcatgatgatatgaggtgctgaagtaaacatgtagataaatataactaaactctaaaaatgccacctcctccacaaaaatcttcatcagcaccctagaaagaggtgtgattcttttcacttgcaatccattacatgttcaaacatgtaagcaatagtcacctaggctctgagcctcattcattgagtatgagggcaccattttaaaataaatttgggtggaacagagtcatagtccatacacttacagttcattcattgattaattcatgcattgaacaaatatctagtaagtgcataccctgagccaagtcctatcttagatgctaagaacactatagtgaacaaggtacagtccctgccctgatagagcttatatcttggttgaatgacaggggaagaaatgcaataaattgaagacaagtagatacagatggtggtgtgtgctatagagaagaaaaggagtggagtaaaagagacagacagctggttgggaggagagtgctctctggcataggatggatacaaaggcctccctggtctgctgatgttaggacagaagcatggagaacacaaggaagacagttctggattactggagggaatggatccaaacagaagtgatgcaaaagccctggtacaggtagaaattttagtatttttaagggccagctcaagttaactagcttctctgagttgcaatttcctctgttgtaaaaatggggataataatagtactatgaaggacagtttgtgaagatttaataaaatagtgtgtgcaaaatacctagcgcagtgagtgttctgtgaaaatcttaggtgcatttcttctgtaaatatctactcacgtcagtgtttctgtaaatatgaactcatgttggtgtgtgtgttagtatgtgtcattatggtctctcttctttgacagcaatgtgccttttgaacagtaagcccaaggtaattaccagattgtgttccagaaaacactaaggcagcccctgcctgtgttaaacatttcatgaaccactttatgaagcttgtttccacctccacttacctttcttgagtcctgccaccattggtctacccagagccccctgctgctgaggccttctcctagaaatggaaggtttttgggtgggagatgcccaggatagctcaggaccagctctcctccatgtgtgttactcactccacccatgggaaatgcatgcacccatagtgaggggtggggcagatttctttccatccctcctctaaaccctgatatctctccagttccctcttttccaagcttagacaggcaaaggagctaaggcagctgaaatgctctgcataaaataatgggagaaatttaggatcagagtgggtgtttgcccttgagaggaatagctgagagaaaagaggtgaaaaacaccttttcaagcatcacggttatgtggctgagaagctttcaagaacagaaaaggccactaagtatttttaaggagtttgccctgttgcactgtaaattctctccatcttttcaaacttttaataaagtctgtcaaaaaccaggtctttgtatgtggcttttttttttttttttttttggtagcaaccaaggaaaggggctaagttctattttgtggtaaacagagctgaaatcaatgcaaagccccatgaccaacagtgggcgagtaagaatttagcagaggaaggaagcaggaaccagccatcaccatccctccatctcctagagttcctcagaagtgtttcgagggcgttggatgtttcaaggcagtagtatacctatcttaatgagcaggatggccttagctgacatgtgcatgtatgtgagacttgctttgggcagcaccccagacaaagataggcactgaattctctggataacaacatgaaagtgaggttgaagctgcagatctgggagggactctaggcctgcctgaaagtgtgtacaatagacaggggttgtccacatttgtcagtttcctcgagtagacccatgcttgtatctatcatcagtatggactcaagctgcattattgaggtcccaagaacacatccagtagtgggcacagtgggagtggctttgttaacctcaatggtttactagttggttcttgagttgacacctttgattccttagaacagaaaggaaataagtcagaggaacttgtcttgggctgcttccagggctgtacataggtagaaataatatcaaagctaacatttattgagtacttagtctacataaaggattatgtgggaactttatatgtactcactcacctagttcccccaacaactctttgagataagtacttcctaatattcttccaaaacaagtgggcatactttgacccagctacaggttttgcaaaactggagcacgtggaatgaataggagtgctgaggggaaattttgtgagaagtaggagttggtgaagcaaccaattcagcaattctttaatagcagataggcagttagctttatccagatacccagtgtctttgtcaggtttataggatgatgttgtaatttcatttacatttgtctgaggtttcctttgagaccataaagtttcccaggccaagtcttcccaggtcccagatcttactctgcttttgcaacttcactctgcagaggaggggatgtggcccatggcaagcaagaggggatggcgatgatgatgaaagttaggaaaaaattggacttcaaggagaaattaaggagggtggtcgaatgtagatcaaattaaggtcaacaaaaaggagagtgtgggcaaggttaaagactttgtgctaaaagcaagagttgtatgtatgcttagtcataaaatgtagctctggagatccagttcagggtctggttctgtgcacataaatcccttttggaatttacactttcccccatgcaagtgcactcatccttggagcactaagcgacccattactgccctgggcagggccagtcaggagtgggtggaagtgatgcgtaattcacctcttggaaaccccatctttggggaaagtgaatttactgcacatttaaatgtttgtctctcagtgaccattaacttaagcctggctcaccagagtatctcgcttttaatgaagaattgctttcctgcaagaaaaattcttgaaattgttggaaaaagaaaaagtaaatcctgagggattgttagaactggtagatgtgacatattcactagcctgactggatttcctttaaatgctgagatgaaagtcattcagcatggagctctcatcagtgaggatttaagaggttttgtttttgttctgtactactgccaggaactgtaattaacaggtaaatgtaagagatggaaatgtatgttgttcatctgatttaaataatactcctcctttaaaaagcaacatccatcataaccaaagtggacctgaacagtagaagtccagatgtacagaggtcttccagaaagccacaaaaatagtgcaatggttagtttttcttttggcctgagcattgataaagggccttaggctagttttagttttccattaatctctcatctttctttttttttttcttgcagtaatcttacctaaaaaatgctttaactggtatattagaaatcttttatttttagacgtattcactttgaattctttcctttttccttacttggtaaatatttatcacactcccaggcaactcaacatttctcttatagaaagaagtgtcccataaaagaaatgtgaaaaacgagccttgcgaaaacacaggtgccctgagagacatatttctgcaaggacttgtactgaaagagcactagtgacatataatcatgaacacttgccagcctttgaatatgaagatgtcactatcatcattcttcaggcatgttttgaaagttttgttttgttttggctcagtttggttgatttggtgtgtggtttttgtttgtttgcttgcttgcgttttccatgaactttcatggatttgtattgacccatccacatttactttgtcctctttagaccaaaaatgggctttagtgtgggatcatcaatgaaaaatgtgtattaattataatttgtctgttcaatatgtgccactaagtcttttataaagaagaagttatattgccagaaaggcaatgaatgaatcttgaatttcttttgtccttgtcctgttctgacatctgcaactctcatggcagaattcggtaaaactgaattcagagtcctaaccagagcgtcagtagatcagatggagtcaaagagacaaggaaagaattgggaagcaatgctgtggtcagttgggaaatgggcaactccagtcacactcagaaaatggaagtgaaaattggggccaggatcatcttagaagcaccaacaaaagcatattggtaaaatacccaacaataaagatcacaaaaattagccacacatgggataatcatgacacaataaagttatgaatcacctctacattagggtatgtgagcaattctgtagctattgggaaacatccctctgttttcttgagtcttactccctgagactagtctcataacacttcaaaatgaaattgtctgagccaagaaggaacagagtcgaatagaatagacaggtgtattttggtgtcaatgattataccattaaagttttcataaatatctttttactattatcattattttctcctcagcagacagcaccagttccagaagttgtgtgatataattgaaattgatttttctttttaagcagtgtatttgacatttcttcagcgaggctccagctctcttccttatgctcacccccaaatctgtggtgaagaaaatatgacttcagtccatctcatccttaatatagctttggccttcctcatcacaaaacccttacagcctaaaaggtcatgggcagcatttacgaagcctgggatatgctacaggagaggcagtcatgcttatgttctcacagtcgtgataaaacatggggtggcccaactcaggactaatttggggtagttttctctggatttagcttttgaatgttttttgggacctgagaaggccccaaaaagaaagaaagaaggtagttttctttctttccttcattacctatagttttctgttaccacttgaaacaatacatccaatacaacctattacagattaagattaaaatatcttttctatggcactatctgaaacttatgctttagctgcttttcaaatgcctctagttcatgaaatgggaaagaaacattttccatgacacgacggtatcaccatctgttttcaaggaggacgactgcacgcctacacagcagattttctctgtgttgtattcatgcagcgaagagctgcacttctgagtggtttcttgtgtaagctcattcatgcttcttaccttggagacttcatcagactctcagccaagtcaaggtcaggaagcacctgtcctgatgcttcttttctgtatatgtttctctggggttctccacagcctcatggaacatattccttttaatctctatcggaatcatgtatgtttcattatttgcagatgaaaagaaaaccatcttcacaaacagagaaggacctttttatttaataaggctctgatcgcctgattgattctgaagtgcttgctctgggctctatctgaatgagtcttacatagagaataagaatctttcctatcattttctcccttattttctaccttccttttatttttcctttctctctttcattttctcctttccctgctttcttattctgtctgttttacagccagtccttcccgccccagattacccattcatcctcatgatgaaaccttttcatccttgtgactctcagatttgttccaagtcactgttaatgcatttatcacttctgacataaggtggtagacttttttagcttatactttcctcccctttgcaactcccttcactaatggcaaagagtgacaactagtgattacagaaatcttgaaaatgccactgggaactcagcaacaagaggtgcctcatcaagactaagacgtagatttaagattggatccccagcggctcccctccccatcccttttatccccactttactagcaaaacctaagtaacctctttttacttcctgacctggaggttctaaactgaaatcttcaaccagcccaagggtgcacgtggccctgctcagtgcttttacgccatcctcccacagtctgtctattttgaagtgagcgctatgttatttctgtaccaggcaaaaacctttttgtttaaatggagatataaaatttgtaggtgctacataatatgcttaaaaaaaagcttcaatatgtttttactttaccatcctgctccctctgcctcgtccttcctctgtccttttatgcattgtgttgccctgtgtctctttcttcatttttggacttgcttcagtgtgtggctgcattcagagtggagcttagggaatgactgatcacctcagaccttcagggtctgcctgtccagcagagctcagctttcactagatctcaagagtccaggggtgaccatagagcaggattatgctgggcaaaatagctaatggcttttattttgcatggtaaagaattacaaaggtaggtccatatcttaactagtttgtgactcattcagcaaatgtttcttttgtatctcgtatgtacctggctgttctagttctcaagatatacagagaataaaacagacaagtgtcccttcacacacaccttcacactttagaacatattttcataatctctaaggcatcagcagtttttataagcaactgtagcatcttttggaaataaaattcccaaattttaattactgtaagcatcttactcagttttatgaggctttttaaaaagaaatgggtgctgtaaaaactgagttgtaactttttatgtgagtggaacagcatttctctccgcatttgctttctcctatcaagagagagagaaggaaagaaagaaagagagagagagagaaagaaaatgaaacgtgtttggatttttgccacctggttatggttagttctttattttaaaatcactttcaaaacagatcagacattacattgttaaaaacaattttcactgtaggtattgaatatcatactgcgcttgtagtaataactgatagatatctagaataatcttcattgtggactgaaactagaaagaactgtcaatcactgagtttaactttaaacacagatgatttgaattcatgttagcagcgtgaggaagccgagaagatggaacagtgctgcttggagaaaagatgataggattacctctgcagtttgccgttcttgctagttgtttgagtcactaaatcaaggcaaagtttgtgaaaagcctgtggctggggtctccaactcttcattcctgctgagattttcctattataaatctgctgtcagaaataagtgctttacttgtgacttaattctatgcaggcacaaacaccttggttcaacactttgaccagacggccctgactgtcttgagagaaacagagatctcattaatatgggctgctacaaagaaaaggggttcccatgctctccggtcgtcattcactgctctggaaacagccctgtgaacgctgaaagaaaacatgaactccaaggcagcagtagggccgggatattgagggagggaaggatattagggaaaagggagtataggccttgtggattcaaaagcattgtcattctcaaaacaggcaattccgtgttttaatacttcccatgtcacctggttttaaaaattggttatttaaaaatctgctattatcataattagctagatccacactatctagtatgggagccactggccacatgaggctatttaaagacaattaaggtcaaataaaatttcaaacccaggtcctcagtttacgctagcctcacttcaagtgcccagttgccacgtgtgcttcatgcaactgtattggacaacatggagcatttccattgacacagaaagttctcttgggcagtgctggtgtagacagtgcttatagaatctcttggtctttggccactcatcacttttacaatgatcaggcatttaagggcataagcaataaaagctgaatgctaaaactcaatgacatttccatttttaatattctgactttatgttaaatgtcttcttgtttaaagatgtatggacaatgggccgggcatggtggctcacgccttaatcccaggactttgggagtctgaggcaggcggatcacgaggtcaggagattgagatcatcctggctaacacggtgaaaccccatctctactaaaaaaatacaaaataattagccaggcgtggtggcgggcgcctgtagtcccagctactcaggaggctgaggcaggagaatggcgtgaacccgggaggcggagcttgcagtgagccgagatcgcaccactgcactccagcctgggcaacagagcaagactctgtctcaaaaaaaaaaaaaaaaaaaaaaagatatatggacaatgactttttttgccttcttttaatatgtcttttgaatatcatatgtcagtgctatgcaacatgtgctccccggaatgggtccagtccacaaactattagttatcagtctatagtgaagcaaataaatcaagagtaagcctttacaaatttttatagggatttaacattgctgtgacttccaggcattcatgctggttttgataagtatgtgaggtgatggatatgtgaattagcttggtttggtcattccacaatatgtacttgtatgaaaataccatgttgcccacgataaaaatacacactttgtcatttttccattaaaaaataatttttaaaacaatttgcaacagattggaaattttgatttattttatgaatttttttttttaaagacaagatcccactctgtcacccatgctggagtacaaaaatgcagtcgtagctcgctgcagccttgacctcctgggtgcaagcaattctcccacctctccggagttagctgggactacacacttagctgatttttaatttttaatttattttatttattatttttagagacagggtctcgctgtgttgcccaggctggttttcaaactcctggcctcgagcaatcctcctgacccagcctcctaagtggtggcaatttaaaacaagaaataaacttgcccttcaccacagagaggtgagaagcaaagatgtatgaaaatgttcactttcggaaacacattaaccagctcacgtaaaaatttcaaacaggaccagcttacgtgcaaggaacgaaagctcaattcaggaaaaagctatattaaatgtataattacttgacatgactgtgaacatagcctacagtagttttctcattcactcttaatgcatgttaaggatgttaatgccaggtgctctttcctataaatctggctccacttttatgtaacattctttatcttagggatctttgaccagagtgggaggaacaggtgcctgttactgagagtaacatggtgtttgtttattacacttggctaagtttggaaggtttgtgctttagcttataaaagtagctactacttgcagagtactacagtatttgaattgaaaagtgttatgctttactgtatctccatacaaagaagaggtttccctgtgatgtgattgacagtctataacaggagtattcctagccatgttccagtttcttctctgggtacctggccacatttcaatgcactcagcccacagagaccagaggctatgtggcacgtgtatgtggagttgctacataaataatacgtagtattaagtgcttatttgctagcttctctgactaaactcagagctctgcagagaaggtggctgtacttagccacctttgctatctccctcgacttacacaacaggtgctcaataagacccttctttttttctcttttttttttttttttattatactttaagttctgggatacatgtgcagaatgtgcaagtttgttacataggtatacatgtgccatggctgtttgctgcacccattaaccggtcatctacattagttatttctcctaatgctatccctcctcttgccccccacccccgacaggccccagtgtgtgatgttcccctccctgtgtccatatgttctcattgttcagctcccacttatgagtgagaacatgcagtgtttggttttctgttcctgtgttagtttgctaagaatgatggtttccagcttcatccatgtccctgcagatgacatgaactcattcttttttatggctgcatagtattcaatggtgtatatgtgccacaattcctttatccagtctatcattgatgggcatttgggttggttccaagtctttgctattgtgagtggtgctgcaataaacacacgtgtgcatgtgtcttcatttaattggctattggaactacatgatgcagttaaaaacatagttaataatcaagtccatcattcagttcatttaacacgataccaaatcactgctttgacatcattattttgcttcatctggtagttgtgtagccctggacatgctgagtttaaacttcagcttggtcaatggcttgttgaataatcaggaaactctgattccaaattattgatatttcttagctctaaaaacataatcttggtttgcaataggggcaatataatgaataaatgattgtaaaatacttcactatgaaatgaggctaaaatattccttatgtgaaatattactaccagaaattccccagcactcattggaactttctgtaagacatctctctgtcagaggaagttgtgagttgctgcttagaaattcagtatcagtggcatttttgtaaacctggcatttggaaagtgaatttcagaacaatcttcttcctccaccccaccccaaccctccatttatttgtatcacaaaactgcccctaaagtcaatatccccctccctaaaatgaatacattgtccaagatctttatcccctcctcctcctcctgctgctgctgctgctgtttgctcatcaatgcaggatttcagagttgttcgtcctccagaagctcccactcccttggtcttgtctgagaagttcttgattgggctcccatccatcagaagaaggaggaatttctggccctatagacatgcaggtgctcttgcagcccatgatcttgcatgaactggagatgtcaggattggggaagtgactcctgcagcctgaagcctttgttgggaggagcagtcggagccaggaagcacatctgcagcaggaaagtgtttgctgattgtgggatttataagaaaggacacacccgggagtaggctctgaaaggggtgaagagctccatccccaggatcacagaacttgtccttctggctttgatctttaagccacatttaaactcacaggaaataccaccactcacgagagccttcactgggagaaagtataggctgggtgttatccagctcgtcacaattgcaggtgtatgtcttcagtgagtgagtggttctatatgtcataggtcagagtttcctaatcttggcattattggtattttgggctggttaagcctttgctgccagagctgtcctgtgcattgtaggatatttagcagcatctctggcctctacccatgagataccagtagcaaccacctacagatgtgacaaccagaacatctccagattgaacattgccaaatgtctggttgagaaccagaaccatagaaagactctcaaaggattctagatgtgccattatttctcagaaaaatctagtaactttcttctatgattaagaaaattatatgattaagaaaggtaaatgattaagaaaggtatgctttacagccagatgcaatagctcacaagtgtactcctagcgttttaagaggctgaggcaggaggatcatttgaagtcaagagttcaagaccagcctgggcaacacagtgagactctgtctctacaaatgttttttttaaaacattggcccggaaagctaaagaagaaggatggcttgagcccaggagatcaaggctgcagtgagctgtggtcatgccactatactctggcctgggtgacagagtgagacccaatctcttaaaaaaaaagaaaagaaaaggaaatgtatactttatgttgtaaccaaaaagtatgtttaagcacccacttgtttgagacactcagttgagttctaaacaaatcaatcaaaaattgtatctctaaacatgaattttctaagctaattgacaaatttttgccttgtagagaatctgaagataaatcatattcagaatacattgacaaaaagttgacattgattctgtcccaaaatatgccttaatgaacttgtctgttaattccatgtgcagaaattgagtatctactattttccaggcatttgaccaggaaggaagaaataaaacacgattatggcccttgaggagttttaagcatagcgaatgctatcatttggcatacaaatgacaaatgggtgggctggtctacatagaggagaagcagctaaatcaaactgaggggtcagggtaaatgttctggggaggtaaacttgaagctatgctttgaaggatgaataggagttaagtgaataaagaagcaaaatcaagggcactgcaggtagacggagcagtgggtaccaaggctcagaggaaggaagtggcacaatgtggagatctgtgagaggctatgaatgcttgagtgaaggcgtcatgtggggctggggtagggagtgaggggcagatcttgcaaagctttgggttctgagcctgaaggcacagtggagatgcaatggcagaattttagcaggggcacaacagggccttttagcaacttcttccagcaacattggaagggttcagaccagcaagctaggaggcagcagcagtaattcatgtgataattgacaaagacctaaatcaaggccatgtcagtaggttaaggaggagaacggggaaggaaatctttcagagattaagaaggtcaaatctataaactgattgaatgtggtgacttgacatagaggagacatttctgacagatcccaggattctagcttagatgacagtgactggttctcaatcccaaagttaggatccaggaagaagattagtttggggaagagaacaatgagacagtatggtggagtagttaaaaccttcaattgtaaaattaaattagacctgggtttacataccggttctattctttacaactacatgaactttcttggactcatttaactttgctaagccttgatttcctcacctgttaaatggtgctattaatagaacttactcatatattattataagaattcaatgagagaatcattgagaagaacaatgcttaacacctagtaagtccttaacacatgttagccaagttagcagcatccccgagcccaggaagtccaactgcaaagttgatattcctaaccattttaatacactacctccttggggcaattgcatgtagattaaatggttgaaatatagattcccctaagcggacttgtgcagtgtaaggataaaaaactaggcaaaggttagatcacaggagatcatatattgtaagctagggactttggcctttatgttttttgtgaaatgagaaaatgctggaatgtttttgttttgtttttttgagacggagttttgctctagtcacctaggctagagtgcagtggtgctatttcagctcactgcaacctccgcctcctgggtttaagctattcaactgcctcagcctcccgagtagctgggattacaggcggacaccaccactcctggctaatttttgtatttttagtagagatggagtttcatcttgttggataggctggtctcaaactcctaatcttaaatgatccacctgcctcagcctcccaaagtgctgggattacaggcttgagccaccacgcccggccaaatgctggaattttaagcagggagatggcatgtcccaatttttatttcagaatgctgacatcaacagacagggatgacctaccagtgtaggaaggcaatggccagaaagacccaccagccttctttttcttgttttcctcctagtgtatagaacacttagttgacaaacttgatttgtctacttccgagtaaaagagaaggaaaagagtgatagaaacttgaggtgtttcaagtatgtcagcatggaatatcctttcactcggttggcctcacagctgcagataatgtggatccagaaagtttgactcctccttaaaaggacaatagttgataccgtgcagagcaggtaaggaagctcctttgcagatgaatacaagcagccaagcctgtgggaccagagcaggcaccaatccagataataaaccctgttcagcatcgtctagacctgtttgagtgatttggtttaattagcctttccaagaaagaatcttcaagttttaatggtgcatagttatgcttgtaaacgtctccgccaagcatgggctctagaagtgaggatttgatgggtcacagtggcttggctggaagccacagggtagctttaataactttgtataatctaatgatgtcatgcaaacagaaaaatttggattagaaggggaataagtaaatgaggtagtagcatgctcgacaggtgaagatggctgagagtgtgtcaggtaatcctctgcctagacatatttctccttcaaatctcattggaattggggcttctcttggtctctatgacaatattactaccacagcatgggtagtggagagagcactggagagagagtcagcaggtctgatttctaatctgagctcttccatcagctggctgtgcaagtttaggggcccttcaacttcatggatggcaatggctcatccattcagtgaaaaaactaaccaaggtaattaagaaggaggatggagaaaagaagaagaaaataataatttccacttacctagttttttatttaatttgctgaacaacatgctatgtggtttgcacacttgatccttccatctcatgacaataacttccatagccatctctctggatttttttcagctatttgttttcatgattctgcatttatgtgaaggcactgggaacaatatagaatggcagaagttgaatacaaatcctccctgtatagtaggaggtaatattttgaaaccttgaaggttcaaacagtggccagggacagaggatgaggttggcacatatggtagaaaacacgaatctggttctgtttcctttctcctctgtccatccacctgaagactgcattatggccagggctaaagctgtagcctgttgggaatatagctaccagagcatacttattttaaatgtagttgtttccttgctctcactgcgccatcaaaactgaaggccttagcctagcttccatgcttccatctagcttcctgcctttccttcccttgctccctctccacatggtttgtcttcccttgaccttgaatgtgtgctgactctctcctgacttcacaccctccttcatgatgtgcccaggttggctgaacccacaagtaagcagtctgttttggggccagacattggtctgagagctgagagtagagagaaaattcagtactcaattttattcactatgtttattggcctttaaagagagaagcgtgatgggagaccagagcatctaacctaaaggatgtagctaggaatgccctttactctgcccatcctacccttacctgcccttaaagctaagctcatgcttgcagcaagcccagctccatctgactgcccattctgatgacccatagcttacaccctctttctagtctcaacaggtctaggagactgtctcacacaacttggaaccttatttcatattttgttgtttgaactatgtttagatgctttatgctcctcattcccaaatcctattgcaactaaataatagctgcttctgtgggtctttctagccctttgtttctgtgattattattaactgaaataccttccttctctttcctattgcataactttcttcctaccttgcacatttttgtggctgggtgggccactggacaccaagaagcagtaattattatcacaattaccctgccttaataactaacacgttatagccttttaccctgacaaagcagctctgtatccattatctcattgtttcacacaacaattctgttatgtaaggagcacagaaattagcatccctcatttacaggtaataaagtagatcttaaagaagctgaagaacttattgtttacatgccacataacaaaatgtagtgaataagaccatactttcctgtgctgtctctggggaaaaaaataggtagataatttacctactacaaaatgtgtgatgggaaactatcctcctgggtcatggcactactaattacccaggaatccttagaaccctcttttgacatcagttgaaacactattgacttataatgctgcttctcaacagagttgagtggatcaaatagcaaatgtgaatgactctatttaacttggtatttatcttggcatttcaggccttccattatttcctctctgatctacctgccattcactgtttacatctttgcactgctatatatttgtacatgcttctttctcttcctgaaatgaaactctgcattctcctctctacgtccttatttaggtcccaccattcttcaaaatccaactcgaattgaactccataaaaaatccacttccctttcttccctctgcccttgtcctatctccaccacttgttaacctcacccctatttaattttcagagcacatctccaggcattctctcttctgatgtagatatttacatacatttgtcgtttccctgcatgaatgccaaattctttggcttcaagcttttttcttgattcatttgtgtggccatcataaagtttagcctatgccttcaatataccgcgttttgaagaacatgtgttcaattataatgaatagaagaattattgttaaagggggcaatttaggttggattgaggacacccagcatgaaactgaaatgactgagaacaggcaaaaaattcatgactgcatgctctaaccactagactattttccattctgaataggacaatagtggtcattattttgttgccacagtttcattctcacactcacactgagcctttgaagtgaaatctctcctagcaccactgaggttgggaggattgctcactatttggagggattgtcagtagaaagttatgaactctctggtgaaatgctgctcagtttattctctagagattcagattcttttgaccaacctgatgtttcaacagcttgaaaaacgaaggaaagaaccatgtctgtctagactgaccagaaagcaaaaacaagggatactttgaaatctgaccacaactgagagttgtacttagtccaagtaactggaaaatcagtttcttggattagacaaatgcttcccttaagactctcaaactactagctttcttcttttataattaatagaaaattattacactgacagacaagagacttcatatttgagccaatgggaaaacttgacgttgaaaccaggggaaataatttagcctcaaatagagttgttaatgccaggataaaagcaaacaaatgtgctaatgatcttccttgagaatctgactgtgatgaattttgatgaattcccagatggaaaatatatcagttctccctgggctgggaattggacactagaatgagaaaatggtgaaatgggagtcagcaaaaagcactccgaagatcttatttccattttctagagaacaagaattctaaagagatagataattcccacttcaaagaaccagatctgtgtggttgtaagcatctatgacaaagttggtggtgggcatgaggcagggggatgtcctgatttccatcatagaatctgccattgctctgctggcctatagaattgatgagaggggagagtttgatacagcagctgccttgatattctcctgtgcagtcatgttatcacccaacaaacattcattgccatctcccatatgcccagccctttcctaggcatatggcaaagaagagagacagtctttgctattgtggaattctcattctagtgggtctagaattctcattcaattcccaccactaaaatatgaacagacaataaatacatgcataaataaatgtagaaggtcagatagtagtcagtactatgcaattaaaaaacaagtgaaggtgaagggaaaacaagtgccatgtgccagggcacaatggatggtggtatgttgctatattaactggggttggaagaggggaggcctcacagatgatgtgacatttgaataaggaccctaaagacatcatggagaaagatgaatatttggataaagagtattccaggtacagggaataccaatgcaaaagctgtgaggtgtgagttcttgacaacatcaataaatgtccaagaagttagcttgattgaagtagagtcagcaaaccaaagagtggtagcccatgcattatgagatagagctggacacatggcgtggtcttgtgctggggaacacaaaactctccaaggaagactccatgcagtagatgagaggatggctacacgtacacatggattgtgaagcagctgactggccatgttgaaactataatagacaactgaaactggaataggcaaggaaaaagaagctggagtcagtttgacaggatacagctagcagctttgttttcaactgtgctccaaatattgttgcaacttccacaacttttcctttccactggacgtgcttactttcacctccaaacccattaatatatcttcatccttcacagcctagttcaggcagtctggcaccagtgtggacacagttgaaacagaatggaatgtggagcttcaaaaactggagttcaaaaatctgcctttgtaatttagtagttgtctgagcaacgtatataacctctttgagcctcaattttgtcatcaataataacaaaatgttttaaatgtataaagtgtttaaagtattgccattatccaaggagagtaattctgttatttacagcagaggaaactgaggggcaagggttaagtaaataacccatgattatttctaaattgtagaaatgtgaaaatgctagcacttgcaggatttgaactcgagcaatatggcaactcatgtatttaaccccacataccttgcaggatggtgggcttgctgaaagggattatcaagaaaaaaataacaaagaagatactcagtcattgttagttcttggccactcacacatttttgattgcaagtgactgaggaatcaacccaaaattacttatgccaaaagaaagtttgttggcttttataaataaaaattggccctaggcactagggtcatgctagcttcagctactgctcaatttaggttccaagttgctatcatgatcccatctcttagccctgctttatctattccttctttttcatgttccatgtggtgagccatggcagcttcagttccacagcaatacaacacccaatccagtagaggagaggagttcactttcctgatgggtgaccatgtgttctggtttagctggaacagtcacccagtccaatagaaaagaggagtctacttctataataggagatacatccagaatttcccaagacagtcacctagtccaaaggaggtggactgatggacaggatgaccataggtctggttttcccaggcactctttattcacatctgtcattgcagcttgattattaattgtacctccattctctctcagaagtgtcccaatttatggtagatgtatatggtcattttactgatagtacaaagaaaaatagtctcattaatctttgcctcagatacaaagtcttcctctaaatcttaagtagtatttacttagaggagagagggagaatgtgtccaccaaagaataatagagggcctgttatcccaagaagtggggtggtggttctggatggccaaaaccacaaatgtagattacagttccccttttctcttcatactgttcggtactgtttagctgtagaaatggtttgggagttggaaaaacatgggtttgactcttgactctactgctgcgtgtagctcattcaccttagtggaagcatcttccctttctaaagcctcggttttctcatacatagagaaagctcatcatgtttgcctcagtgagttattatgaggagtgaatagactgatagacatgaaggattcaataaatcaatagctactgtttttccatagtgcctggaatacatcttaccacacaatatgtggtcagtaagtacctggtgaccggtgactaggacaggaaacaaacaagaaaggaccgtgaacctcatagtgggtgcagggaggcacggggtgagtgtagacaagagttgctgtcagtggtggtggggcttagtgatcaaggaaaggaaaacactttgatgctgagtgaggagattcatgatccaactgaaacattggggaaaccactgagaaaacgtcctttttagaactactggggaaattagaaattattaaaatttaaaacagtaaaaatatttactagacacccacattggggcatacagatatgaataattaatggagcctactcccaagaatttgggaggaaaaaactcataaatatacagaattatgttctacttacaatttatatatcatagctagagaatgataaatgccataatcttaaacataatagttctttgattggatgaacaaaaggttgtaggaaatacccaactgaagtgctatgagaggttaaaggaagaagaaatcccgccaacaggtagagcaggaacaatttggggaactggggggttcttagaatcaggtcatcagtgtagctggatttacatgtagggaagatcagaaagtattggaggccttggacactccaggtgcactcttacccttgtgcttttgtttcctttgcctaggttgctctcccacaggggtccataagacctgatccctcacttccttgagtgtattgccaaatgccacctctcagtaaggacctcccttgctctctgtgtaaaattgtgacacctactactgtgtttttgttgttagtgattgcagctctctaacctgccatatacttcaactgtttatcttgtttattctccatcttgctgctagaatgccagctccatgagggcaggaatttttacctgttttgttcactgctgcatctccaatacgtagaatatacccagcacatagtaggtgctcatattttgtaacaggaaaagaagaagggagtctgactgaggggaagcatgaaccaaggtacagatggaatgtggaactgtgtgcagcagatactgtgttagtgcaggcagactggagtatgcatgtgtgtatgtgcatgcttgtgcgggggtgaacacagtagaggacatttaaacaggaagcacatattggggccagaccttagaggacttgaagactaggccaaggaactcagcttttagtctgcatgtcatagaaactatcaaatgtttccaccaggaaattgatatgaacaagttgtttgaagaggattgatcagacagtgttgtttgtagcaagagtaggcgtggaaagaggttagaggtagggaacaatgaccaggtgctgcataaaaagccaaggtggccttaaccgaaaaaaaaaaaggaggtgggaaatggagagaataaagggagatgtgcaaaagaagggtatacaaagagatagaattaacaatatttgatcctgttaataaaaggaatgctagagaacatgtactaatattagtgggatgacctatatatgcagtgattgatgtgacaacagctctaacattaatagtcagagatgatgactcttaggtatggaaggtaccactctgtccttaggaacaatttccttacagcgaaaatagtgcttctaaatggtttctatttattttactcttttttaaactagttaacataacacaataacaattctagtatgtgaagaccttgagtgtctgccttcctttgggacagatctacagtcactcctaaaagttaaatatcatgacatctctatctctgtgactctgattttctttttcacaagcaaggttcccaccaaaggaaactgcagatttgcacattgggaagacttaatagagaaagcagaagaatagagaatggaattgtctaaaagcggaagtagatagcagaagggatttgagtctgaaaaacagaggagtccctccttattttccaagcagccaagaattgcatcttcaattgttctgaattttttgctctgtgtgtgtgtgtgtgtgtgtgtgtgtgtgtgtgtgtgtgtgtgtgtaggcatgtgcatgcatatgtggacagctacacatatagggctgccaaggatggccataaaggctgtgtcttacacgcctcaaggaggctctattcacataggccataatggcaatgctgctttctggagttgtgcaatgggatggccctgcttacgagaatgtagagaagagaactaacttgagaagtggctgtgctctttcaaagtatctcaccttcccacatcccataaaatctgcaatttgccattacaggttaatttatttggattatcattatgtagtctatcagtttgagttagttcatccaactattctcttcagtggctaaagaatccatgactttctgagaaatcttggataacaagggcctgaaagatctaagactgaagataaggaagatggtggaggggtgggttctgacaacaaacttggcctattttacacacaattgagtcaaaggctgctctgctctgagcaatactggagaattaagttagggtcagatggtagtgggtcttaaatgctgagctaatctaggaaatagggagccattaaaggtttttaggaagaaaaatgcatggaaacaccgatcagtcaagcctccttgtctccaaacatcaaactgctgaaggtatccacagactcccacctgagtatctctgagaaggtccttgttctcttcctcatctctgtccttccatgcaagctgactgatccacatcaactcaattcaatacatatttactatgcatatattacatatcagtgctcttacaagtttcagaaacagctgcttaaacagtactattctctgacttcccctctcattttgaatattttctttcatttcctcccatttgcaatgccttgggtgacattccttcaggaagtaaactttccaagtactgtcatgttagagccttaggagagatctgatgtggcctagagtgttaacaggagtgctctgtacgatgagaaatgtatgttttctttactctggccagatgtttctagaccagaaagtgaaggttttttcaatattagcatgtagtatatttaacaaagtgcttactgaaaatcccacaaaatatgtctttcctgcatatttttaaagcgtagaggcgctcaccttggtttgtgtaagcattcagtggtgcatgttatactttatcttggctgctgtgatacatattgggagggtggctctctctggactcccggcgaagttggcaagctgtatccaaagttggtccaaggatagggtggcttgagtgagttatgtgcgagagccctcactgtctgctatacaaatacatgtctaaattcacagtctgattcatcacacccgctggcaactgcgccgaccaaagtcaggttctcaactgctgcttggactatggctatggcctaccttcttactgtgccctggctttagtcttgccaccctcctgcagcctccacgttgctgccatatccttaaacaaaatcagaatttgactcttgtgttttttaaaacctccagtttctctgcagggtagattgacagcagtgattttcattgagggtcaagccatccccagagagatatatccgaatctgcacaaagggtgtgctggggaagagagaagtgtggctttaaaagccatatctagcatcagcagtgccttggatttcttttgaaattgttaataatatttatggactgaatgtgattaatatttatttaaagtgggctactgatctctaggaagaagtccacacttcttgttctgccattcaaggccctacgtgatgtagtaccattagtaatttccagaacagtctcctgttttcatattaccagtctctgtacttaacgttgataatattaagaagagtaggtctttgagggacatttactctggttgtagagatagatgcaaaaaactaattttacacggtatgagatgtgttattgtagagatatttacaaggtgggtggcagaataatggaggggattcacaaatctgtttcagaggaagagttaaagctgctggagttgcatcataaaggctgtaaagacaggcagattcaagacagatgctggaggtggaattgacaggactgagacccccctcttactagtccctgatggaaaaggggaattgagggcagtgctcaggtatccagctgggattccatatgaacagtggcaccattaagcaggtcagagctctgctgtggacatgtcaggtgtgaggtgcccctgagatgatcacgttgtaatgtccactacagagtctggaacctagaagggatatcttggctggagaaatcaacttataggtgatagtggaagatacaggtgtaagagctaaccagagtgagcatataatattagaaaagataaaatgagacaaaaggcattacgcaaaaagatgaaaccaaagccagaactgcaaagaatatcttccaatatattttttaaaactttaatagaacttgaaggggttaagcctttttctattaaaaatttaaaaatatgttataagaagaatcaccatctgaatatccatacatggaattatataaaagtggccagggcatttgttcttaagttgaaaagaacatatccaaaaaaacaaacaaacaaaacaaaacagaaaaactcaggtctttatatctctccaagtctattctccaataatagtatactagtaagcttgatttagaattgcctctgtgtccttgccagtttacatcttggaagcttgtttctattcatttcataagccacaacgtatttgatcatttctaacattcacaattttcacattaaaattgatgatgtgttatagtttaatagcagtaatcgtctttctcagtggtatataaaataattgtgcatcttgcagtcattggcccattcaattcaaagtcaaagtggtaattgctttgtgccttctgctatgggcagcaggaggatgccctttggagctgagaaggatggagtgaaatggtcctgtccactccctgccttcactctccacccgagccagccttagcggtcttcctgaggtggcagatggaggagccacagtcctctcatgaaatgtcaggagcagagcatcaagggctctggcaggagctcagatcctcttatcccaaagttttgcaagccctaagagggctgaggaaagcaagaacccagtggactcgtaaaacacaaacccctctcttcacagagggtcgccttgtgtcgttgagggttctggttgcatgcagcaggcatcatctctggtgggacttactggaaggaaatctggtgctgacaacgcctctagtgggatttattggaaggaaatctggtactcacagaatcaacaggaggcagaaggaacaggtttgaaaaagcgtggggaccgagggagctctggaacactgggcctctggaacaatcttgccaggatgttgggcgtcactgctgctactgcgttttcctccaaaatgaatcctaacttttttctcagctctgactccaaggatccaaagacaaagcctgagttaggagcgaccagtctgactccccagatcctgtctgtgccctggccaccaggagatgaacagcaggaaactctttccccctgggcttcgagagaggaaagtaggatccagcatatcaccaatccggattgctgcaaagggaatatgccccagacagaaaggggttttgcattatactgtattgccaaacactgacaaatgttccactgcactccccttcaaatacctcacatttgtaaggctatcaaaacaagtcagcgagcagaggactgctgcatactaaaactgtctacgtcggcttcattcagagccatggactagtggaggaaacgaactcttctggagctcaggcaaagggtcgagcctcgtgctgagtgtgttatctgtgattgctgcataatatgtagttactcattcttagacctctgaaaatcttaagggaggaagacagtggttaccaaagatttttccaaccaggaggaatgaatgtggcaactggagacagcagaatatgggtattaaataaaataatgtatctaaaagatgccattgtttagaaattagccccttggattgacaggtaattaacttctgccactagtttaatttcttgtgtggacctggataagggaagccatacatgggtggtaattttattccctccaatctcaaaggaaacgtaactgggtatgaagtagtggcacaactcatatatcagtagtctgtagcaggtctacataaatccttttctttaaagttatttaactgttttgaaaatggtttcaacagaagtaattccaactgcaccagaaaggaaaccagagttttaaagaaaaatatactctctttgctgagcaaggcaaacatatcagtatgcagagaaacaaaccagtctcttgtgttttatttcctttgcaaatccaccaaaacacttactttatgtctttaaaaggctgatagacaaagaattctgtgaccactaaaaattaatacctacaactggtttgtagacactttaaaagggcaggtactattttttaaatttctctgtttttcacagtttctcattatgggactttgtacatactataaacacaatacatatttgttgtgagtgtttttttagaccgatcaaaaacatattctctggggaagcattttccattcaaggaattagataacctgctatttcctcacatgcttctatgcataaacctagacattgtatcacaaacctagtcctttttatagccaagcccttcacagaataatatttttccaataagctcgtagtggcatttttggtcatggtgtttcttttttgactcttctgagaattaatgtttaaaataaacacccttatagctgtgaaagatgagaacttgttactatttaagctgactaattcaaagtcatttggtaaaactactttcagttttaagaactagaagatttaagtgctcaaactagatggctctaataaatgcacaattattatctatagtcagtataactaattatcagtgaatccagaccttgatccattactcccctcacgtccatggattgagaagcaagaatctatttgttattagtcttatttcctccaaggtcttcacacaactcactcccttaactccattaagtttttgctcacatgtcacctcattgtggccttggtggaccttttcactctgttttaaattgagactctcccactcttgaccagaatgcctaatctctctttcctattttgtattttcccccatagcatttgtctgacacagtatatattttgtttttttatttgtttttggtttctctccactggaatggaagctccatgagcacagagattattttgtctgtcttgttccctggtgtgtgcccagcacctggcacatagtaagtgctcagtcaatatttgttagactctaaggcaatgtttgttttgaagatttatgcttaagtatgttcccaatgaccttgatggtttaaaaagcaattttgtattggttattttacttagttattcttacaacaacgtgttttaaggaaggattattatcccactccagcagatgagaaatgggggctcagagagttcctatgaattggataaaacccaggggccagcaagtggtggactccagcctggaacaagatcaaatacttcctttagggtgctgctctcacctaagctgtgaatctttctggctgggggaattaacacttcatattaagcattgccggccaggtctcaaagcagtggattccagaatgaaaattagaacagaatgtggttgtagaatacctgataaataaaataatccattatgtacagctctcaagggtgagaagcataccttctcagctacaacttgtatttgttcacctcctgagtgtggaagaacaatccatgttgaggccatgcaagtccacctcaaaaagtccctgcaaagcctccttaccttgcaatagaacattgcagctgcttgtatttcagtcctttctccatggcatttctatttcacatcatgctgtggttcaggaggcagtttgcatagtggttaaagatcacagaccccaaaacaggcagagccagacagaacttgaagcgggatgtggttgcagttccttcgggggaaattattctgtcttctcatctgtaaaactgggctaatggtactaagttctgataaataaattagattatacaagtgatgcactcatcactgccttaagtgttagtgaatatctcctgtatcccttctactaaattgtaagattgtagaaggaaatgcacttactggctttattagttttcaagttttgctataacaaaataccacaaactggctgtttaaacaacagaaatgtaatgcctcacagttctggaggctaggatctgagatcaagaagtctgtgggcttggttccttctgaggactgtgaggaagaatctgttctcctaacttccggtggttttctggcactctttggtgttccttggcttgtaaaagcatcaggccgatctttgccttcatctccacatggtgttcttcctatgtttgtgtgtctgcatccaatttcccctttttataatggcaccagtcatgttggattaggtgccctactccattataacctcatttgaactaattatatctgcagtgaccctattttcaaataaggccacattctgaggtactggggtttattacttcaacatatgaattttggggacacagttcaacccatagttctggccttatcacctttgttttttgttgtatttgccctgtacttaataagtggcagggcatggctgctgaatctgttaaagaaatgtctccagaaggttcagaaataaagccacttaccaacagctgagaggccttttgaaaactgcctcttcatccaaggattactgaaagaggaaacttctctctagctagttcttcactagactttgtgtttagtccttgggtcaggaagatacgtcatgtcgagatggatattttgattaggactttccaaatggaattttgtgtgtgtgtgtgaagagatagcattaatatgttcacatacggataaggacatagatatgctatttataacttaacttttaaaagatttatttgtttaaaagtctaggtaacagtgttcttttcaaaattttaggtgcgacttttcatctcataactgtgacctcaggtttgtgtgaataataaatgtcagttctttaaaatgttttacatcctttcttatatatgtataatgtggttataaagtagtgagcttggctccacagtctacctgcatgcctatagagtatgatatttcaattaaaattcatgttttcaaaattctaatatctaaattgcaatgctatattttacatatctgtatttttaaaattgatattcctaccacaaatcacttgcttaatattagttagaattctgtaagttgcttacttagaattttgtaagttacttatttatttgagcatttaagtgtgcatttataatgtattctaagtgattggtgctgaaattttgagttgataaatctcaggatttattgtgatggaaacgggactatctacagagcttgagattttataggtctgtaaatatttgttgaatgagcgaacatatggggtggaggaagaagcaaagtcatttcttttcaactctctttgaaccaatgaaatcaataacctacatggagtacaataccatatttaaagactgaaagcaaattttaattttttatgtcgttttattttctataatttggattttcttgtgacaccttgacactcccttaaaccttctacactgtgcctgatgctttcaaacactatataatggaaggggcctctaggaaaggcaagttgagagtagaggaaaaatgagcatacatttgcatagggcaggaagggcactgtaacatctggcaggggtagccaactcagtcgacttgttagtctcattaaattcacattaatgcatgaactgctctgaatgtgtaaataccattttgagttgttttctcccagaccaatggcattgactttgggggcccttcccttggttgtttacttgccaatggcatttgacctggggtcagacctgtatttaaccctttcctgtaggtcaaaaacaaattaatttggtgagaattaaattggaaatgagtcatctgtacaacaggtgttccctgtgggaaatgtgctccaggtggaaacattttaaaatctgttcctgggccatcttcgaagaagcttcagaggtcagggaggcaattccaagacatcccacgtggtgagggcctggagctggatgtacaggtgcccattcagtatggttttctcaacagcttggggaaattttcaaagaggccccttttggagataatttattcataaattcatgaacatttatcttgggcattcattgtggactgatttacttagatgttgccctaaatgattggaactttaccctttacccctacctcccactatcaaccaaagactttgatttggaggaaagaaaatattgtatttttctctttcttttttctagaggatgaggaagatgaggaaatggtggaatctaaagttggccaggactcagaactggaaaatcaggacaaaaaacaggaagtgaaggaaggtatgatatggaaaataaactgagtaatcattttattgttttgttttgtttgcctttactaatataagagactatagagctaagtaaaaattgaatttgcatcccctatatggaagattttctatgattgttcaatacattacatttagcaacataaactgtaatctccaaagcaagagtcatttatttcttgactgataaaggcaaataaagtgcaaaacgtccacaatttcagtaacaattttagtcacaattccagaacacttgttaccaattgccatgttatctcattcacagaaccatatattcccaatgataacagtaaagcaaaggactagatataattattttgtgaataaattctaaagtgttttcatgtgatctacatagaaacattaatagtgatcaacgctagtaactctgctattaaaatttttcttctgcaactctgcctgtataaggaggaacaacctcttacatgttctggtgataataataactaacatttattaagggctcactatgcccttggctctcttctaagcactccacagatattactcactccttacaacatcattttgaagcagatactgttattacccctatttataggcagagaactaggaagagagaggtctaaaactttatccaaggatacataatgtacaagtacatgagccaagatttagagttaaatccaaagtttacattttaccctgttgccctcctcataatagcactgtgcctgtaagtagaaagaaagaaaaaagaaaagaaaaggagggacatgaaatactgcaggtgacatttccttacaaacccaattttgtattactttgagattctcagcccatggagacagaagagaattttgaacttgtcttacttgctggcaaataaatgaagagcgggacctaagaactgtgtagattaaaaaggttcttccatatttcctaatgagtgtcccaagtatagatcaatataactctgattagaagctcatttgatctgtaaattttaaagatggttgtggctctggcacagtgtggcagatgttcagcactggggtctttgtaggaattgatacctactgatcccaagtactcacttcaacaccttgtgctctcatgagaaaattagagaagcccaaatgcctattacaaatgacatccatatcatatggagttaaatgggacaatttttttttttttgagacagagtctcactctgtcccaggctgcagtgcagcgacgtgatctcagctcactgcaacctctgcctcccaggttcaagctattctcctgccttagcatcccgagtagctgagattacaggtgtgtgccaccatgcctggctaatttttgtatttgtagtagagacggggtttcaccatactggccaggctggtctcgaactcctgacctcgtgatccacccgccttagcctcccaaagtgctgggattataggcgtgaaccaccacgcccagccacaattttagaaaattattaaaaatcacttcatattgaggctcatttgaagtgtgtctgagtgtaggtgtttaatttagttttggtttgttttttgcaatctcaggtatctaaaggccagtgcaagatagtaatgaaaaagcatagcctctggagccacactacctgggataaaatcttgtctctgtcaattattagctgagtgatcactacagactaagttagtttaacctttttttgcctcagtttccccatctggcaaacaggtttttaaaaaactcaacagggctagtatggaacaatacttggcacaaagtaagtgctgtataaaagtttgctaaattatcattagtagtcttgccttgcagtgcctgggtctataactggtttctaccctgatgggatggatgcccttgggggccccagctctctgtgctcagctttgccatagcccatagctttgaaatgagaacatggttacaggggccccagctagctagtacatttaaaaaatgtggaactttcaatagagatgcaagcaaagtcctttaaacttgttggagaactatcattaaaggtcttatttctgttactgtgctaggtctcagacattgagaagttcaatcgttgtcaagttctagggtgtgactaaggtttaggagaagattcagcattttaacagtggcatccacagaagacacaaggcttactctttctgagagtctaaatgaatttgatcgaagagatctcacatttaaacttatactaaaaacgtcttttaaaaaaaaagttggtgagtagaatatcatgattacaggtgtagtgaggtacaaaataagtcaggatctattaaagtactcctttaccctttgcaaaatattcttaaaatacacctggtgataaggagccagggtatattttgtgtgtcttggcatggattccccatcaccaccaccccagccccaatctccaagtcgtcttctccagcaaagcaaagcaacctccttcttaagttccaagcgaaaacacccttcagttttaactgttactcgtgcttcatggaattgattaaagtcatgttaaaagtcaaaaagaagtttgaaagaacatttcctgttcctgctgcactgtatgccttattctccattaatggcttttctgcaaattaacacataatgggttaaaaggatgtttatgttggcatcaaactctggctttttttttttttaaagcaagacagtattttgcaaacttttgaaagaatctctagcagatataatcgtggcgccattcacacgactgcatagtagttagggctgtgtcagcacttccattacgaaccttgcgtttcaaggatttattactcagccataaagatttgctctgggctgaaacttgacatacacagtttcaaaccagggaacacatttttgagaaatctggcttttttttttttttttttttttttttggagtgaaaaggaagaaaaaggtggtgagggggacatggggaaaataatcagtactcactaacttttgacatttttgcccacgtgacatcaaagtgcattaaacactaaagaaatgcagtcttgatttattactgtttcacttttttctgccatagagtaggaaaaaaatcaggtatattttagcttataatcaaagtttagaaaacttctatatgtcagtgtcctcatgtcttcatgtttagaaattcaaaacaatacaactgggaacctaacatttttgtaaatacaaatcaactcataaacctcacattgacgtcaaagaaagatgtccttcacttttagtttggtttggtttcttgctgctgtttatgaactgatttcactgtaaaattcccatgagagccactgtccttatttaatctaatgtttttcctggctacatgggttttattttttatctcttagagatccttgaaaaatatttttgaataatttttatattgaaatttaaagcagcatcactgaaacaagtcaggacatatttgtagtagatatttttaaaatatcttttaacagaaatgagatactaaaaaactcagtataagttgtgaacttcattataaattgtacatttttatagagggaaaaaaatcacaagaaggcagaacccaaaagatatagtttaaagtagtataaattaattaaagagaaactgacaaagtatacattgaggatagcaggaaaggtcaagaaaacacggcaaatgaaatacaatcatgcttgaaagatttatttaaaagtattttcatataaaaaataagaaaaattaacatttctacaataaaaagtggaccctaagtgaaatttatattctattgtaattttgcaggccacaaatttgtagaattaggctgtcttctgaatttcatgtattctgtaaaatttctttcatacatgttattcaaattcaatataactggttaaattttggtaactttgaaaattgtcttatcatttggattacatgtaagttacatccatgcattctacttttcatagtgtagaatctacttcttcttaaagagctctttaaatgcacaaagtattgttagctgccagttcttggcagaaacactccatgttttgtgttgtgaaaacaaagaaaaaaaatctgctataatagtattttctgcttaacctataagaaaaactattatccatgcccacattttgttttggtatgccctttgctattaaatcctatctttttaatgccatgaacttgttaaaaataatttattagattccagggatagggaaaagctgtagaaacagatacttgaggtagaatatggcatctatcttggagtaaaacaattctgattctatttgtttattcctgtattttgaactttgtggaatccattaatcaaccaattttctttcatgaaatatgatgcctggagaggtttttatctctgaatacaccttttggttgtggttcctggatactccattatgttttcatgatattgaacaacacttatcaatttaaagatctttgagtatgggtggttttgtttatttaatcaaaaattactatggccctatttaattaagttgaatattgtttatgacttttaaaaagtactcatctgcacatgcatctgattattttgtgctaacaaatcatgtcatttgatccctgtttgacatcaaagcttaatataaaatgtatcttttgtttgcttctgtagcattttaatttcaagccaaatattgtattgtcaatcataatatctggagaggctagtgctccacctacctgaacttggcctctgcaagcacactttgatcagccatttatgtttctgttagagaagaagttgtgtgtcttgaaagctgagatcaaagtgacaataagctacagggaagaaaaaaattacagaaaattacatagataccattttttattcaaggtaatggacctgtaaggaaagatacaggtgaaatagaagtggctcaaaaagataaacagagactagaaagattttttaatatcttaaaaaataaaggagaaaaattcctactactttgtttaatttcaagtgtgtctcaagtcatctattaacagtgaccaaggccaagtgagtctttttgaataagacattcttcttggcctatagtattcttgtttagtcaggtttattcatttatgtaacagcattaaccaaaacaaaatggacttagtagggtttgttccccttttgcctagttccattttgtagttttattatattctggagtgaaataattcaaatgtctcatttacaggagttttagaaagcagactagtaaattgctacttcattagtaattattgaagcccagcatatttagctttaattcttaaaccagacttaaagtttaggtatcatccccatttcatagataaaactactgctcaaagagcttcagtgcattgattaactaatcaaatctagcatatggcagggtgcttgattgcaggttggtgtcgtagagttctttgtgttatttatgacctccacctatttccccactacctagcctaagtctgagtgtgcatattgtctgattcagcatttcacaaactagtgtctcagcagcactgctcagtagaagttaatggggtccttggaaagtctcagtacacactggaatatttagggctctggagacctagacagcaaagaaatatttctaattttatttagggctgctagaaactatgaggtggggtgtgttaggagaaattcttctgctataatggatgaatcacgtgttgccctaatattacctggagagcatttcttaaggtgtgaaccaactacatcaggatcattctagtttcttgtacaaatagagattctcgtgtttctccagaccccctgcctcatggtctggggcagggaaggggaggctagaaagagggagatgttacgaacattggatccactgccatgacttgactctgtagaagggcttcttgacactacagatttcttaggcttcaagatacaattagtccaattatgtaacactttcataaaatattgtgctacaggtgatagtacctaaaagattcttctgaccatgtggccaggtggaaatcgattttgttgttaggatggttgtggaagtgcttggaaaaccctgtaggtgagtgattccaccagaggctccacctgtgattgtaatgcactaccctcctcctgtaagtttaacttcaggagcttctgtactacttactgaaagagtaaccaatgaaaggtttattgtaggctctctccaccagagttgaactagggttcctgaagaaccacaaaggttcagctgacagtttctgcccttgatggttttttggtctggggagttcctaatcccttccctaaggttttatgtaaaactctcaattgaaggaatggtttatgtaaccaaatggtgactctaaggtgagctcactttcagaaactatgacatgctactagttatttgatctctttgtctcattttttatcttcaaatttagtttgataagattaatcataccagaaaagtaaggcagaaaaacaattgtgggttgttttatagaagcatgtatttgttccatgtgtttgtttaaaagcagaagatcttgagtgaaagcaggtttggaatgatatatctctgcttttgaatataatttatataacaatcagtcagccttaccaactaaccatttaaaataaaatgaatttatgaatttactcagtagaaaaaggaaaggtactatgaggatcatattatagagtgttcctaattatttaatattgccagcttgacaatagtacaatagcataatagcatatataaatacatagttttgtgaatttatctattatgccatatttaagctgtttttcaagttaaaaaaaacatttagaactgattgctaaaaacacaccaatctatttttatttgtaatcttcttcaactcttcaaaataataattagaccaaatatgcaatctttttgtggggacatctgcagaagcctttggtgtgaatttgtaaataatttagaatcaatattagcaatgatttgtttcactgtgtcttgccactcgtttgataagcagtctctctcaagaattgggttcctcttgataagttttaattgtcactttttcttccctaacaatctcttttacaaaaaaataaataaataaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatgggttagtctcttgtgtgcattctttaaaaaatagcgtaagttatctgttaattctaatttatttatgttctgactaggaaaattccaaattaagaaatcagaggagggtgaaattttggaattgatcttgctgaacagctttgactatgggctttggtgataacttctggcttagagcgtccttgtaattatcatgtgcttctgtgaaatgcttttgaacttggtatctggggaacagtccaggtgatagagactggcagagtcacatgcattatcctctgagaaaacattcttttgagcagcaaaggagattcatgttgtatctactagatttattcctgatgtccaagcaaataggaaattgaagaaaataaacatgaggtgtgggagaagttaactgatgtgtgtaatgatgaacagagactggaaaatgtttcctttttttggtatcatgaaagtatgcatatgtgtatatgccttttaggaaacatattaatatatgtaagaatatatttccaggcaaaacaaaactaatcaataaaagcaagtgtccctaaatgacttcctctgtgactgtagcataggtattagaaaaggccatgactgtcaaccatcatcctggggagaataggagggactatatgagccttataaacataaatatagctgttcttagccacagatctcttttggccaagaatgatatgtgaaggtagggtcacttgcctttttcatcaggcctgattttttttgccatttctaaaatccaaatacattcttaaaggacgatatcttatcatcattgaggatgctcaagggaatgtaacagaggcatgaaaaccaatttcaaaagggagtcctgtacatgttctcaacagtaggcagcatctttagactaccttgaagaaacaacagtattttgaatatagatgctctacaatctttgtgtttttttgaaaagccatttttctatgactttcttgattttgttggtcctatttccctctgtgtgcctggctcagtattatcctaggctcctggcaggacgtgtgtgtgtgtgtgtgtgtgtgtgtgtgtgtgtgtgtgtatctcctgagtttgcaatggcggagctgaggaagggttaacagaaaaaaaaatgtcatattaggtttactaattagagcccaaataacttgttggaagccaggtcacccagtctgaacaagagccatataagttaagtgatgcagggcgcaagccagcagttgaagcaaatgaacagaggaaaggtgggtgtagaagaatttctgaaccaaagcccaagcaacttaggcagctttttatgcagatcccgtagttcctggtccagaacaaacattactcgatgtaaatactcagcttgtggagcagctgcataaccagcactgagttccttgaaggaggtgttatggccagttgagtgtcagccaagtaaacactggctaaagtgtaatcctcctagattcagatgctgttttggtccatggcagaagtgataagtatctggaacatatctggtgaatcctccactgtctaccacgcctgtctcatggtagaaattatcacttactattgagtgaggaggctactgctacagcctgtcagcatttacaagtaaataaaaacatgcatatcatttccggtctaaggacaaataaggtagtatcgatatcaaagaatcctctggtgtgctgtgctcccttgatagcagagatttctaataagccctgcttcaggccagagcctttcagggagaggctctggcctgaaccagggttggagaaagcttgggactggtcaagatgggaacttgaaacaaatctgacatttcataacagtcttggaacgacatggaaacccttgccaggtcaggttagaaagagcttttcataaagaagaccatctttagttcattaattttgatcagggtatgtagtctagattaacattttggcctcagagagtattgtgtgccaggcttttgccatatcagtgcttctatatgagcagcatagagaaagagctccatatttatctctgatgtttaaatcctcctagggatgttcaggctggagccaatctttctttcaatcgtcagttctatgatgaacattggtccaagcatcgagtggtcacttgtatggactggtccctccaggtaagaattattgctgggctgggacaaactgggcttgtgttctcgtggcatttgtataaaaaaataagagatttgtttacttgcctacgatttcctctctatgcctgttggtttttttcccctcattttattgaggtttcagtttcaattctctactcagttatttgtatttattgagtacctactatgtgctaggtaccaaacaagaagccagattgttctgtccatgaaactattccattaagattaccactgatttcctacttgtcaaatcctgtggatatttttaatcccacatctgtcctgacctttctttgtcaagcagcttagtcagcttccttgtgcctatagaaacatcctctttccattgaattctcactactcctctctactgtctcctagttctctgacttctccaggatttctttttcctctgaccatccttgaggtccctgtggtcatgctctcaacccctgctcttcttcctgaggtgctctctgcaggagatctcttccactgctaaggattcaaccacgaacagcctatttatatctcccgcccaatctccctgctgaatttcactttgtacaccagacagagccactattctaggtgtcccatagaatcttaaatgaattagtaactcattattttcatatatcccaaatccttttttacctgttatatgatctgtatgttaaaggcaccacaatatacccaaaagcctaaagcagaactttcatcaacattgccaacttcctcttctcttccagacccagtctgtcacgaagactttccatgtcttcactcatgtattcatcatctaatactattcttaaccttcaaactgatatttctaccttcatgcttgtccacatacagttttcccctggagaaatctacccaaacaatctttctaaaataaaaatctgatcactcggctgcgtgaggtggctcaagcctgtaatcccagcactttgggaggccaaggcgggtggatcgcttgaggtctggagtttgagaccagcctggataacatggtgaaaccccttctctactaaaaatgcaaaaagtagccgagtgtggtggcaaatgcctgtaatcccagctattcgggaggctgaggcaggagaattgcttgaacccaagaggcagaggttgccactgcactccagtctgggtgatgcagtgagactccatctcaaaaaacaaaaaacaaaaacctgatctcttcattccctagaccaaaactccccattgcccgtagaaaagaagtctaagcccatcagtgtggcattcagagtgaaagcaggcaaatttaccaaaagccaatttgctgaatggccaactcaactagttgacaatataccgggcactgagtaggtaagtaacatgcaaaggcacacagcctagtgtggtgacatcagaatttgaacctaagcatctgatgcctgagcccacattcttaacaacaatgttccttcctgcaataacactgacataagaacagtgagagaagcaggaatgattactcctaagcatttatgcacagcacagtttctgctttcttgttgtcaatgcttttattgggaataatagtcatagctagcttttaatttatttttcttatatacaaagcaccatgatagctgctatgaaggctttcttatttccccctcacaacaatcatatgaggcagccacccttactatttccatgacatatttgaagaagttgaggctcagagaagctaagtaacttgctgaaaaatcactcaactagggtatggtatagtggggatttataccaaagtattttagcatcccgtggcatatgctcttaaccactgcctctcacaaagagcttctggatctgaaactaaaagagcttgtaaaggtgcagaatgatatggggcagatagcaagtgctctcaaagttcagtggaggttggaatctgtctctggtcagacagagcttctcagaagactgggatttagacaaatggaggggagaagagggtgttctaggcagagctataaaatggtaagtcccaattaatcctattggagaacaggggaacaaaagaggggtgtaattccccacaactagaccctcatcagcaataaagtgggtgaatgttctctcctcttgaattcctttttgtatccaaacaacaaagcacacagtgagtgatcttgcagagacgaagacaagcagggtttgcccaaccactttccaccagtgtgtgggtggtctctgagcatgcttgagtgtgtgcacagaaatcagatccaagcctgaggaaacacttagctcagcttgttcacttgttcagagttggggaattacacaggaaccttatctgacacattcctcaaaggcaactacaaccttgttcccgggtcagctgataacactccctgaggaggcacggggtggggctggtcccgccttgcctcagtaggtgatgggccacattgcctgtggaggtgtttccacacagggtctcgcatgatgtttgtgttggaggaagtgaagttggaaataacagaaactctaccatggagagaccacatttattttcccctatttttgtgtgacctgcttacctacgctgtggggaagaggtttgcaattttgaaaaatgtgttgtatatgaggcgtaagaaaaagagattagaaccctcacctcctgcatcacaacactgttgaggggttcaaaggaccaggattacatacttatgggataaagagactttttgatggatttagatgcaatcgaatgatattaagaaagaagagagatagaggaacagtcttggtgtgcagtggtggcgtgtgtgtctaggatgatttcctgaatgtaacagaatagaactgagaggagaaaaagaaagaaattataaggtttcagcatagctttcctttgatctcctgggcttcttaaaccagaacactttaactttgaaatatttacaaaatatcatcaaacatcattccttggaagaaatctgggaagctggaggattatgtcaactttgtcacccattgaacattatttaacacagtcagtcaataatactatcacataccacgtgacagttttcagatgtgtgcagaatcagactcatgatcttactcccaccatgtatactcactcctctcacatgtacattgcatcttccactcctgcagtcatccaggatgcaaacctgagtaatctttggcaactcagttagttgctaaatccaatcaaatttacaacagcaaaaagattactattgacaccagtgccaatccacgaacatggatttgacacctactttatgtcatgccctctacttcttgcttatgttaggaaacagcgtcttactggtctccctactgtcagtctctataaggttaagtcagtataagtacttttacctggttaatctttgtaaagattacttatacactctgtatcaacttgggcaaattgcctaacttctcttggcttaagtttcttcattcatgaaatgataataatacctagctcacacacttattgtgagtgttaaatgaattaatgcatataaaggaatgataatttggctggacacagtggctcacacctgtaatcccaacactttgggaggccacagcaggaggatcacttgagcccaggagttcaagaccagcctgggcaacatggcaaaaccccatctctacaaaaaatacaaaaattggccaggcatggtggtgcatgcctgcagccccagctatgtgggaggctgaggtgggaggattgcttgagcctggaggcagaggttgcagtgagctaaggtctcatcactgcattcaaggctgggagacagatcaagaccctgtctttaaaataaaataaaataaaataaaataaaataaaaataaaggactaataattttaaaagtgtctggtgcataagaagtacttgataaatgtgacatagtagtgagaagagcagtagcagtattatcattagttgcaaagtgtgacttctattgtcccccagaataaaatctaaaatcattagcctgtgttcagtgacttccgtgatgatgccctgaggcatttccaggcctttcttcttttatacatcttgatatagcctgcctcctagccacatattaatactacaacctgatgtctattggacatattcttcttcactgtattggtcaaaaagacttcacctttggctaggttaagtagacagaggaatttactggggagccattatagtagttagggaattcatgaaaaagatgaagaactaaaacttagaaatattaggaatctgggcagcccgagggacctcaccaacaggctgctgtccttatccagacccctttgccagctcccaggtcctgtgtctcagttcaaagtttacaatattctggttagagaacgcctttggctcagctgggtcaagtatcaaccctgcaattaattaattatccctgggaagttaggcttctgttgactggggtaatctccaaagagagagattcacatgaaccaggcagataccaagaggggtctcctgcacccctctttggactcttgtccctgctgtcatctgtcctaataacctacccacttgacaaggctcaaggtctcatttcttctgagaaatccctttcaatttctcttcctgccacaccccacaccagcttccatgcttatttatttatttattttgagatggagtctcactctgtcaccctagctggagtgcagtggcatgatctccccttactgcaacctctgccttctgggttcaagcgttctcgtgcctccccatcccgagtagctgggattacaggagcaagccaccagggctggttaatttttgtatttttagtagagacggggtttcaccgtgttagccaggctggtcttgaactcctgacctcaggtgatccaccctcctcggcctcccaaagtgctgggattacaggcatgagctagcatacctggccccatgcttctacagaaccttgcttctgcctctgtcttagcacttgtcatggtctgcttttttatttgtcttgtagttacttctacgtgtgtcttacctccctccatctaatgataagttcctatagagaagagcctattattcagggcattcatgtcacatattttacctgtcatggtgccttacatatttataggggacacttgaggcatgccacagcagacaggaaaggagaaggcttttgaagcccaacagactttaagtggggttcttgctttatcacttattagcaacatagcatggaatatgttatttaacccaggactctgggtttctttgtctgtggaaatgagtaaaccattgcctaccttagagggttatgaggaccaaatgaattaacatatcagtgtctggttcataacgggcacttaaaacatgatggttccttcctctccagtaaatgctaggttcttttttttttgacggagtcttactgtgtcacccagactggagtgcagtggtgcactcttagctcactgcaaccttcacctcctgggttcaagcaattctcctgcctcagcctcccgagtagctgggattacaggcacacacaacctggctaatttttgtatttttagtagagaaggggtttcaccatgttggcaaggctggtctcaaactcctgacctcaagtgatctgctggcctcaacctctgtgttggaggcctcaacctctgccggcctcagccactgcgccccaactaggtttcatttatttgttagaaaaaaaatggggttgagagcatatctggtaatttccaggtaaaattctcctagggtaagtattggataattcagctctatgagtaaccaaatgatcatgaatttcataattctttatattctctttaaaaacataacttcgaacaacacttaagattaaataattgtttagagattttttattggaaaaagaaaatatgactagtcatgttcaaacaaacagtggaaaaagacatactagagggcaccttgaaatcccaaaaacttgcgtgagataaaatttaaatcagtatctttaggccttatgatctcagttatagaaattatgccaatgacatttcactggtaattttactaaagcactccctgttttctaaaggagttttaaagctaaataattttaaatatttttaaatggaaaaagaaaagctgcaagtgggtaccaacaatgagacccagctgggtgatattattgcagaaacatctagctgctccttagcccctgtggtggtggtgttgatgtttatagagttgccttttcacatgtgacatagttaaacttcagatggacagtctggagacttctgtgtttatctggatgttagtttctttgaatgggctttgaatcaaaggctttcttaataggcctttgattcatccgctgcagagtgttttttaataaagaatgattacttcccctggtggccacatacatgtgtgtcactgtacgcttatacttcctctgcacaaccagcacattgtaactctctgcagatttctttagttgaggctgctggaagaatgaataagacttagatgtagttatttttaatagaaaaaaaagatctgtgttcaaattcataaaggcaatcttccattaaatatatgtatagaataatgaaaaaggaggaaaaaattaaattataagaagagagtgatacggtctgccataatcctgatactatttttaataggactgccttttgagactcctatgtaggaatgacattttcatgaaatgtgtcctaactcataagtacttcctatgagatttatcctcagtttatttagtaacactcaggacagagtttttgtagggtgagtaggtctttctaatacctagaatcactatagagtccttcttgttattttactggttatgtttctggcatttaagcctttaattattagcattgtttgacaacaaaggatgatatataaagcctttctattgagcacagaattactaaaattaaaaattttaaataattaaagaaattttggcacaagtttattatatgctaggaattgaccctggattcagaggtcaacaaaaaccagtccctactctcaaagagcttgcaatcgagtgaaagacacaggtgtagaaaaaaaattataatgcatttgacaagggctttaattggcaggacagacacatgatacaaagggagctgataacaggcaaggaaggaagtggttggttaagtcaggattgtctggaggacttgatgcctgtgttgagtcttaaaggatgagttaattatgtaaacaacaccaaagggtcatcccagtgagagtgagtatgagactcataggtacagagatgtacctgtgtgcctcaaaactagtccagtgaggctgggtcataggctgtgggaggtggggagaaagagggaaggttgtaggagagtaagcaggaaaggcaaaaaatgacagattattaaggatcctctgtgacctgcattttgccttgaaagtaatgatgagccattaaagtattttaagctgaggaatgacttagccaaatacatattttgtaaagtcttcctgataaaggatggagaatggagtaggtcagtataggaagccatttatgaagctgctgccttcatccagataagaaattaatttagcaggctctgaccttaaagatagaaagaaaatattcatttgaaaggtattgaggaaatagggaaatttagtgtgtgggagtgagagagagaaagaagtaaaaataaatgggccaggcatggtggctcacgcctgtaatcccagcactttgagaggccgaggctggtggatcacgaggtcaggagatcgagaccatcctggctaacacggtgaaaccccgtctctactaaaaatacaaaaaattagccaggcgtggtggccggcgcctgtagtcccagctactcaggaggctgaggcaggagaatggcgtgaacccctgaggtggagcttgtagtgagccaagatcaggccactgcactccagcctgggcaacagagcgagactccatctcaaaaaataaataaataaataaataaataaataaataaataatgtagaatggctggcctgggccaggcgaatgttagtgcaagaccctaaaatagggaacatggaggagcagtaggtttcgtgtggaagtcaatgagatcatttttctatgtgttacaattgatgggtctatggacagccctgagaaatccccagtaggcagtcagatataaagacctgcatctcagagagaaattaagcctagagatatagatttgaaaattaccagcatgttaagcttattaaagccactggagtagatgaacttactcagcgagaatagccctccttggaatttatgtaatagaaggagaacctgcaggaactgaaaagagaagtcagggaagaaaatcaggagagaaagatgtaatggaagccaatacaggagaggaagggagtagcacaaagtgtcaaataatacggagaggtaaagcgatgtttgtagtttgatagttaccggtgagtatgacaagcgcatacagagtgttggaggcagaaacaagattgcaggaggttgcagcagtaagctgatagtaggtatgccacaacataacagaaagcaccatttacactgtgtagtataccacgtgtatgtaggaataacaaagttttccttgtgttgtcatcttagcataattcatccttgtgacctcttccatttagtaccctgagctgatggtggcttcttacaacaacaatgaagatgctccccatgaaccagatggagtggccttggtttggaacatgaagtttaagaaaaccacaccagaatacgtcttccactgtcaggtaggagtcagcgtagtaaaaataacttacatctcctgctagaccaaatatagtttgtgctgcattgcatctgtcttatgctgagaggaagaactcagtttaaaaatgaaattgttgacaattttggaaaattcccccacagtaacctaatgttttgggaaagtggcaaccctccccaaacagttaggaagcttggttagggactgtgtgtcattttctttctatttaaaacagcccccatgaggatgagtttataaagacctcgcacttatgaagaaatcgtggtgtaccacttcctctgcttaaaagcaacatatgcttgcccacccacgtggacatcctcagagcactaccatttcaagtctcctactctcttggaaatgcagttcaatggattttgctgactttaagtttatgggcgccatactacttaacagataatacttttgtagctggcatggggcaagacttaccactcgtatttcttgagttgctgggaaatatagatgctgtttctggtttgaaaatgcagagataatttcaaatatgtttgtatttttcattccttctctctgcggacacgtcttctcttccccttgacacaatacaggctgaaattatggtacccttgtacacgttcagcattgctctgttgccatgactctgcctaaataataggcctcagcataggccaatacaccaacccctttattaatgctcctatcctgtgattatgcacaggcaaataaaaaacaaacatttcagctcaaaattgcagttcctcaaatgttaacaattcagaggtactgagtggcagattactctgaatacaaagacatcatttgaagagggtgggtaaacctgttgatttttggaagcttagtgccattttctatctaagagccaagtatctttttgaactaaaatatgtttagactttagagcattatcagatataatttggggaataggagctgctggaatagagtcccagcctcaacctgattgagtaacctctaactctggccatgtttttctaatttgctgtctcaaaaacaacttaacaagaagtctagttctgtatggtaaataacctttattttcttagcctttgaaataagaacggttctttctttttttcttttattttttttaagattttcaagtcagcttgatatgctccttctgtaaacatagaagcacaaaatcctaattttgttcagttttacaaggtttgccgaattcccaggaaaatactgtaaggattaagaaataaagagaagcacatttttgaaaaacagtgccttttaaattattttgatattacagaaagtctttgattttaaaaatccaacaataatacattattataatcaatatgtatgatctttatcatgatttttaaattttaattatattaactgactacaggtttctggaatcaactgtaaattacttgttttaccacacaacaatagttaatactagtattaattgaaaagggcattcttgtgtgtgtgtgtgtgtgtgtgtgtgtgtgtgtgtgtgtgtatctttgggatcattgactaaacatttctccaacaaacattttttttagtttctcccttaatgatccaatatatgtcattgagaagaaaatatactcgtgattttaaaaaaaaagcaagaggtaccctaaatatagtaacaagatagtcataccagagttaccaaaagatgctgagtaaaatagttgattccaaaaacttgtagtcagcactttgatacaggtgatactcatgaagttgggataaaggtcaggtaaatatcactggctgccaaagaaaaacaaaattgctatgatatttagtatttctgaactgttgggagacaaaatcaggaaactttcagcagccagggaagtcctagatgaaatagtgatggaggttaggtagacagataacataataaaggcaatttggttacctttgtactaaagtgtaatacctgtagcaatatctacgtgtttctgtattttaaattttcccaacacttctgccttcatgatctcattgattgtacaacagggaggtaagaaaaatgttattattctctttttccagttgagagattttatactttagaggttacccagctagtgagcagtagagccaatcctggaactgaggcttattctatcgcatacatcgtgccatcacctaggctgcattctaaaaatgtgggcagacatgggacttgatagcaaaggctgtacagcccattcaaggtatatttttggccacctacccttataaggtatcgattagacatggttctagacgtggctatctttaccaccttctaaccctaaatggaaatttagagatcccacagaattaaaatgtatatgtggaaaaaccaaagccttcactcactgacctataacttttcttctatcctatctgatctttgctaaatcttatttattacaactggtcatttctagacactaactcagggaaatcacgtcgtttgaatgtgcttccgcattctcctgtgatgttctgataatttcaaaattagacaattcattacttagaaaaagggcagaggtagagagtagcaagagtaccttatgatgactgtacttttataattttggagtaattgcgtagctattcatttcctgctgatctctgctgattcttcatattttttaaaagtgtataattgtaaacaaaaccaatggatcagagaagcattgtgtcagtcagtggaaagcaaatgcacaagaaacagacatcagctccatggtgttttgtaaagactgacaagctttttgcctactcataaaaagattttagtatatagtttcatttctctctgttatggatagcaaggccaaaaagtatcttctactgtcacaggcagtttttgtgtctttactaaactgaatttttagtgtgatctctggtcctgcattttctatttttatttcaataaaagctgtctgtacttggaaaatattggtggaccctgcatagaaatcagccactcagccccataacacactctggcagtgctcctgctgtcttctgtagtggcttccacacactgtcattagattatgtgtctgaccaccctgcattgcttaccctggtgtggtctttctcttttaaatggaatgaatagaatcagaaatatataccttagaattatctgcgttgaggtaaatgtaaaagctatgtttagagtcttagcttggtcagaggtttttatttttacttttactttttggtgatttggtttctttgttcttggcaatctcttttagaggtggacctgacaatgacctgaagctgacaatcacctgaaaccctcactatgtcagggcaaagcagagtgtgaagtggggtaatatcagctaacctcgtttgtgtcagtgtttaaagccctcagtctttattccttcatgggctttgcttcccgttaagattctataaagggtacagatgtcattgctgcacacggcctcagctgcccagtgtttgattctgtatgacgttcctgctaacctcaaagagagttccgcctgtgaagagtgatggtaacagaggagggagtgtgggctggtggttaggacagggacagaaagttaggactcggagttccattcctagctgactgcactgctgagtgaccctgggtgagtcatgggggctttattgttgtgtttcctgatcccatgcaaagaagactttctctagtctctggttcaattgtaaagtttatttcagtaaacctcatttcttcctccatcaatttttgtccctcccccaacccagattgtggtctgtaatccaaatctacaaaacggctgtggacacagagatataaattaattgacattaactttgtaaagtatattttgaccagagaagtgttagaatctccttaaggatttttatttatttttttaaatgaaaagaatagtaacttgcttatggcccatctgataaaaagaaaagggcatcttctaagcttttctcttggctaggctaagaagtggttattacaggtcaaaaaagaaaaacagataaaagaacagaaagttctttgacaattactgcttcatatttagtatgaattcctgggattcaaaatgaaagcacatagtaggtgctttataattgccaaataaactccatggctaagaatatgaaaaccagagtgagacccaaacagttttcaaatgtgatattcaaagtgcctcaggatgggaaaacagaagaggaaacctcaaccagtgttacattgattatcatacacattttgaagaataaaatcatggaaaatttaaacttaacttttgacataaaggtaaaattaaactcttacataaaagatacaacttacatggatcagaccagagaaatagtgccacaacattgctactttgtgcctttcggaaaaggcataagggaataccagtatacatggtgaaatgaaatgcagacatcccaaaacacttcttttctgccaattgagaatgaccgatccgatgagctagacagtgattcttattaaatcaaacagcaggaatttcattttgctttgcccaggaagctggaagcagaaaacctgcccctccagctttcattctttatctaccctcctctagagtcttctccaaaaagcaactcatgaagaagcagaagtgatcactgggacacatctggggaagttagaattatcagctggattctagcaaagagattgtattgtaggtgattcctcatctgaaaacagcaatgaaggagattatttctatacctcatggagtatgcgagggaccaagtgagctatttgatgaagaggataccatgagaatacacctttaaacaagttgttttaaaatcgttttatttgtcttgccatgacacattgcaagtgatcaagctaaagtttcatatcattacaaaaactagcctcttactagcatttgctgcatcccgttaatgtgcacacatgttgtcaacacagaactccagctgattctatccagttccctaaatgcccttcccttctctccccatccactgtgctacaaccatctgaaccaggctttctccactgtgcttcattcaggaagtatcctgggaattatggatgctgtgcagtgagagccagattgcaatatgagcacgtttgctgtcttgtccctcccttccctgcaatacccacccacctccagccattcactgaggtgagagaagccttggtctcaggaagatgggtgttctgaggggtctgggttgaagatggatgggattctaactacctcttaagattataataaggataatagaaacaatatagttatattagcctgctcaggctgctacaacaaaataacattgactgggcggtttataaacaacagaaatttatttttcactgttttggagtctgagaagtccacagtcaaggaggcagcaaatactgagctaaaatgagatcagtattttaataactggtaaggttatactgtgtgcgtagccttacacataatgtaatctgtgagagctctcttcttggcttgcagatggccactgtcttgttgtgtcttcacatggtggatggagacagtgagctctctgatgtctcttataaggacactaatcctatcctatcaggtccctaccgttatgacctcataaccttcattacctccttctggtccctatttccaaatacagtcacattgagggtgggggcttcaacatatgaatttggtcgtggtgggggaagtacaattcagtccatagtaattggtgaacttgctttgaaatgataaaagtattctctttacatctgtttgttttactattattgcatgatagtcacgtgggaagaagcttaaaccttggcatttttatttttcttgctaggatatattcctgaagaaatttcacctaacttagattcattcattgacccattcatttgttcattcattcaacaattattttggaggtacccaccatggccaggccctcacagcagtgataggctggaggtgagaccctctccacaagagcccttcagttttccccaaccccaaccatgcttaattttccatcacctgactggctcctctcaattatttctattgcctaggccctgttcacattggtcaaatttatatgtgtgttctttatattaaaatgccagttgatagagggaaactgagacaattccaaagttctctcatcccaactatttaaccatttgttttctaactaaatgatgatgaggtattttctgagttctgggaggaagttaagtacatagtggttaagagtgagctataaggccacacagcctggaattataatttggattctaccacttagaatctctgtgaccttgagcaagtcaaatggttgttatgaaactataataaataaataaatgtgatgtatttagtgacaggcccatagtaagtacccagtgagtgtcagcaataattattattgaatatacaagaatgaaattcaaaatatgtagcaatctttgtgtattgtccaaatagcatggatgtgacctccctccttagttgctgaatggggggttgtgactgaggggttctccagggaggtaccaattcattcaggcaacaggagagtgctggggacaggtagagaagggcatcttaccaatgagtacaaaataagctcagcattttttttttggttttggtttttttttgggttttttttgtgttttttttgtttgtttgtttttgagacagaatcttgctctgtcatgaggctggcgtacagcagcacgatctcagctcactgcaacctcagactcccaggttcaagcgattctcctgcctcagcctcccaagtagctgggattacaggcgcacaccaccacgcccagcaaagttttgtattttttggtagagacaggatttcaccatgttggccaggctggtcttgatctcctgaccttgtgatcctcctgcctcagccttccaaaatgctgggattacaggcgtgagccattgtacccggctgaactcagcattttaataacccataaggttatactatgtgtatggcttgaatatcatcctgttattgtgcttttgccacttgcgaggtacagatgcattggcttccttggctagactactcacactgatggccccatgccccagcttcataaatgaaccctcttgtacctacgtagctcacatggctacaatgaattatttagagactaactggccatttgccgtgcttaacacactctgtaggctatgaagcaagaataaggatgatggggctgaccaatgttttctactttcatttaataccagtttagcatatctgttaaaagctgtccctcttagagatatgtatgacccaaggacccctttggtagggcttccattctctggactatcagattatgcattttctttatcctacaacattttcatataggcaagagcaggtttaaaagaataccaggtggtctgaaaggaaagagaagtctcagaagggcaacaccctccctcagagatatgtgcatgggggccctcctttcaggaaaggaaccagtacagagcaggagtgggctgtagttgccccaggccagatgagtccccaccaagagtggacagaggccactaccacccccgagagggatacttgtatattgctttgtcttgtttatattctagggatggaaccacttctagactccagaccatctattttttaaaaatatagctttttctccctctgcaaactaggtccacactttctgatttgtgtgtgtctttaagttgcctaatattgttggatgaatggggctttttgaacacactgtgttattaataaatacagagactcctggaataaataaataatgtgattctccaagagtcacattcttattgtaatacattttagacagtgactttgagcaaaacttaatttttggaattatttgaaaacatttactattgtagagaatttcttcaaatataattatctttacttcccggggaagttttctaacctctattgtaacaaatagtctatactttgctttttccgtttttatatccgattgtttacttttaaatggtatgttcattatttgccaaagacttgagcaagatgttgcttttattaggtgaaagatttatcttcgttaatttttaactctaatctccttgaaaatatattgagtttatgccttatatgctacaaattattgtatccataatcattttataacttcactgttttttgttctctaaagccattatgtttttttccttttgagtttttaaaaagtatttccagcacctatgaacaataagttatgttatgcagcattacatctttgcttcttcaataactttgtctagtgttatgttgagtagttgaaattaaattaaaatctttatttctttaaaatgttcatgataaatatagtcttctgaaaactaaagaaaacaggagcaaaaaattgtacccaagtgctcatgctcacataaatgcatgcacacacacacacacacacacacacacacacaaccaagactctcaaatcctagtcaaaagctatatttcacaaaagagaattatagtaacattgatggtttgccaaaacctcaagcagtgacaaaatccacagtgtcctgtaggggatgcctttgcaaaaccatgcctctccagatggtttagattagagatgtttaaaaacacatggcagcattagcttggtttagaattcatagttaattcagtagataaaataatgcaaatttgaaaccctatcctgtctatcagaaaaatcatcaaatcttatgattgctcttaggagaggttggtatgtgatgtgttgatttttaaattatctaattgaaataataaaattaaccaagaaaaagtaaaaagaggattaaaatataagagtatgagtaaaaactttcttctctgcagaatatttcttcctttaagctgtcatatccaatcagtttgtatgggattcgacagccaattgtcatttcctgagatatactctgtaaagaggttgtgttacagagacggcatgaaaaaatggaaaaaataattccagagcatcatgccaagagaagccaaaatgtccttaaagaccacaaagtgttgccaggatcccttcaccttgctaataatagcagataagcagcttacacacaaatttttcctttggcttatttagctttccctcctagacactttctaaaagagagtgctcccagtccacattttagtaaattattttgccttctctgtgatttttcatcttgggtgggcgctctttgtgaacagcgatgttgcatattgcgttatctgacacgagacgtatagtagttcccccaggaccctaaaaggcttcatcactaaaagcttggctcccactgtccccttccttatgtctaaaatcaacagtatcccatcctctgatcccacagctggacagccagcaaacaactcctggaaaagaactgctgtatgggaacagtattaatttaatgatgtatattatcgtgtatcctaccagcagcataaatgaaaacattcggcagatatgttgaaattgccactggaagaacgctcactcaaggactcaaagcctttcagaaaatccacacggggaaaatatgggacaaagattctacaaaaatagaatcagaagttttcaaaacgccgttgctaggctttgaagggcttgactcaaagtggcccagtatttacttccccctgaaagtaacacattttgagcatttttccaaatataaaaagtagaactgtagcttttaatggctaaaggagctccactatcaaagtaaatgtgcttctctggcagcaaggacacatgtgcgtgaagaaaacaaggggggagcaggaagagtaggaaggtccctgtcacaggaatttgtgtggattcatgagtatttcaactgtagatttcattttgttttaaacatggagaaaatgtgttagccaaccttaacaactgatcaatagttctgcatatatccccacttaatatgtgtaatgggagatatattttgttgtttcatctaataatcaattttttaaataaatgggaatggatgatgacttggcaggggaagatgcgagcattcgagagaatccaggcgcttcatcacaggcataaatgacaccatgccaaaagacttcacttttggagcaggtgctcagaggagagaaaaccccacctgagcctttctccccctccccagtcacactcctcatgatgacccttacatgttttattgcatcttctcttgtgtgctttgtcaaatttgtgaatatttagctaattttcagaacaggatttcactggattatcacttctctatattgaaaactgctttacataaatttcctgcctttagaacattccaatgtgttcttccctttgtatgagggattttgagccaagttctgtaaaacatcacaaatttggacaacatggacagagaaggccaattctcaaatcagatatgatttactaaagaagatcaggataattaaatgattctttttgaaaaacaaatcatcacagtctccaaactatcctttgtgcaaatagaaattttcactatatcaggtcctctgatatgacagctgctgatttgggacattgttacagaagtgaaacagaacaccaatgctatgttataactcaaacttgtaattaaacatctgggacctgcctgctttaatgaagagataagaatatttggttggttgtgtatcatatctctaaactgatactactgtgattcaatcattacacattgtgtacatgtatcaaaatatcacatgtacccccaaaatatgtacaactatgatgtatcaataaaaaatgcaaaacaaaagcaaatacaaagattgaaggacttagaaactatttattttttcacattattcttttagttagcaagtactctttttttcatacacagtgcaaagagaaaaaaattaccctttattgttctgttaaaatttcactagttagctagtacttgtgttacaggaataatggcaaaataaatgggaagtggactctgtgagcctctcagacctgtattattccaaaactaaatgtaaaatattttttctcaaaaacctttacaaattcttaaacaatgtctgtatcatggatacttatcctgagggatccaacagtgttgaatcttgcctagcaatggaatgaattcaagccataaatatattacatgactgttctccacctcaaaactcttctaaagcaagggaggacagaaatggaaaagtaaataatatagttcctgttttatattctacatagttcctgatgaaaacccttggtgagttgtatgtgtgactagttcatatcaatgatgtttgggtgcaaaattcggagatagcaaagagctgcaaaatatgatacatcaggagaaatgaaagtgtagaggtagggcaaggcttttcattgttacctacataacacaatttgccatatccttaggttgatggcagatcaacccagcgaaaaaacactctaagcctctgtacagcatttttaaaagaaggctaatggatttttactgcctagttcacacatatcaaagtaagaaagatgacaccttgggaaacaggcaatatcagttgaagcaaagcatattataaatgccaagacctatattagaatttatatatgcccaaagcctgtttatttggggactgaattctcactggctctgagcctgaggggccacagtccatttctctggttaagctaggtcagtaccacctgtgttcctacggtgaagtaagagctgctgagacccatataccctccagccactgtatttattattgcacttgggaatgctctgctcttgaaggctgatctgacgagggtgggatcacaggcagcaggtatgccatgaacaacaaacccatattcttaacatatgtttaatttgagtaactctcctcctttaaaatacctcttgattctgaatccacatcctgatttgcccactcttgttaccattttctgctgcctgttctgaattaatcctttgaggtggtcattccccggaaagaaaaaaggaaaatgagaagagagatgcaaagttgggaatgtgaatgaaagagaatgggagagagcagagggaagggggtcattaactagagtctgctttcatgagctagattttctttgagctgtataagaaaggagaggtagaggaagaagagaaatacaaaaaaaaaggcacttgaaaggttatccattaatacccctactgaagaatgaaaatcattttttgcaatagagctcaatttacagattattttcatttctctgtcgtacttcatctcaaagaattgatataatctaaaaagtggttaaaattattaaaatagtttccatagtagaaaattaaatgattttactaactgtcaaagtcagtgtttaaactgagataatttgaattatatttcatatagtgatcatgtcactaggatgtctaaacattctttggaaaagtaataatccctgattctgatttctcatcaacagaaaactgactaaaggttaagaatattagccaccaattgctgttatttgcaaaaacctaaagagaaggctggttttcatgaggaattttgaatttaaatatattctccaccttggaacaattaaccctttaggagactttctgcatttttcttaggtgtattttctgctcagagggtcatgaaactgcttcaaatacttgatttaaaatatatttgaaagttaaatagcaatatattatgctattaaatataagatggcaaaatattatgttgcttcataacatcaaatttgttttccatctatttatctatctgtttatctgtctatctagcaatcaatcaaatacaggttttcctaggccacagcacactggtttttaaatgaagtcatattaacagagtaaaacatatttctctggtcctcacctcatttgcaacttaggccctctggggtcttcacattctcccacttttttcccgggagttctcagaggatattgcaaatgtgttcatgaataaggttccaatgactgcccgtgaagctaaaagcagcttgcaatgactccagcactcaagccccaaggccttgccctctgccctgtccccattagcatctgagggctggcctcacccactccagagcaagctccaccactaggtgctggtttccattgctgcagtgccattgttgctgatgatgctctagacccctgagtagccctgggccttccagaactgaagccagcagagtcagggcatattccatgaagaaggagacaaaaatgattctctcccccaaagtgtgtattctttgtctcaaggaagcctaaacacacaggctggatactccacttgttcataacaaatacagtcttttctgttgttccagtagcacccttttgcaaatagagctctgcagacctctcccactgatctgctattcatgccttctacactgtgaacactacttaaactcaaacctgaccacctgtttaattatatttcaagtttgaaatgtaatgctgtttacctcatcactggggcagatgacttcttttttttttttaagacggagtttgactctttgttatccaggctggagttcagtggcacgatctcggctcaccacaacctccgcctctcgggttcaagcgattctcctgcctcagcctcccaagtagctggaattatagccatgagccaccacacccggcaaattttgtatttttagtaaagatgaggtttctccatgttggtcaggctgatctcaaactcccgacctcaggtgatccacccgtctcggcctccccagacgacattttattcagaacaattcaagatatttattgaacctagcactgtgctaggtactgaagctacaatgataaatacgacctgttccttgtctttgaggaatctgtccctgccccactaggtcaaaagcaagaataggtgatctgaggtagaatgcatggtacaaaacaaataactagtgcgtggttgacccggaacaccccagccgccgcattgtcacctgacttaaggtggtcagtggagtggaggcgggaatggttaggttcgtttgtggaaaagggctttggaagtccgagctagctcgcattaggagggaggcgacctcacatgaagaatacctacctcctacctcaagatcctgcaaatgtttggggatggctggtgaaccacaggtattcctaagcctggttcttattaggcagggaaaactagaagcctcgcttttcctcatccttgctgtggaatgaaaccaataaagtccattactatttagacaagtgagtgaatgctgtttgtttgagaaatactgttcctggggagggtctgaccaatagaagcctctgaagggctttttgggggtggagagaaagcccagctagagggtggttctagtaatataagaatcaatggcaactctgttaatgtcattaggttaaatctacctaatcaaaatcataaggaaagccttacctttgcatacatatttttgttgttgtacaaataaaatgagtagctcaaaatctagcacaatgactgtctatacagggctgaatatctgtaaaagaaaaacacctaaagaagtttgcattgccagatgcttggcatcatgtaatcaaaacattttgaatgtattttaaaatagtcttccagatgtgtgacaactttgagcttagctacagccattatctacattttggaaggggagtggaaaactgagttcattatttaaattatacgggaaaattgaattcttattgccttcctggcctgattgcctcgggaaaaggtagttttattttattttttgcctttctaccaatttcttcaacactgtatttgacctgacgaatgtaaacacagtagaactttccacagtaccttgcatttgccataagaaagatgttattgccaccaaggggtgacatttcttgactgtggaagtagtctagttatttagaattcaacttttattttgtgcttactttccctagttcttgatattaactatacttaatatgtaccaatctgcccagtttcttttcattttagggctcatgctcaagaacatggaattaactaaggaaaaaaataagttaaataaagtagaggggttttttgcctttggactagattttcccatagaaattcacgttcttcagtgagagttatgtgctatgttaaacccactgtaggatatttatctgtgctcaaagtaggtgccaaatattaaataacctactagaactataggaaaaattgctcaggagaattttcaccttgtgaaatttgcagttatttcctccaagcccacacagaaatattctatttgtacttaagtccatcaataagtaaatctgtgaattttgtcattgatatggtatcactgccaattttaaaagaagagaacaactcacatagaaaatttcgaagtggtggtgtgtgtcaatctagttctcaagacatatctttctgtcaacatacttgagtgtactgttcaattaactttcaattattcctaattagtctttgacaccagttatatatatgatacattggtataactggcatttggcaaatataatagattggcgtgtctttctgaagctacggttaatttaaagataagacgggatccctgtaattgtactggtagaaaactggtagaagttttcccaagtgacacataccgatcagcataaaatgttaactgcttcaaaacaattgaaaaacttaaaaaatgaaaatatgttcctatggtctgccaaaactatcctgaaattttatctgcgttggtgggaggagggttggggacagtggcaggaagcttattgttacatttttttcatgccatgagaacaaatttgaaaaagttttgacagaaggtatatggattgtgattgatgtgatggttgatagcacctctactgagagagtagttccactaatgtaacttaggcttgaaagatttattttgaaggaagagggtatatgcactcatgggttgcaaataacagcagagtttgggtttttgctagtaggtctacagtatgctctgtgcgtctctgcttctgtctgaagattaccatcctttcttttttgttggttgttctgtttgaaatggcaattgggaaaggagtttagtaagagataggaagtagaaaggagttttaaatctctattctgcctggaactttagctgtctcaatatgggagtaaacaattcaaattaacctttttaggaaaatctcacaacagattatattctatcaggtgaaagaaagtgaaatagaactagggtacatttttaaagccaaaacataaactcaggtgaacatgagctcgagtgagtatgaaggttgtttgtctgggagtgtacaatatatatgtgaccatgactttagctagtgatgggctgtgggaatcagctgaatttacatatactttgaagtgcttaatttatcattttctcaaaatatttacaagtttatcaagtatttgttgaccacgctgatagaataatggccacccaaagacatctctattcttataccaggaacctgtgaatgttacctcaagtggcaaaagggactttgcaaataggattaaattaaggatctttttttattatttttttaaattttttccataggttattagggtacaggtggtgtttgcttacatgagtaagttccttagtggtgacttggggaagggtggatgggggtgagggataaaagactacaaatagggtatagtgtacactgctcaggtgatgggtaccctaaaatctcacaaattgaggatcttgaaatggggaggttatcctggattatgtgggtcggcccagtgtaatcacaagggatctcataagtgaaagagagagagagaggcaaagagggtcagactcagagaaggagatgggatgatggaagcagaatcagaaggtgtgatgtgagagagagacttgaccaacccttgctggctttgagggtgaaaggtggcatgatgcaagaaatgagggtggcctctagaagttggaaagaaggccaagaaattgattctcccctttaccctccaaaaagaaacgtagcactgtctacccctcgattttagtccttccaacctccagagctgtaagataataaatttatgttgttttaagccactaagtgtgtcataatttgtttttgttttgttttgttttgttttgtttgagacagggtcttactctgtcacccaggctggagtgcagtggcatgatctcagctcactgaagcctcaaccttctgggctctagtgatcctcttgcctccgtctcccaggtagctgggactacaggcatgtaccaccacgcctggctaatttttgtattttttgtagggacaggtttttgccatgttgcccaggctggtcttgaactcctgggctcaagtgatcctctggccttggcctcccaaagtgctgggattagcaggtaatttgttactgcagcaagagcaaattaatgctaatgcctaccaaatcttaggaactggctgaggcacaaagaacaacacagagagaagagaagcccatctcctgcccttctgaggcttccaactccaaaggatccattttattgtacccatgaagaaattaagcccaacagaattaacatgattttcacatagaaaatcagtcttgagtaccagttcatggatctttccactacgtctgtatcctatgattaggatgaaggggaaaaaatcacatcctgtcccttccccacaacctttgtgtgttaccgtaagggctgctgtcctctgaccagagcaggaaacaaacagcttaatgacattcaaatcattttttacttaggaggactcatctatagaacagagtcatgcttttgcattctgaagagctggaactccctacagccattaaagaaagggaagatggcctgttctctcaggcagtggcccttaacttaattgaagaaactacgtcctaaaggagttaagtcccatgaacaaagtgacacagctatagaaagagagtctttccagaacgtgagtctcctgactcccttttcggtttttgccccttctcccagcagacatgtaaggttccagctgctttttcggaatctgaaataggaacccagtgcctttcactaacctacttcccagcacaccgtgtggattacaaagggaaattaacatgtaaagaaaccctttggaaactaaaggagccatgttagttctcttgctatattatttggctggtctcactgttggtgtcattttcaagtgtggggcttgatttaatagagacagccaacaactgtggatctaatcaaatggggctcaaagcacataactttctgtgtggggaactataagaaatattttcaagttttggaatgttctgacaggaatagggcagaaaatattcaaaggaagctggaaaatcaagctacggatcttgtttttcaggtctgttatagtcactttgtgaagtactgcagacaattcattataatttatcacactgatattcatagattggatgaagcccaaacacaactgagttagatgcatattaaattacctcttacttaaaaggagggtggtcttaccagggcaggatggagttcattagcagtcttagaagctttccttaactcttcattatctggtttcatattattcctggctccacaggatcattgaacaccttcctttttttcaactcctggagaattgcacaaggcactttgtgaatctcaccaatcaacaattccaaagataaaagacacatcatcacaagtctatgcacaaagcagaaattactgggaaatctgttcctattctttgtataaaatcatttttttcttttttagggaaaagaaaaaaatactgcccttgtgcattttaatttagatttatatgaagcaaaatgttgctttttattatgataattgactgacacatacattgggtgtactctaacatatgtttaggaatttattatcacatttattctagctgacccataatatctcccatataaattcaatgaagaacatggttcagaatagaatcctacagacagatggtctttaatatgcctctagactctttttcctgaactggaaatttcagcctctatgtaaatgccccttaatgtgtacatcctacgtcttatgattgaaaatagtatttcccttgtggactgagaaaaatccctgaagtgttgtaaatttaatcatttgatccccccccagaatttttattcacatatttttctttatctcttggtttgttattttgtccttttaaaaaccagctcaagttgaactctggggaatttgattcccatttgtctgttgaatttccaagtacacataaatgttccggtaagagggaattgccttcagcttagaaatgaacccacaaggacacatttctggtattttctatgctgcagccattctcagtctatgggtctcttgcaaaacttcagactcttcggtggacacgacaatggtgtagaaattgagggctcagtgagatttgggattggttaacaatttaaaacataagtttacccttgtctcttccatatatcttatagtaagcacttaaatccagtttttccaagttctttttagtacttcaaagtagcagtttatcaatagaaccaccaaggtagacatagtcctagaggtcacctggttcatctttgtgccttagacataagcatatctaagtcattctaggcagatagaaaaagacaaatcttcactaagactgtttctacctttggcctcattgctttgttgggcgtaggtcttcacttcttattgtcttgcccaaggtttatattcaccacatagttttaatatgaagaaagacctattcgtgccaaattattttattttcttgctaaatttagaatgatccaactgattctgtgtactgtcacagctggcaaaaccaccacagttattcagaaaaaccatgtgaagatgctgtgcttagtagaacactttaggtttttttttttttttttaatggtctctctataatttctgacctaagtgccttggtaatgatctaatgtgggctagtccatgactctttgggtggatcctccaaatgtagatttattttaccagcaagggattgagtgacatatggagactggatgtttttctttctttctcagcctcctcaaacaacaaaccgtgaatcctacaaattcaaaaagaaattgtccaaagcaggacacacatatcatgcaattgtttttagacactcttgccaatacaacagctctgaatctggttagcttatttttttgtattgtgctggtaaaaaataatacctgataactgaattcttctcttggattctgtagctgatgaacgttattgcttcttttatatggcccaggaagggaacacagattaagaagctggctctttttttacatgcttgctctgtcaagaaagagaaggaagtaccatatttttgaatgctatattttccccctttgcaaggagttagtactttttcaataaaaataaatttaatttgtggctacacttcaagtaagatggtttgatgtcaatgtacagcagtctcagctctgaatttagagaagtcgtgtggctgactcccttagtgtcactttcatgtggttgggtgagccattctcagaaaccccaaacatttctgaagatcctaaactggagacattcacaagtcttccctccctttttgctactaatccttcatattttaacaagcaccgaagttaatgctgcctacactttttcctgtcaaattggaactctttcttctgtcttgagtaatctgttctctctagttcatactttcataaatcaaagaggtggatgtcaacacacaccatatccaaatatcaacttcctttcttttaattaagcaggatttagacatttgatttaaagaaaactgttgctttttaacatacaaaggcaaccatatattcatcttcatctcttcctgttattttttatctctataaataaaacaaagtttgccttcgccttgtaccacatcgctattccagtctaggcctagcaacttgggttttatattttctaaaaaagagacaagaaactttagtgaactgttggcagtcagtactgaaaaagccacctttgttctgaacgtgcttcagtgagcattattgtcagatattgatattttttaactttttcctaaatgcaagccatccttttatttctaaaatatgaccattttgctgaagatgattctctctctcaatgagacaactgtgaaaaaagtatgcatattatttcatatcatgtgagttcagaagaatgttcctcaggtcctgtgtttatgtctgtaagtaagaagttccactttttgttaaagcacacaatagtggccctattcacttttcataataataaataataattcatataattattttgaggaatagacacactcaatttcaaaagaacttgttggattgtaatggcatttttcctttggttatatagtgacaagatgaaaacaaagcattttctcccaaagtggcagtcaatgcagagcttgtcaggagtgatccaactggtttccaagctgctagctgttcattagactctcttgaaatgattaattggtctcaatcagttcccagcaggaagtacccacctcatagtaaatatcaccacaattggtactaattaactctgttatcacctgtcgcaactgatagtctgggagctgagtgaggtgagcgatctctacaccagcagcagaaacccaactggagagaggtcagagactcactgccaaggccactgtaacaggcagggagcccacaagccctctctgccatctgggtatgcatgaggcttagcctgtggctaccagtcccacagaggtgaggaagtaagaaatgtagtgctcaggcgggacccatgtctcaaagagaaaaggcacctgcattcaaccgatgcaagttttcacagtatattggtgtcaaagtcagccaagctgtggttcaaatctggactttgccacttactattaatttgatcttaagccagtggcttacttctctgagcctgggtttcctaatccaaaaaatatatataggcaaaattacccacctagtaagactgatacagcgatgtgtagtatatgcttgacactcatttagtaactgcacaaaaattttggaatgctggccgcaagtaaatagccatgtagccggggatgacagtgataatgttcattagcattcctgacaataaacaagaaaactcctagtgtctacatggagagtgatgctgaagagaagttgggacctaaaccttcatttcatttttatttatcattttctaagagcctcattatttctgtggggaggagaaacaaggagagatgtaaaaactaacaaataaccttgaaggaaattaaggaatggtattctagcagagggaaatatcataagtttctcagttgggctggttgtgaaaatgacacgattccataagggaaatatccagacctacattgatgcggaaggaaacttatcccacaatgatactgggtcatgctccatgaattaattgtttcagaactgtgttttccatttttctccatgatatgaagcacctagatgtgtttgttaaatacacagatcactagatgtctaccttggaaattctgattaagtatatcacagtgaggactcaggagtttgtgttttttgtttcttcattttaattaacaagcaaaattgtatatatctatggtatacaacatgatgatttgtttgatatgtatacattgtggaagggctaaatcaagctatttaatatacacatcattctttgtagtgagaacacataaaatctgctctctgcaatttttaaatatataatacattgttattaattgtagtcaccatgttgtacagtagatctcttgaatttattccttctatctaactgaaattttatatcctttgactaatatctccccagtccttctattccagcctctggtaaccaatgtgggtttttaatgaactctccaagtgcttttttttttttattcagataagcttaggaaccattaatttgaaacagtacttttcacatttgacggcaaaatactaatgccccagtcgcacccccagaaattctgactaaattggtataggatgtggcctgagcatttgagattttttaaagcagcccaactgatgctaaggtacaggcgaatttggagtagtactgatttagaaaatagtctgaagggtacctgtaaatgatgaataagtaataactagatgtaaagtcacatcacagatcaatagagtccagctctaattcaaggtgtgaaagaactgtcaagaataaggacttaaaatagttaaaccacgtaagaaatgatgtagtaacatgtgttactagatcatcaggacaacctccatcaacaggacaggaccaagaattactactgaaattattggagaaagatttgttgagcaagaagagtcctctggaccacttacagtgtttagagatttttcttcgaatcaggaggtagtaatttctaattctatatgggaatatattgtttatctgtctttaaactacattacctaattcaaatcttccaacagccccagggaaaataggcaaagaaaatgcctgttccataggtagggcaagaactgtcatgctcctattataaaaaaaaaaataaggcttagatacctcatatccattagaatggctagtactaaaaagaaagccaaaaaaaaaaaaaaagacagaaaatagcaagtgttggtgggggacatggagaaattgaaacccttatgtattgtgggtggaatgtaaaatggtgcggctgcttgcattagtctgttttcacactgttgataaaaacatacccgagactgggaaatttactagagaaagaggtttaatatggacttacagttccacatggttggggaagcctcacaatcatagtggaaggcaaggaggagtaagtcatgtcttacatggatggcagcaggcaaaaataaaaataaaaaataaaaataaaagctcgtgcagggaaactcccccttataataccatcagatcttgtgagacccacccgccagcgcaagaacaccatgggaaagacctgcccccatgatccagttacctcccactgggtccctcccacaacacgtggaaactcaagatgagatttgagtggggacacagtcaaaccatatcactgctatagaaaacagtgtgatggtttgtcaaaaaatcaaaaatagaactacattatgatcttgcatttccacttacaagtatgtacccaaaataattgaaagcaggatctcaaagagttagttgtgcacccatattcttagcagcattattcacaatagccagaaagtgtccattgatgaatgaatcgataaaaccagatgtggtttatgcatgcaatggaatattattcagccttaaaaaggaaagaaattttgacacatgctacaacatagataaaccatggggacattatgctaagtgaaatagccaatcacaaaaggataaatattatatgataatacttatatgaggtacctcaagtagtcaaatttgtagagtcagaaagtagaatggtggttaccagagcctggtgaagagtgatgagggatgggggatgggggaggaatgaggagttagtgtttaacgggtaccaagtttcaattggagaagatcgaaaagttctggagatggatgatggtgatggttgcaaaacaatgtgaatgtgtttaatgtcactgaaccgtacacttgaaaatggttaagatgataacaaattttatgagtatttcaccacaattttaaaaataaataatttgaaaatgtgtccctcaaatatgcaaacaaacaacttaaggcttaaaggagtcacacagctagtaaggtgtcagagcagaaagtcagttcttgggactctgggtctgccaatcctccctttctacctccctgcctctcaggaagtagaaattgaagatgatgctcaggaagaaggaaagagggagaaatagttgtttgaggaaagagtgatccacggggtccagacacagttgtcttgaagataacaaataaggttggtaagtttcatgaggtcagaaacatgtctgcacaattttaacaattaagatatattttacatgccacaaatttacccttttaaaacatacaattttgtgtttttttagtatattcacaaagttggacaattagcattgtctaattccagaacatttttatcatcacataaagaaaccccatatttagtagtcattcctcattccttccaagcccagccctaggcaaccacgactcagctttctgactcaatggatttgcctattctggacattttatgtaaatggaatcatacaataagtggccttttatgagctgtttcagttagcgtaatgatttcaaggttcatccatgctataccatgcatcagtactttattctttttattgccaaacattccattgtatggatttaccacatttcgtttattcattcctcagttgagggacatttgagttgtttccactttttaacaattatgaataatgccgctgtggacattagtgcacaagttttttgtgtagacatattttttcaattatcttgggtatatacctaggagtggaattggtgggacatatgataattctatgtttaactttttggggaactgccagactgttctccagagtggctgcaccattgtacattcccacaagcattgtaatgagtgttcccatctctccacatcgtcaccaacacttatttccatttttaaaaaattatagccaacctagtggatgttaaatggtatgtcattgtggtttgcacactacctttgtattctcagcataaaagccaggacaaggcacgtgatagggtctaaatactgaaagccatgaaaattccaaggaattctcagaaaggttatcaggatgatgggtttctaatctatgggaaatcaaattttagaatcagctgctttttatttcttagtataaagagtgtcaagaaggagcaggtaactaactcaaactttgctccagggcacccccacattaatggggtgataacttttgattgatgtttactcctcttagaatttagaagaatagcctgtgcaccccaggacagagacttagagagaggaagggagagttttagaagaaaaaagaggctggatatgttggctcatacctgtaatcccagcactttgggaggttgaggcaggaagattgcttgagcccaggagtttgagaccagccatggcaacatagcaagaccccatctctacaaaaaaattttaaaaattacctcggtgtggttgcatgtgcctgtaatcccagctactcaggaggctgagacaggaggatcacttgagcctgggagctcaagtgagctatgacttgagctatgactgtgccattgcattccagcctgggtgacagagcaagaccttgtctcaataataataataataataatataaagaaaaaaagaccctttcccttcatctcaattaaagttaagtgcctgacccatgactcatgtcgtcttgaccagcttcacaccttccatgttgccaaatgcctggtgctacatgattgcctataggaggggttttcaacagcagtcttctccaaatacacttttccattaacaaaagaaatatctttgtgggtttcttaggtactcgcagaaatagctactagttcactagtagctagaagcatctgatctgtctgcctcaaagccctctgacagtgaagcatttgtttttaggcaaataaaacgtcagccaccatttaacagcatatggcaacaatacgaccagtccctccctgaggaccatcctctccccagaagagatggtacttgaaataggcgatgcttttgagagcagaacccttatttctcccacccaggcatgatggctggggagtgggcagagtgccacgcacggaaggtcacaggcaaccagatcaaatgggagcctagagggtaggcttcccagccaggaatgaccaaaggttgttcaccctgggcatctgggtctgtggttaaggggaagtaccatctctaagctggcctggattagctccacaaaatagaaaacagcctccacagccacttaaagacgggtctgggctaacttgaattgaatgtagtgatggtgtgcggtgagtgcagggagacattccaagctgaatctcaccctcatctctgtggaattccctgtgaatggtgtaaaataaactgacttctctttaaatagatgatgaagaggtggaactctgtttagtgggtcagctcgtgtgcaagtgaacatgtggctatatggataaggaggtggtctgtctttgcaggggtggccagtaactgggccatctgctcaggattaaaaaacaaactgttttctcaggagcctctgggctaaggcatctgctaaaaacattggaaactgtcaacagagatggcttggtcttcgaaatatagtctcaaaattttgcttgtccgaacttgggaggaacatattgtgcaaataatcaaaatgtgatgcttgccctcttagaaattgtggttcctaacgtaacactgtctttgtgttatgtgtgttggaatattgacagtcagtcttaccagtttttcatcaagcttgttacatatgagctcatcgtatttctgagcccctgatttgaccaacaatgtggccacatcaatgaaatcaatagccttgtgaaaatagagttcaaccgtagcctcaggaaaaattactttgattagttaacattattgaaagatcctcaccaactttataattattttccacttacgtaaactacttgattggtttttcttttttaaatattttgtagagatggggtttcaccatgttgctcatgctagtctcgaactcctaggctcaaccaatcctcccaccttggcctcccaaagttctgagattacaggtgtgagcctctgcgcccagcttgatttgaatttttaaaggccatacgttatttttcaaagtaattctaagacattaacattttaaggaataaaataaaataggaaataattaagactataaaaatatctatacacatatatattcttacagtataacaaggcaaggaaactttttgtttccagttaatttcatttgtctgcattttattagtctccatttaataatgctttattataacactgaataacaatataaaatttcaactgcatagggaagtaatgaaattttttaaaataaaatggtgttactaataatttttttagattttatctccagaaaaatgtactgttaaaaatgaaggacaaaaaaaccccacatttattagtagtgtcaaccaatttttctgaaatgttttttacttttaaccaaatagaggtaattgacaggatgatatcatttgctctttttattcacagtcagtaaattctatgacaatcagcagcaacagtaatgactagataggtagctgtgtgaacagcagggggttgcaacagtaaaaggtttctgagaccttttactctgaggattgttgatgtagactttccaaattaaaagaggagccctcattgtccaaactgtagttaagactataaatatatctatacacatatattcttatagaataacaaggcaaggaaacttttggatgaaaaataaaaaattaactcactcatccaaatgttggccaccattacatcaaacatcagggtatgtaaagacatcttgtgaaatgactgaattctcaagtttacatctaagcaattgaaatcttactacgttagcatttttacatgaatgatagtgcatagtgtggtgtaccctggagacctgtgttgaacacaggatatgtaaatatatctgtatttattttaacatatatgtcatgtaatacatatatgtcatgtaatacatataacatgtaattaatatgttgagcttaagatataagtgaaattgatgaacataactatacctcatcttccaaacagaaaatgaaaaaaaaaagtctaatcttatttatcatggttatattgtaaaaataggtttgcagcaaaacaaagtagactctggaagcagaactctggtgctgcaaggtggtgttactcttttttagcattaacttgactttttatcaaatttaaatagaattctgaatttgagatgggggcttttgtgacatttaaaattttttgaaatggtttagtagtcctttgttggtggtaagtgttggatgaatgaatgaatgaagaatgaacaaattaatgaatgaacaaataggtattggagttctcactctatggggttgggttctagttgattgccaactatgtgtttcagttttatataaatacctccactgctggttttcctctggtttagtctcaacaaacagtacaagcttgcgggggggggatatttgcttggatttagctgaaacacagaagcaatcaagtggttgaattctgcattttaaaaaattgaatgacattcctttatccatatcgatttgagctttggtaaattcaattgtcgataccacctggataattttaaatctttctgaagctttaaaaaaaagtttccaacgtagctccagcaacataagaatttcatcaattgaaagctaagaatcatttctgtgggatgtgtaaaacaagaagccgaccagcattattttctttttctttaattcagtatcattattgagagttattcttgaactttatgaaaaccagattggggcatgagcatgttctccattgaatcatgttcaaggaattgaaactgaaaatcattcaaagtagggaaacatgacattgaaaaatagtctacattctttattctccctcagagtatctgaggctgtttctaactaggaagccttaggctgataggagatctgggtttggtttcttgttttttgtcttgttctgttttattttttttaatagatgtttagtttactagtcaaaaagaggtcataggtttttttttggggtttttttgttactactttgctggtgtatcagttatgatgttggatcctcttactcatttgctccaaaagttgtgatttctcaccattgtccacagaaaaaaattccaaataatgtcattcaaggctttctgctgtctagcccaggcaatctcttagtcagacttcctactatctgattcttccatgcaatccccttcccaaccaaaaaagactatgagctgctcacaagtctcattttgctgcctctagtccttttccttcattatcctatccttcaggaatgcctgttgcttctctccactgtttgaatgttccatatatacttcaaggtgtgattcatcctcttccatgagttctttccaaccatctcaccatttccagcctcctctccccctccctaactaaaacaaatcttccccttccatctatccccctcacacacagagacacacccacacactccacatgctcctacaatttagtcatagcatgtatcacattcaaggctgctacttgggtgtgcaagttgtgctctgcacaagaacatcaggccaaagggacacgtggggatgaaaatccatcttactctccatttgccaaggcatgcacctgcccatacgactgtgtttctgcagaggatacctttttctgttttccacaaaggcaccgtatggactggtagcccatctgttcatctgcatccatgttttttagttccctttcccagagcacaaatttgctgagggcagtgactacccttttattcctaccattcctggtacagtgccttccttatacatggtaagttctcagtgacttcatttaatttaattaaggcatgaaatgtattgactaaaaacaattactttagcttataaatgcaaatatgaaaagtaccgtaggaatcaaaatggtcttagcagatgcaaaacagttacttctctgactttaagtgcattatggttctatctcagctaagtaatttcctacaaaatgtactgcccagtagtcttttatggagcttcagaaaccacatttgtgacagactatgacagaccatggcagagctggactgagatccatttctggttgtttgttaaaataggcaaggaataacattaagaattttctgaagtgggcagaattaagatcaggaagaatgcccatgggaggtgagggaattttaggaggagccaattggatcagtctgaggtcagtatacttcctggaagtctacattaagggaaaaacaaaaagaagacctcatcttaaaggccttgaatctagaattactctgcctttaccaacactgcaaattgtgtaacttgatgtggccatgctctcaaagtaaagaattgcttagtaaaggctttagtggagaattaatattagttctgttgcaattctatgtgacaaatgggaaatgtccataaagcaagatttacagaccacaaaacaatgatgtacttaagataggtttcatacctatttgataaaatggacaggacttcaaatttcagatttcaagcagtaaccattggtcagcctctccaaagaaagtcctgtgcctatgtacaaaatttcttagtaactatgcacttttacagtcccagctttaaattatttttttgttttccaggatgtgttgagtttatgtgatgaactgttttcaggaagaaacaagtcacctacaaccatttcacattgcatctctctctctctctccttttccctgacagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacggtaatgcaaacttttgccatatccctgtgagccgccaggccctgaaagagaaaataactctactcaaaaaagtatggatgttttcagtaatgccaagttaggaggatctactttattatgattgaatcctgaccagctaaaagttgagtgaaaagtagatgaaggaagcactggctttagggatgtctcttaataacctacatgtgctagcatgtagggaggatctccttggctctcccaaaggccaccagtgaagagaaaccttggaagaggcatctgtggaattgttttcccaaagaaaccctatgcatttacattataaggtggaaacacgtattttcaaatagatcctgaagagtaaggatttcacatcaagggatgatatatgggacttttgccaactggccttttccatgtgtgatttgagagagtactttgactttaaattctggaatgtgtggtgtaagtctcaacataaagtctacagtgacaatataatccctggggttaaaagtcaacatctcaaaaccattacccataatttagtagaagaggttcagtatagtgttcataagacaactactctgtcatttcctttaaaagaatgacaggtgtgtacagcaattgttcagaggaatgagaagacaggcgtgtctccatcaatccttgctaccttgacactcagggtaactgatgttctttctctgaaatgcccaaattatgcccaaggatacagctttactcttgttttcaatttccttaatgtgcttgctgcatttgtttcatatgctggactcaaaagcactctggcatgaaaaaggactgccagctgtttagctaagtccatgaggaggaaaaatctcctactcttgtaagattatcaatgggaaatgacaaataccaagtcagccccaattctgattgactggggccaaagacacttgcaggtgaaactagttcttgggaatcttgggaaattgctcttgcctgccccatttccccaaactaataacagaaaattgtggcccaggagaaggtgggcttgatgcaggtgtttggtgaagtagtgtgaaaccatgccttggccctgtttggatggctggtgtatttctgaacataccttctgaaatttccaaaattgtaaatccaaatgttagaacatttagcagtaagcttttggggaaaattcaaaaccaggagctcttccaaaaaattaacatttcttttgtgagtaacttagagtgtgatcatcacaactaaaatactattattatcaaacttactgatgttatttctgttagaaaataaaataggccaggcatggtggctcacacctctaatgccagcattttgggaggccaagacaggtggatcacttgaggggttcgagaccaggctggccaacatggagaaacgctgtctctactaaaaatacaaaaagtagctgggtgtggtggtgcacgcctgtaatcctagcttcttgggaggctaaggcataagaatcgcttgaaaccaggaggcagaggtaggagtgtgccaagattttaccactgcactgcagcctgggcaacagagggagacttcctctaaaaaaaaaaaaagaaagaaaaagaaaggaaaaagaaacaaaacttgtccacttttcgcttttgctgttttgttgttgttgttgttgttgttttggtttttttcagggggattttgtttgtttgttttctctaatctatagctaaaagtgaacagttaattttgtgactgtctttcaactttcactattggctgactgattggtaccaggatcaaaaaggaaaaagaggcccaccacagattactcactaatttcctttcacacccaccacacatatgcatttgagacaacaggaaatcataagtaaaacaaaatccctcaggcacacagtaagtttatttccaagataaataaaaacaatctggcatctatactggaaaaatgggtatactgtagctttcttcttccttaatggtagagttgtgtgtgtgtgtgtgtgtgtgtgtgtgtgtgtgtgtgtgtgtgtgtaggcatgctccagtgtctgcttctgttttggtttcattacacctcttttttctcttaaactgagttttattactcatggaagcacaggccagtagtgctgattaaagcctgggaggggctgccacacacactttctccgggcacatggctctacacattcttctagacttgctttctttctctgctggacctttctgagtcttaatccattagtgtttaatgatttgtgttgatgctcagtggttatcaaagaagccccactggactcttgttgaaaaacaagatggatttcaggttcataacagtatttggaccctgccttcccattcttcagttttactaagtctataccattttcaggtgaaaatttgttacatccaatcttccatttgatttccacacagaggttagcatgctgtgtggctccgggcttgataatacactgcctggggctctacatacaccagagacttgggaaagagcattgcctacaatcccacaaccagtcagccttcctgatacttagagaactgattgggataacatttagcttcagatctctgctgtacttactatgtgcagatccactaaggctgactcatttggaagtttcagtagggacatggtgtgaaagacatagggacttagctgactgtccatcagcacgggggaaagaggtgatataattgtcaaaaaagcagatgtaatcttagcatgcattaaatgcaggcatattttttatcacatgagaagtgataattcaatgctacccaggtttctatattctgctggtcagaatataggtagacagttctgttttattctcagaacctcactggaagaggaatcagacaaaatacagcattttcaaaagagattcaccaggataggaaaggttttgaaaaccaggtacccaaggaacagatgaaggaattagtgacagtctgggtaagaaaagatttggcagggagaggagtaacagggaacaactatctataaatattcaaaaagctgtactgttttgacttgattagtttggtttggtcccacagggcactgcactggaagtatctccttgaactttctttatccccattagtggaagaaaaaactcccccaggatactacgaaaactggctgccctttaaggaaggtgtttaagcagagtttggaccacctcttggttgaggcagatgagtagctacattagatgattattaccactccttctgaccagcagtttatatgataataatagtttgggaaccatcctttatacaatagcaactttccaatattaaatattgtttcattgtagttgtggctaggtattatggacagtaactcaccaagggtaagactgatactgtcagctatttgcacaaagaagcaccaagtaagtgtggtttggccactggtggctgaactgcctgaaatctaacccaaattgctgtaggttctgctcatagtaaccttccattttgtgtttaatacacagctgcaaatgattttagcctaccgtttagaattctgcagagtgggataacccactagagtatgacagagggttacaacatcttgtgtatggttcctgggatgtataaatgacctttctcaatgccctggccaaatctaagcctctatactactgcaaacggtattttgaaaaataaatatattattatcctagattttgcagtaacatagaagaacctaattttatctcaccaggtacattgtgccaataatctcaccactagtatctctcccccagattaaaatggttatgaatattaaccactttttataaagaatgttaacaaatgtttggcattgtgactataatgcattaaactccagatttagtaacatgtattccttccaaaagtcagtagttctacccttttgaagactgtctttttccatcactcttgttgagcttagaagccaaactatgcggtggagacttattcaagtagttcaaattcacctccctgcattgcctctgccccatcaaacctcatttgttctagcgtccttctgttccactgcattgcattctgactgagcaaggtgaagctttataagtatttccactattatgtgttgctgccagagcttttagaaagaaatcaggttcaaatcaaaagcggcaaatgacctgacgcttgtattatagtaggattatgttactctttaatccttgttttagagtaatgtgtttgacactcaaatgtaagcatttcctcttggatctgtctctgatcctctttgtttatgtttttgcagcatcccgtgtactgtgtaaatgttgttgggacccagaatgctcataacctcatcactgtctccactgatggcaaaatgtgttcctggagcctggacatgctctcaactccacaggtgggtttgtttttccctacacataacaccatcctggttaaaagagatacctacttaatggaacatagttcctaaaagccaaaccctcacatcctagaggagctaaaacaaatggatgcacttgaaagagtggggcctgctttcagcaatcttctcttgaagccaaaacccatttcctttaccacaaatcatgtaattattgtaatacattaatccttaggtcagtttcaagtgaaaatgaaataatccattctaaatcatagtaattatggaagttgcctatggtatgaattgcacttaccctacagcattgttgaacagatgcagacgaggttggagctcagcagagcaatcccttatgggtacttgcattggagggaaggtaacccagcaaaacagaaatccaagcccttgcttgtatccgtagcctagacaacagcctgtgtgtatgaagaaaccatctgttttcccctctggaatgttttttagtatggctcctgtcattccttgctcagtaaatgagaagtcaaaaatgaaaaagttccaaagtctgcaaaccaatactgattgcaacagtggggaccaaacaaaggaatagaagtgggagaggctgtcaaagggagacaactaaatgcaacttgcaagatatgcatatgtagacaaacacacaagacatgcgcatacacacatgaacacatacacacacgctttttccatatttctttgtgtgaaaaaacagtattcactatcctccaaccaaaaacaacagagaagtcattgttatagactttgacaaaaatgtaaggaaacatggagaaaactgcaaaacaatatctaggagataattctcaatgttaacattcccatattctttcccaggataaaaaccctagaatgtctctcacacaattttagaagaagttaaagtttcaaaatgtacataaggagacagggcacggtggctcacacttgtaatcccagcactttgggaggccgaggtgagagaatcatttaagcctaggagttcaagaccagcctaggcaacagagcaagaccctttttctactaaaacttaaaaagttagctgggtgtgctagcacatgtctgtagtccatgttccttgggaggctcaggcaggaggattgcttaagcccaggagttcgaggttgcagtgaactattatcacaccactgcactccagtctgggtgacggagtgagactttgtctcttgaaaaaaataattattattattattatacacacacacatgcacacacacaaaaggaaatatggaaactgtgaagaaccaacctcctttaagcctccacaaaatacggatgtaaagaatactacgtttttttaaaataattttagggagaaaaaggagagagtgctaataagctgcttacaattgaagttccactattttcgctgatctttaacattatagagggctggagggattggtattttatggctttgtcttaaaattctcagcaatgttttgttttcttttaaaagcctgaagattataaacagacataagagcaagcccactatttaggaatttttaattgcccattttgctcattacacatatttatttaggttaaaaccagtaatatggtggctctaagtccgtttgtattagttttagcatgctcacagactcctgtgtctatacaaagatggaggatttcgtgacatggcttccatggatggcagggaggaataggggcatccaacagttggcctggtctttctctctcccaaatgggtaaagggacttttccttccttgctgctaattttagtgatgaagcagatcattggatgatccagttatctgtatgacatagtcacagcatcctctcctttatcccagttgctgatgtgcaccctatgtgtggatatcacaaactttgaacacatcacaggatcagaatcagtctgtgttgcttagactgttagcttgcactttcaatttaatggactccttggctgaaatagtttatttgcacaagaaagactaaactctcaagcaactataatgatatgatacctcagaatgattttttaaaaattatttcagatgcacaaaataggctatttgatgtaaatagccagaaatactcagggatattagttataattgattattcttttctgtcattaaacttaactcagcagtatatcttttaagattaggaatctttaattctcaattttaaaaaatcatattataaaataaagactcccatttgctattttaaagacgtatttaaatattgttcttttcaggcttatagcctattcacccaatggctgccctgcatgaaatctagtccctgttgaaatctggtttttatgacctgagtgacaactttctggttttagtccatggaggacacatactcctgctttgacaaatttgcttagtacatctgatattaatacatgtgtattctcacaaacaattgattttgaaaatgtttgtaaatacaagggtattgtgtgttttattaaagcttggagctgacaagtgtaaccattattatctttagtttctgcaccattagtttcaaaattctcacctgtcatctttgcctgacttaagaagcagcagcacatgctgatgaaatccagccggcttgaaaccagagatccacagaagcatgaatgtcaggggcagtaaagcatggtttctggcacagccggggtcttttgtaacgctgtgtgaaaagcaaacacatgatttagccaaatgatttttccgtgctatctttggcatggcaaggagttgacagatggaaatgtaaccacaccgtgttttggtaggagagcatggagctggtgtacaataagtccaagcctgtcgctgttaccggaatggctttcccaacgggagacgtcaataacttcgtggttggcagtgaggaaggtacagtctacacggcttgtcgtcatggaaggtgatttttctgtttctttactgatgacatgttcttcatttccgaaagtctgttatcacattctggattttaaccaccttgcattatgagaaagcatctctggaaaaatggaaagcacgacttcaactcttcattatcttaaagagctgcatctgctctggtcattagctgttcataagactgtggtggttcacactgccttgagggaaaaaagctcgagcttctgagcctatcataacagaccacttgcaccttcccagcatctccgcataccttcagggtctagccatgtgcccatcagagataacaatccccaaatatttcttatccctccatgcctcaatgagtttgcatactcaacttcttttaccagttctagcatttctccctttttggcctggttaattcctcctcatcattcaagagccagcacagagatcattccatgtgaaacattttctgactcttgggcaaagaaaaccactcccacctttaagtcccatagaattttcaattctcttattcattcactcttccaaggaatatttactaagaacctaccatgtgccaggcatcatcaaaaggatacattaaagaacaagacagacctagagttcatattctagttgagggtaaaatactaataagcaaataaatatatagtttaggatggtaagtgcaatggagaaaattaaagtagaataagtgggataggactataggctgtcaagttgacaatttcatatattttccttatgcttctataatagcattaatcgtattttagtttattcattcatctgccatttttctcttactacattatttccatttcatctttgatttcctgcacagtacctaggacatagtaagtgaggagctaaaaatatatattggggataaagaaatgatatataatgtaatccatccaatctaaagaagtgccttaaaagctttcctcccagtcagatgggtcagaacagagtgagtcacacaaaccaccatgcagttcccaggtgataagaactctaccttaactgagagattcacaatgcccctggaaaagagttgtcagtataaagtggaatccaatagtttggactagattgtaaaattgcatgcaaaacttaacaggtggcctcatgtcttttgaaagggtcactatgttcacactggtgcttaatttgtcttttactttagtagttcttattccattgattttttttcatctcttgcactcatccgaggctattaagatttaatgaagaaccacaaattgttccaagttcatatccctgtgtttttgtgatttgtagaaatgacaagcatccatggctcagctatgtgactttttccattcaaactatacaagctgttatgttcctgctgttctgcacgtagaaacaagcagtatttgtcccctcacatgattcaaagatgacttaggaagatatgcctcacagtccattcccaatgatcctccttcataaaccctggctaaaaccacacattaaagctttatcaaagcataaaaatatttgataaagttattcattcataaatatatttgttgtatgcctactttgagcaaagtgcattgttaggttctgcaaggcctgcagacgtcatgtaaacctggtttctctcttcaaaataactgatgacggtgagaaagataaatacacaaatatctggaacatgagtagaatgtcttaagtggcatgagaggcatagagagtatagtaggccagacctggagtcacagctttatctatatgcgtattagaatcaacatggcataggttcagttaacttaacccatggttttacctaggtccttgattatctacgaaggctatagaatacattcattgataatttccagatttttttcattgctataaagtgaataacattttacatgatgaacattcttgttctgtggctactgtactttctaagcactatcagaatatgcactttggttcaaaagaagggtccctatggcacacaccacaaatctttttacaacaagctgaattttgctttacattggtccatccatctgaaatataaaatacagaccttagtaacattgtaacgtagcaggcattggctttgtagtcattctaaatgggtcatataggtctatgggggagaagcaggggattgctatttttcacctaacatagagaaggtgcaaatccacttccataaattaaacaaggtcctcattttgcaccctataaatcctttcaggatgctgttaagagcaagtggagtctcaccaggggccacttcaaagatcagttcctcgggttcattagaacaaatttaaatgatcatgtgtggaactgctcttagcagtttcactgggcataatttttgagtgcctgttacatggaacacgcactgccacactttgctcatgattccaaattttgctaagcacattgacatttattggtgctccagaggcccaaatgttttaataactgagctcgtttttattcttagtgacataatattaggattctacaattcctacatatttgtcatatttataacctcatgcacatgaatattttaaatatagcatttttggtatgttttctcacatcttcctaattgtatatgattgcatgcagaatactatgtgataatagagggctgcaaataataacagcttagttaaataagcaagatatgtctgtgtgtaattttttaaatgtctatcattatttctcaaatgtgcttctgttttaaaaaaggactgagacataagtttgtctctttttcttagctagtttattcaacaaatatttattgagcacttactatatgccagacacttggcaacaagaaagacaagatacttgcccgtatgggatttacagtggatatgtaaatctgtcttctgttttcagtaaagagaaaacattattttctccatattatatttaaattatgtgcattattttgtggtgacaagggtttccacaaagtgttacattttcagctatgttaaagtaatttaagaaatttacttgaaaaaaataaatgattgttccttcaaggatggatggagttttatagtcaataggttccccaaaaggagataaagcagaccatgtgcaaaatgctatctcaagaataaaatagtcttataaatataaaagcttcagagacctaagtgtatttgtttccattaaaatagctgcatcagcaatgataggctttgaggaattctgcaaaaagaattaaataataaatattgatattaaattctgtattttaaaaagatttcattgccctacattgtttttaaataatgaaaaatagggtaacatatttgcaaacaatttctttcaggataactgtaaaaatgatttcattttggtggtgtgtggttgttctaaattatggagatgcagagttgagggttttttgttttgttttgtttttaagcaatcattgcttttcagaggtcactggaattctgctcatgtgtgctcttcctacagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaaggtaagaatatcttgactgaaattctcagataatacataagggcagaggatggtttttcattccctggaaacagttgtccctaaagcctcttccaggcaacctggcattgggaattcatataccttctggtgagctcagtctacctcagagctagttaagtccattttatttacttttacacatataggtaatacttgaaaatattctaactataaaaaattcaaacaattcaaataatgataaagctgcagtcctcctctacctaccccaaccccaaccccatccacaacacccccttcactgcctgcacctcagtcccctccccaggggtaaacttttatcagtttcatgtctatgttctggagcttggtggtatctacttacttacatatgtacctatggaaatatatgatttgggacttgggtttttttttgtttggttcgttgattggttgtttatttttattttgagctattggaagtttttaagctggtaaatggccctatgttatgtttttaaaggtaattctggctgggagctgtggctcacatctgtaatcccagcactttgggaggccgaggtgggtggatcgcttgaggtcaggagtttgagaccagcctggccaacatggtgaagccccatttctactaaaaatagaaaaattagctacatatggtggtacatgcctgtagtcccagctactctcgaggctgaggcaggagaatcacttgaacctgtcaggcagaggttgcagtgagccgagattgggccactgcattccagcctgggtgacagagccagactccatctcaaaattaaaataaaataaaataaaataaaatagtaaaataaaatataattctctccatgcttgagagcaagaagaaaagctgagaccacttggaaggaaggcacaataatctaggaaagaaatgacagtgacttaaaccagtagtctgagatggagagaaataaatgcatttgagaaccatttaagagataaaagccacagaaactggtgattgatttgatagaaggaaggtaggagagggagtcatcagcagataacccaggtttaagacctgggcagctggtgagtgtagcactcactgcactggagaacagcaggggaaggacatgctggggcagagctttgcatatgttgagctaaaggtgcccgggagaggcatttcaagatctccattaagcagtttgatatgtgagtcagaagaagagagagccctccaaacagaacgtatgcactagaatagcagtgatcttcacaaatgagtagttttttttttttttcttttttttgaaacatagtctcgctctgtcacccaggctggagtgcaatggcactatcttggctcacggcagcctctgcctcccaggtgcaagtgattctcctgcctcaacctccctagcagctgggattccacagcacacaccaccatgcccacctaatttttgtatttttagtagagatggggtttcgcatgttggccaggctggtcttgaactcccaacctcaaatgatctgcccgccttgtcctgccaaagtgctgggattacaggcatgagccaccacacctggcccagcagtggattttaaaagaaacactaacatgcaatctggagggagagcaatacttaggaaataaatagaaattgaactagaaaagggagatgaaaaagtaacccaggaaatagaagacaaattagaattttctttgcagcttcatgggtattaatggaaaaaaccatgttaagaggacagaatttgcttttaactatatgaaaagataacaacctcatttataagagaaattaaaattaaaaccaagttgagaaacatatttccaactatcagattgacaaaaatctaagttttgcaacatactctgtgatgaggccgaaagaaaccagctgttctcatacatttccattggaaatgcaaaatggctcaacactgtggaagaggatttagcaatatctaaaaataatacatgttttaacagaacaatttccacttctaggaatctatgccaaagatataccagcaaaaataagacagaagacatatggagaaggacattcactgaaagattatttgaatagcaaaagaatgaatacaactcaaaaatctctatcagtacagtgctgtgtgaatcaaaagtatggtacctccacccaagagagtaacattattcaggtataagaaaaaatgaagaagacttctatgttctattatggagtgatccctaagatacatttttaaatgagtaaagcaaagtggagagaagtgcaaatagtatattatcattgtttataattatataattagaagttgaaaggataaacaaaaaagttacttatagcaagacaggaagctaaaagaaaaaaataatagctagacttctttgaatataccttatttttacatttgattttggaaccatgtaaatattttacatagttataaaagaaaatgaaataaatttaaaaattgattcctaaaaaatttaaagtaacatgaatcaactttaatgtggttcaaattggtagcaaaatcttacatgaaagaatgatttgaagtgactttaaaactctgtatgtttggtatacattcctaaagggatatattttaaggatttttttaaactaccaaaaaaaatctaaaatctaaactacttctagtactcatattgctggttgtcatattgctactgctatcctgaggccattgtatttatatcataacataagttaaattactatgttggtgtcattgagaactgagattatcagcttggttgaaaggagatacagatgcatgcagttaagtaacaattctgtagtaatcctgaatctgagtgggaagtatactaagaactcatggtgtgtattatctttcaatacaaaagaatacatattcactgctctgttcaccaaaaagacctgggaacggtgaccaattcaatagcaatgacattcctgatgcccagaatgtgctccccaaatacagcttccactcaaggaaaccagggatcccagaagaaattactgattctaagcgcggagcaggaaatttataaaataaactgagattattttattataacaagcaaagatgctaccaaacactacaaagtttttgtcaaaggacttggaaaccaagttgagtaagcttctgttggcccagacaacatcaataagagtaatagattcatgagttcctaacaatactgaagaaaacaaacaaataaaaaacctctttggccacctatggagaatactaggtaaacaaactcattattttgaaaaccagtgagtaaatgaaagaataaaacatgtagtctgtcttttctatatgaattgtatttcagggttactaaatcattgatgaggggactttttctttacagaattccagctaatataggaataaaaaatgggccggggactgtggctcacacctgtgatcccagcactttgggaggctgaggcgggtggatcacgaggtcagaagatcgagaccatcctgcccaacatagtgaatgcttatctttactaaaaatacaaaaattagctgggcgtggtggggtctgcctataatctcagctgctagggaggctcgggaggctgagtcaggagaatcacttgaaccagggattcagaggttgtagtgaaccgagatcgtgccactgcactccaacctggtgacagagtgagactccatctcaaaaaaaaaaaaaaaagaaagaaagaaagaaagaaatgacagaatttgaaaatcaccattttgcaaacaccataatctaggcaatgattattgctgataatattgtaaaaatagaaacaacctttttcataattacagaatacacaataccacctttgaagtaggcttacactcaaaattgaatctgaatcttatcaatcctccagatctctgaatttagaagatacagatgcaaaacattaaataacaccacagggatgcaatcaaccaaacccagaccgctggcatatctacgggacacctgatttagtttctgcaacaaaaccaaaaatttttcctcaagggcaaattggaagtggaaacaatgtattaaaaaaaaaaaaacagaacaaaacaaaacttgggacatttcagtggatcttaaaatatggatcttacatagatcttgattcaaacaagcaaccaggtgaaaaactttacaaggctaccagggaaatgcaaatactaactgtatatttgatgatattcatgcagtactatttttagtaattttttttttttgaaatgtagtctctctctgttgaccacactagagtgcagtggcaccatctcggctcactgcaacctccaccttccagttcaagcaattctcctgccttagccttccgagcagctgggattacaggtgcccgccactacaactggctaatttttgtatttttagtagagatggggtttcaccatgttggccaggctggtctcgaactcctgacctcgtgatccacccgcctcagcctcccaaagtgctgggattacaggtgtgaggcactgtgtctggccaataattgttatgatcactttaaatggtgttaccttttagggatgcatattgaaatacagaacaaattatatgatattagggatttgcttcaaaataagcagttgggaatgggagagcttgtgaatgtaggtgactaacattggtcatgattgctaattattgaagctggatgattgatattagtctctctatctctgaatatgtttaaaattttctataataaagaacctttaaaaggcagaaaaagcaattagtaataatggctaatacttcagagaagaaacatcaggacgggaatatgtccattgtatttagcaactcagaagccactagtgtccatggcaaaagcagtgtctttggagtttgttgagggtgggacaaaaaattacaatacgttaaagaatgagtggaaagcaagaaagcattaaaatcaagatgttttctttcctttttttttttcttcttgagattagagagagctcaaggatgttgctgctgtggaagagcctgtgaaggagagtagaaaatctgtaagtgtaaggtagagaaagggccgtgaaaatgttgccacaaatgaattcatagcatggacagggaagtgaattttaaatctgagcagcaacatctcttctgttgtaacagaagagcaggtaaggatgggatcatgtgtgtgtccgtgtgtagagttagtgaaggaaagcagagcaaactctcctgtgatggctattttcttaatgctgtagggggttaaatactctgctgagtgggaagtggagctactgaagggagcagatttcagctgatcacagaggagaataggaagagctgattagggaatgaaagatggactgtggtcagtgtggtgggtccagttgcggtcagaaaccagaatgttttagcagcttcaatcttcaggactgatttcctccaagaaagggcagcagtggaaatatgggaatgaatgaagggcaaagttagatggatgtgggcaggagccttaccagagtgtgatggaggggcaatagagcaaggaattgggagatatggacaagaaagcttctgatgttataggctaaggatgctaagctggagcagaaaggaaataaaaacagacaggagaaagtaaagagagcaaaggattggatgcccctataagatcaaagaacaaggatgaaggaagtaattgaataagagaattagtaacataagatattactgttagaaagtgagatgtttggatttagtatttcacaactgaaatcattccaagtgatttttttaaaaagtcaaggatgtggtcatgtgtatagctgaagtctagtgagggtggaattcactgcaaatgaggacgtcacaaaaggtcaaggtgctggtgtgttgtgggctttggagtgggccagaaaatagctagactgggatggaaaaggaaacagcgatcacagtaccaaagtcctcagtgaattaggaggagacatcaaaagaggtagagaatgatacagccagatggcctgagcttaaaagaaataggactttttactggaggcctaagaagcggtaaaatagccctgaagagcaagtgagaagctgaccctctcactatcttgaaatagaatacatgataatgaacagcttctacatgaggaaatggcagaagaggtggtgaggttagggcagagctaggattccactgaggcaggcaggagaagtagcttcccatgagaaggctgaggttggaggcaaaggcatgtatcatggaataagagatgtggggcaggggaactgtaggaacatcgggaaagaagagtgcagtgagtgatttgttccggtgaaataagtactaatagagatttctagaaaatgctctgagaccccactgggaatgggaaggggagacggaataaaaggggccaaggattcagaagaggatgctaatcgttacatattctagcacaatgaggttagcatgaagggagagggaattaaaacacattacattgccctccctctactcccacagcacctcctgccgcaccacgtttcatcattaaccactgtcagggaagaccacattgaagcagaaactttgtcggagtggtttacctggcaaacagagaaccaggctgcattccaggcagctgagtcaacaaatgtccaagcagccattttcatccaaatggctggaaggttgggatccatttagggaatgaggctggaaagataggtctatacttgattgtgttgatttatttttattttctaggtggtgacaagtcattttaggagagaattaatcaaaatttgattttaaggagtttgctttggaatactgtggaagatgaatttgtgtggggagccaagatcaacatttatcgaggtcatactatgtactaggcattgtgctaaatatttgaaatacattagttcattaaatgctcacaataaacctgtgagtagatgttagtatcccattttatataagaggaaataggcacaagagagcgtaaataacttgcctgatgttcttagtgaataagtggggaaactgggattcaaattcagatttgggtgaccccaaagactgtgttcttttccacaccatcgtgttaagcctggagacaagaagcccagttgtaagtctggtttggtcatccaggtgagagccagaatttaggcagtgagcttgtggaggagaacaccaatctgagaaataaaatcaaccagatgcagtgaccagcagacctgatttgagaggggagtcagtgatgattctgatatttctgtcgttagcatctgagtgaagaatggtggtgccagtgactgagacaggacatgcaaggggaggagtgggcttgggttagaggtaggaaatcagtggtctgggcatgcttagactgaggtgtctggaaattcccacaatgtaattgaagatatttgtcttagtccattcagggttctataacaaaacaacttagagtgggtaacttataaacaatagtctttattgctcacagttctggaggctgatatgtccaagatcaaggtgccagtagatttggtgtctggtgagtgctcactgcctcatagatggtgctttcttcttgcatcctcacatggaagaaggggctaacaggctccttgaagcctcttttataaggatactaatcccattcatgagggtggagccctcatgacctaatcatctcctaaagttcccaccttttaatactatcacagtagggatcaagtttcaacatatgaattttggagggacacaaatattcaattgacagcgtaatactgaagctcaggggcaaaggatgagttagaaatatagatatgacagtgatccatcatttattccaaaggtgaacattataatagaacatgaattgaagaggctatgaatgcaatcttggacctgctgatgctgcaggtgctgaggcgtgagaacaggatgctcaataaagaatgtgataaagactgttaaacaccagagatatcaagaaatacacagatggcaaggcaagaagagggtcacgtggacctcagtgagaacacttttagtggagcactggagacagattgtgagtggttgcagagtgaaaagggaagacagtagacacagaaaatatagactagtctttcagacatgaggcagtgaacataaggagatagagaggcgactagcagggaaagccaggccaaggaaggattttattattatactctctgagagacctgagtatatttgcggcctgaagaggagccagtgaaaggtgtatggtttaaaaaatggaggaacagaattcaccgctatataactcatccatgtaacaaaaagcgacttgaactccaaaagctattggaataaaaattaaattaaaagaaaaaaccagaggaagattatttcaagtgaccatgtcaggtttaggatagggagaagaggcaggatattggcaagactaaaaaaaggcttacaagtaagtttagctacatggaagtggagggagaaggaggaaagaagagaaggtcccccatttcttcggtggagtcagaggcagttatctgttaacgatgatgggaactgggatgtggtagggagaggaaggaggattagaccaggtcctgtaagagatgggacagggccctgaactgcatagatttgaggaccagctggggctaaatatcacagatgtatttcataggtgatatctaatttaaattttatgaggtgataagaagagtgccaagaattgtgtaaaattgccattgtggaatctcttacaggaatctcctgaatctgacattcaaagctgtccacagtctgtccccaccattactagagcaggtgaacagatccaggtttgggagatgcaccacttctttacaattcttccaagccagtgttctcaaaatgtggccccagatcagaagcaacagcattacctggggcttattagagatgcaaaccgtctgggccccaccccagaccttctgtgtcaaaaactctggggatgggagccaacaatctgtgttttagaagccttccaagtaatccagatgttgctaaaatataaagagccatgccctaaaccaccgtaaagttctatttcaaacatcccatcctacagagctggtggggcagttcagttacattgagggacccttcctttctcccagggttgtgttagagaactggggatctagtttagggttcagacaggagaatgaaaactattgtcccacctgcaacaaggtttcctcatataatgaatatgctacatgttctggccagaggtttgtacggtgaatgtatttgaaaccccaaattaattctaaccctttatgttgtcctaaacagttacgcttgaaacttgacaatatgggctaatggctttctcctcttcttaatctctatgagcgtaaaatttaaaggaagcaatcacatctcttaaaattactaatcacaggccgggcacagtggctcacgcctgtagtcccagcactttgagaggccgaggcaggcagatcacaaggtcaggagattgagaccatcacggctaacacggtgaaaccccgtctctactaaaaatacaaaaattagctgggcatggtggcgggtgcctgtagtcccagctactcgggaggctgaggcaggagaatggcgtgaacccaggaggcagagcttgcagtgagccaagagtgtgccactgcactccagcctgggtgacagagcaagactccatctcaaaaaaaaaaaaaaaaaaaaaaattactaatcacattttgcaggactatggctgaaaataacctttatcttaataaaagaggcaaagtaaaaaaaatactctcttgaaaatattggaaatggagttttttggcctttttccatcttactgacaatgagaattttcatggaagtgtagcggagacaaagatatgagatgggtaattattgtagtcccttttgacaataatgattaccttcataatctttactttaaacttattgggtaacttggagtcatcttatcatttaaacaaggcaaagaagtttataatagagtcttaataggattagtgatagcctcacacttcagcttgtaaattaaataacataaggaaaaatcctccaaatcgtagaaagaattggtgctaagagacaacactatgaaatagaatgaaatcaaattttttaaaagtctgcaatataatactttgttgataaaatacagtatagtggtggggcacagtggctcacacctgtaatcccagcactttgggaagccgaggtgagcggatcacctgagctcaggagtccgagaccagcctgggcaacatggtgaaaccccgtccctactaacaatacaaaaaattagccacgcatgatggctcatgcctgtagtaccagctactcaggaggctgaggcaggagaattgcttgaacctggagggcacaggttgcagtgagccgctgcactccagactggatgacagagagagactccatctcaaaaaaaacaaacaaacaaaaaaaaaaacagtatagctcaaaaagataaccagaaaagatcaaaagcaaacaattcgacaacaagaaaatttggcaacagaaatatgcattttatacactctactgcccaagaattcacatgtctaacataataataaaatattaaaaaaggaagtctgtattcgagggggaatgtcatgctggaattagcacagtgagcaaaatgaatctcaccctgaagcctatagagaagtccatatgaattcactttgcatagctaaatgattgccagagagacaataacacttcacatactgaaagagagaagtgatgattttaaagatccaaatttaaaatgaaacttctctacatgggatcttagaaatactgtagttaaatgaaaaagcatatttagagaaaatgcaatcattgtcaattctctttgtgatttgaatagttaatatttccattaattttatagggttttatttaaactttccatgaggattgaacaggttgagtttttgaagtgggacaaacatgatattacatattttgggggtgctaagttcctaaacaataccctttcccattcggtttatcttgtgcctttttctaccaaactgcagtttcaccctctacagcctgtatttatccccatgattgccactagacctgcttcttcaaaagttgccctgacctgctttcttgcctgttccaggggtcatttttatcattttccttttctttgatgactttgctgctttaataatgttgattagtcccttggaacatccttttttcaatgaggctgcttttagaggatagtaaaaaaactacatattttagtctgtccattatgatcctttaaaaaaaagtactaaaaatgcattgcctgaataaattctgttgagtaccaactcttaccttttactgtatcttagcacattaaatttcctgtccatcaaaacatgctggagctgatgctcagaaataaagtatgtactcttggctggattaagacattcattattccactcagcttgtctgtttgctgaggttttggataattttttttcctgtgctgcagtttagtttagtggctagacaagttctgagtctttggatttttttattaatgcatccagtttggaaagtttcagtggattccagttaaattttgggttaatatttattttggtcctggtacaacttcagggggatttaggttcatgatactgttcatgtatttgccaggtcagtccctttctttagacttcaatgggcttatgtttcttctatttgtattaaatctatcttctaaatcctttctgctctcaacttttgggtcttaaaattcaattccattatgtcgactgatcaggtatatggcctaacttaacccatgtgtttgtatttggtgtggattttggacaccaccctggggtgctgtcatccaagaacctttcgtgatacacatttgattgatggaaatcactgacttcccctgaatatatcttgacattgtagacattgtacaatctttcctagcagttaacatgcatctcaatcctctaatcttttaacagtgactctgctctgagaataaaattttctaagtgactggagaattatgactttgcacaaattagaaagataatctttaattttcaagcaactactgtgaaatcaataaatattacctatttcacttttacatcctctgatggggttaaaatataagatggctgtcttagctgattgttttccctgttagctactagaaaagaataatttgaattttatgaataaaagagacaagaaacattttttcctgaggaagaacatttgttattcctttttaaatatcttcatttaaatgattatgtattacaataaatgttaagtatgggtatattataaataatacaatgattaaaaaatttatctcttgaatcacagtgagtatgcaactgggacagaattgccatcctttccctgtaagactgtgagctccttgagagtaagtccctgtgttttttgtctgtatcccattacctggcatagtgcttgggacctggtaggcactgagtaaatcactgaattaatacatgaataaataaatgctggtttttaaaaagatgtacattgaaagcatactatagcaaatatttagttagcagtagttttgagcagtaaaattcatagccataatttagaaatataataattagaaactgaggttaagctttaaaaatcctactaggaaatatttaagaaaccataacattgaaaaaagaaagcagaagtttgaaggaaatttagttaggtaaagggagaaaggaaagggcattcaagcagaatgaacagagtatggaaaaacacagacacatgagatagttagtactctctagctgtgtgaacctagaaaagttacttaacctctctgtgctgcagtttagtcatctctaaaatggggattaaaatacctcctatttcatgaagttcttgtgaagattaaatgagtgaatagttgtaaagatgttaaaaccatgctaagtatagggtaagaatattaaagatgtagcaatagtaataattaccactattactgttgaatattatggtaattgttgctgttgttatttggatgctaaagtgctttagtaaggctggagcagtgggtacaaggtgactggaacagaataatgaaaggacagctctcgggacaaaatgggatcagatgacaaaaggcaaaaaggcagccttgtgatgccatgcgatggagtgtagactttcttctgaagatgacaaaggtgacagcttatgtgaaagtagggccacatcacctcttgcctgatgtcatgtagactgaaggtgggcagtaaggacatcttaccttctcctcagtattttgaacaacagtgatagtgtaatgtcctacctctgatgactgctctatcaaattaccagcagtatttatgttccagagtaacccctggatacatcacatgcatccctcctatctccacagtagttgattggattatgaatgcacactctcacaattccacctcataaaatgatagcgacttcattgactggagtatttacttttgcaatccttcatgaggctgccccgcccaattcactacatctaagttttcagacgaagccaattatgattacaatagtcataataataattgtagctgcatttaactgaataatcacatgtgactggcattatgccactgatgtcacataattttaagtgtatttctgtaaatacattgccacacgacctcatctggaatggatcactgcagaattatctcatctggcctttctgctagctttatgtttactggcttctatattttatcttcagtttggcttttctttttatcaacttataattgtttttaaatttggggggccaaatatatattcccttcctcatccttcttggttccaacaaactcctgtcactagcacttctaatcctcacccaaaaccccattagtcttttcacacctgctctccaaagtcctgacttcttgaaagggatttaaaagtggcaagacaaaaagacagaggtactttcatttgtcttagatctcaggaaagtatgtgtaggcatatctaggtatattttaatatttcttttatgatatctatgtatttctttaacttgtttcacaatttagtgcatacttacacttttttttagaataggatattgctttgttcatctttatcccgtgtctcacatatgttagtttcctagtattacacacaatgtggcatgagtagaatttgcccattaaaaataattactactttatcaacatgggacaaaaaatattggaagattattctcattcttctggtactttgtaaagaatagatataataagaattttgtagtggaaaaatataattaattttttaagctttctttttttattatacttctgggatacatgtgcagaatatgcaggtttgttacataggtgccataggtttgttatatacacgtgccatggtggtttgctgcacccatcaacccgtcatctacattagatatttctcctaatgctatccctcccctagcccctcaccccgcaacaggccctggtgtgtgatgttcccctttctgtgtccatatgttctcattgttcaacttccacttatgagtgagaacatgcggtgttcggttttctgttcctatgttagtttgctgagaatgatggtttccagcttcatccatgtccctgcaaagggcaggaactcatcctgttttatggctgcatagtattccatggtgtatatgtgccacattttctttatacagtctatcgttgatgggcatttgggttggttccaagtctttgctattgtgaacgatgctgcaataaacatacatgtgcatgtgtcttatagtagaatgatttataatcctttgggtgtatacccagtaatgggattgctgggtcaaatgatatttctggttctagatccttgaggaattgccgcactgtcttccacaatggttgaactaatttacactcccaccaacaatgtaaaagcattcttatttctccacttcctctccagcatctgttgtttcctgactttttaatgatctccattctaactgacagtgaggttttgatttgcatttctctaatgaccagtgatggtgagctttttttcatgtttgttggccacataaatgtcttcttttgagaagtgtctgttcatatcctttgcccactttttgatggggttgtttttttcttgtaaaattgtttaagttccttgtagattctggatattagccctttgtcagatgcatagattgcaaaacttttctcccattctgtaggctgcctgttcactctgatgatagtttctttggctgtgcagaagttctttagttgtattagatctcatttgtcaattttggcttttgttgccattgcttttggtgttttagtcatgaagcctttgcccatgcctgtgtcctgaatggtattgcctaggttttcctctagggtttttatggttttaggtcttacgtttaaatctttaatccatcttgagtggatttctgtataaggtgtaaggaatgggtctaatttcagttttttgcatatggctagctagttttcccaactccatttattaaatatggacacagggaggggaacatcacacactggggtctgtcgggggcttgggggttagaggagggagagcattaggagaaatacctaatgtagatgatgggttggtgggtgcagcaaacaaccatggcatgggtatacctatgtaacaaacctgcatgttctgcatatgtattccagaacttaaagtataataaaaaagaatagttttcaaaaaataattatatttatttttccactgcaaaattcttattatagttattctttacaaagtaccagaagaatgagaataatcttccaatatgttttgtcccatgttgataataaagtagtaattacttctaatgggcaaatcctactcattccatattgtgtgtaatactagcaaactaacatatttagactcaggataaagatgaacaaagcaatatcctattctaaaaaaaaacagtgtaattatgcactaaattgtgaaacaaggtaaagaaatacatagatgttgtaaaagaaatattgaaatatactaagaaaaaaactcttctttttctttccagagtgaagtaactggccctcccataaattctagggaaccaggcctcagtgtttattactggaaatgcaccagctttgtggaagtttctggaaaggaatgttgtggaattggtgattaagtggaatagctttctcttctgtcccctggttcattgacttgatctaagcccaaggcaaaagtaagaggaggtctcttataatctgtcagcttccttctcacttaggaccttccttaaggattaaaaacttaacttttaaaccagagttcctctttacctctctgccagacccaactacattaagggatttgacgggtcaccaatccaggagggttatgcatgagacacttggcttccacccacctatggaatttaatttatgcctggttggtttgattttttttttccctcaatcaccctcctttaacaaaggccagtcaatgagctgagttttgctgtcttctgctattaggaccattttcttaaggtagcaatccatagaccatcacaatgaagtgtgtttgtgtctatgagtgtgtacctgtgtgtgacattctttcttttctttacagtattttatgtttagcttgatctgtaataaattaaagtggtcatgcttttctctaaggatgacctcctccagctccactcaagaaagtctatttattgggaaaatagttccttaacagcagagaaagactatatcttctttatcaagtttgtgacaaaattattaccagtttctctgaggtaggtctctccccatgctcattcttcctacataatccttttagataatctacccaaaatatacttttcattatgccatttccttatactacaacatacagtagtgtttgtattctgtggaactctaacaggcatttctcaaaggcaagagttccatgatttactctctctatatatatctatatctatatatagtatatgcatatagcatatgcaaatgtatatttactatatatatagtgtgtatatatatatgcagaaagttaaagtcaacaagcatctgtagtaagaaggtcttttttaatttattcttcacgaatgagctgcatatatggcatgtgaagtttatcagagtgacctaaatacgggattggtttttaaccaagcataccaaagaatagtagtcctgaaaaacataactctggaaactaactgataattgcattacttgctttcttaatcatttcaaacacctccacctgcatttcatggttcttcacacttttagacaggtgtctaaccattagtctcataaactaggcacataaatgtccaggggcaggtaaagttactggagaagtgtgtggtgctcctgggtgtaggaactccagggagaattaaagaacttgttaaacaaggtggccttaatttgaaccccttaaagtttctgggttttgactggaactggagagatcagaagttgaggagaatgaggaaagtattggaacttttggaaatgggtgtgctcagtctgtgcgagtcagagtccttgaaactgggccttttctacgtctgagtcctaatgaagattccagttttcacagtagaagttaaagaaaaaaaatgtctagaaaggagtgatttagagatctttctaggcccatatttttcccatcttatgttaattgtaattgggtcagttagaatttggtctgttaaataaaatggtttaatattttgaactgtccacctattcttacataccatttagtagtggactcagatgcctaaattatctaccaggttttttctggctcaataatgcaacactcctatagtcagaaaacaattattgtaataattttaatcaatgccagaaaatttaatacctgaatatgatgtaaatgttttttattgcatttatgtgttagttgcttccctcttttccactgagctgtagcttcttaaggtcagtgatcatattttacatctattctatactctccatagctctcagtcagggtactaaatgattaatgtgtcatataggctgattgtcttattgaccaattacatatcaattaaattaagttgccagcagtcatatttctggcaacaattataggacaggataatctctgaggttttatatgtattgtgaatttatttccatcctcatttggacaccctagtgactgaaacacaactgacccccatggacctacaaagacacctcagtccattccttattgatgtctctgactactccattctccatttatcacctttttttcactccattgatctttcctcttctgtccaatcaaatgtacaatgtttacataccaaccaacatgttatcattgcaaaacatgcaagaataacagcacaaatataattgacattctaccatgaagtaagggcaaatattgtcttctctatcctcgtagtcaaaagaatactagatttgttagattttatcaattatttattcattaaaccagcattcatggagaacgtaatgtgtttttaaattcatgctttgtgtttttaactttgataagaatagaaacgtgacacgatctctggtgccaacaggttcatagcctacatcttactactcaaacttgtgtaatcaatagaacttctttaaaaagagatgttttgtccacctttagtattgcctgaagttagtttcatgtaacttaaatacatctagacaaagaacaagttatacattccttatacttattcattcaatacatgaccatttattgagagcttactatagttcagttactgggagtatcacagtgacaagggcagacaaaacccccccgacttcacaaactgtttattctggtgggaagaaacagtgtggaaaccaaagaaacaaatatagttaattatgtttttttgagacggagtctcactctgtcgcccagtttggagtgcagcagtgcgatctcagctcactgcaacctccacctcctgggttcaagcgattctcctgcctcagcctcctgaggcaggaaattacaggcatgtgctaccatgcctggctaatttttttttttttttttttttttggtggagacagggtttcaccatgttggccaggctggtctggaacccctgacctcaggtgatccaccagcctcggcctctcaaagtgctaggattacaggagtgagccaccgcacctggccagttaattcttgttatgtacaacagttgtattctataaagttgccacaaatgccaaactgacaaatactaaatgaaccattgcttctgagggagatactggatttgattcctacgaccttctggttacaacattttcatcagcctatgaatacattatcttattgtatgtgtgtttctgtttaaagacacttgatttaatgtgtattgttggttcattgacattggatccttagccaatagctcatgcctgaaggatgcttgtttaacacatgtatttttccagtagggcacatcacagccttctggcacttaggaacactagacagcacttcagcactatgcttggggccattccaaacagtgaaatcgaaaaaaaaaaatgcaaaaaccatggcaccaaataggcaacaaaaaaaagatatttgtttacaatatgagagctgaaacaagaaaggagtgtagtcttattctgtctgagctgggaacaggtacatcaggggactcaaattttttgccactctttgcttattcatgaatgatctaggaatatttattttggggttacaagtaaatttcagaaagtaagagaatttgcaaccatggaatccataaaaaatgaggactgatttcatataataaatattcagataggaatgaatgttgcaaaaaaaaatgaaacagatctggagagtgatgggggtttggaagaactgtttgagctgggtgactaggacagtctgccctgaggaggggacactttaatagatacgaatcttcaaaagtagttagccctgtgaagatggaggacagagggagcaagtgttaaagtctgtgaatcaggagcaagcttgacttggtttgtgtgaggaacaggacagaggtcttcatgcctgcaacaacaacaacaaaaaactgaaccgacagaagatgagcttgaaaagctaatcagtggtcagataatgtatggtctttttggcctactaagtggcttagactctgttctaaagggtaatgagaagccactgagggttttaaaatatatttgagctatagcttattagataattttacagccttcccccaaagtttacaaatcaaatttacccccaaacaataaccatttaagtgaatcacattaacttaatgtgacaagtggatgcttcactgaaactaaagttctattcacagtatgactatcgggctgacttccctggtgcaggttcttcccagttcagccaccttcgtgaccctgtgtgggtgatggctccaagaaccaccctcctgtggcacaaatccatcattacatattcatggttcctggatgtggtctcttcccccaagtctctcacgactgtagcaaagacactccagcaggcctgaagtccgacatacatggttataaggcagcagcaagcaggtgatccctagcatgctttttgactctcatctaaaggaaaacataaaataaatgtttccattagagaactcatagataccccacaatccctcaagaaggaaacccacagccctgcaaattgtttgaaaaccttgctctcacagaggattattagggcagtgaaagtattctgtatgatgctataatggtggatatatgtcatgataaatatgtccaaacccatagaatgtaccataccaagtgtgaaccctgatgtgaactatggagtgtggatgacaatgatgtgtcagtgtggatccatcagttgtaacaaatgcaccactctggtaggggatatttacaatgggagaggctgtgcatgtgttggggaaaggagcatatgggaaatctctgtatactttctatttaattttgctggaacctaaaactgctctaaaaaataaagtctaaaaaaaaaaacccttgctctacatgcaaaactcaatgacgcttcagtaatgaaggaagagtgtatttaaatactataacagcgtaaggcagacacaaaggcagccccaaaatggaacaccgaaaaagaagtcagaaaacaatggctgaggctggagaaaatgagacatctccctgtgttctgtcagtgtttgagaggggattgtggggtgagggaggactttatctggatggcaagatcagaccctttgcgaggagagagaatagtacattctctaagagcagaaagcagtgtgaacaaaggcttggagaccagaatgcgttcagtgtgtggaggagatggtgaatgcagccgactggctggaacagagggttttaattaaggagcgaaggggaaaacacacttggaacgcctggtcctgccatttcagcacgaatctgcccagtgggatcagatggtggtattcatagccctggactgtcttgtcaaagtgttggctgtggaatctgtagcatggaggtactttctcaatgtagctatttgtactgagcctgtcactagctcgggaagaggtaaaaattacttgacagtgtctctggactctcacccatccaaagcgtaagagaggatggggagtgtcagagtgggtgggcattggggaaagtgagttcttaagaactggagctttcagtgaaagagaataaagggcattaggaggcttacctagagttgggcggcagtcatgccaggcaagcaggcccccacagtggaatctccgaaccctcccacttcccaatagtgagccgttcacccccagagtgcttgatttggtatggaaaaagagtctctctctctcttcctctctctctctccctccctccctccctctctctctctctctctcacacacacacacacacacacacgcacacaaacacacacacacacacactccaatttatcaaaaatcactttggaatttaaaatctcagctaatgacctttctcagaataaaaaagtcacattttcgtcaagttctatgggttccctattaaattgcaaatgtggaccatttggcatatgcagttcacccatttaaacccatttgactttgtaaggcggggtgataacattttggatttcatttttgtttgtcctataagagtcttgagttttagccaaaaacccaggccttggatgaatgtgctttagacctcactttttgtcacaaggccaagtggacttgagagagagggtggagcggtctgttgaaacatgatttttagttttgcccttcgcctctggagccagggccctggcccacgtccagctgcaggaagagaagatgatggtattttctaggtaattttaaggagcacaaacctaaagtaaagtcaggtggtttcaagtctgcactgaatttttcatgttaaggatttatcatgatttgggttttcagcagagctgtattttaaatgatgaagggagctgtattcctgtattcttccggagacagacatgttttggttgtttgctaatgacctctggttttgcttatggggagttttgttaacaaatggaaatttagcaaaatagaatactttccttcttttgtttttttctttttttttttctctctaaacaatgggaacccttgcagtaaactgtcaaaaccaggctatagatatttgttactgtagcatcattaatactgtgtaaatataagttagtcgcttcggcaatcagacatattcttctgatcttctgtctttgcttttaaacagagcctttgccttgctgtttgatagatcctattgttaagagaactgcagaaatgtattcaaaaattcttcaaaatttttccaacctcaggaacctattcaacagtaattagccttgaaggcagctgattaaggactctcccaactcactccccatctcaccctgtagccaccatttctaaaataaaaagaagtctgcagagggtgacaaaattaaaccaaatgaaactttaaactccggtgcagaagacttctgtctcaggaaaaagtagctgtcttcaaggcagaactgactgactggattgaactgaattataatttctggttcaagctgagttgtgtccctggggtggtttgacctgtttgtattagctttccactctccatccatatttgtcccggtggtatcaggaacatcacagaactatgagtatgacttaaagctaagttgaaaagaggctctgctgtcttcagaaaggggaatatatgtgtatgtgtgtgtgtgtgtgtatatatatgtgtgtgtgtgtgtgtgtgtgtgtatgtgtgtgttttctttcattacaggcagcctgcctctttcaatggaggcgcaatatagctgatggttgagccgtagtcattgattgcaaagggatgtgtttaggaaggagagaaatagctgctcagaaattgccttctttctctctcaaattgcactgttgggggaattacataagtgcagaattgtggggaactgtgcgcatgtgtctgtgcattagaggccaagaggaaaaaaaaagtctgccttctcttctcatttgagaattatgttagtttgttagggctgccataacaaactaccacaacctggtttaaacaacagaaatgcatcctctcatagttctggaggctagaagttcaagatcaaggtgtcatcagggttggtttcctctgaagcctctcgctttgacttgtaggtggctgccttctccctgtgtcttcacatgggcttccctttgtacacgtttgtgtcctaatctcctctttttataagaacaccagtcatactggattacagcccgcccatacaacctcatttaatcttaattatttctttaaagaccttacctccacaaacaacagtctcatattccaaggtactggaattaggacatcaccatatgaatttgatgatggagagagagggtgataattccacccataagagctaaagatatttcattatcacaattgatccttggttatggacaaataaagagttaaccataaggcctttcactaccgccacctcctaatccttatattgaagggctccagtctctccaaggctgaatcccagaggcaacagaaccttgaaggacccatggatgtcgagggaaagcagcgggaacagttgatgcaatgtggttagcgggagaggtggcttggctgatgctgaatgcagagaccgttgatcaccatcttcagaatacatttactgactggtgcagggtatttagttgccctgtggtgctggtttggattcaggcttctttagagtcagtgcttgtttctaagcatcattgttcttctccagaccaaacatatcagaatatttcatggaaagaaatattcatatctctctctctctctctctctctctctctctctctctccctctctcagtgtctctccaattgaaatttgtgtgtttcagggacatactgatgctttaagtcaaaggataagtttatttgtttttaatgagatacaattaatcagacatttaatttccattgctttgtccctgtgatccacaggaaatttgtggctagatttcctactatccaactcactagtggcctacctttcattacgatttttcatatagctttcttgctcagtagcagtttcctgatcttttcccgtggtgttcaaacatgctgaaatctttgccatgactgggcagcaaatgtgaccttcatcagaggttacatctcaaggtaccaaagtgaggggaaaggttctgaaccaaggtaacatgctagaagcacaatagttatcccaaggaggatgccaaatcaaaaatccatttgagagagtagaggtttggtcctggggagtctaggaaagcccaagcccagagcatcagaggaaggctgaaggctctgttcacaggtgtcagacaaaataggactgaactcaaggctgcgttcatcacctaattacagtccatcttatctgccttccatttgccagattgtatgccaagtgcttgagacagaaagcaaagtaagaaatggtccaaaaaatcaaggatggtgtatctaaatggacagtgggtggtcttaaggcaaaaaaaaaaaggcagccctagacacacactcatgtagtagtgttatgatttgcttagatattagtggttgatgattagatgggttcgattaaaatatctcaaacatggcctaaaatttgggttagcttgcaaaccacttgaagaatcagcgtgcacccacatggaccattgccacatttgccaaccaccctcaaccaaccatattaatcttccaacacttctcagtttaagaccatcaacgaattcctaattgctacattcaatggtttcttggtattatccacccctcattcctgcagctctctctagcccagttatgttctcctgctttgtctaggtcctctccactggttctctctcttctactctctcagcccaaatgctcaaaatttcctccatagtcctccttcttctccatcctccccactcttttctttttttctttctttctttttttttttttttttgagacagggtctctctccgtggcttaggctggagttcagtggcataatcatggcttactgcagactctatctccaggattcaattgatcctcccacctcagccttccaaatagctgggactacaggcattcatcaccatgcctggctaaatttttggtttgtttgtttgttttgtacagacagggtttcgccatgttgcccaggctggtctcaaactccttggctcaagcaatttgcccgccttggtctcccaaagcgctgagattacaggcgtgagccaccgcgccgagcatcccggctctttcctctcccacagcacctcgtgtgactgattctttagtgtggacttcaggcccactctctctttcaacttcagacctgcacttccactgtcagcctaacctgagtgtctctaccagagactcaaatgcactgtgtttaaaatacagatcagaccttcctctatttctctattttttctattttctactcatttaatggtattcgtcattcagttgactgcactagaaaagctgaaaacactcttgtgaatgttaaacatctctgaatctgtttagcacatagcacatttatcaatgcacatttaatacattaatagctaattgcagcaaaaagttttaactacatacccaagacttttcataacataccccacttttcccctacccaaaccaaaattattttgttttcattatttcttaggacaaatcctcagagttcactcaggctgtccccacctctcatctttatatccgtctgggaataccatactgacttaaccaggtttttgcatgttttgctctcctcttcttgactgttttccttaccatctgtcaaagtctatgtatctttcaaggcaggttccctcacctgtcctagataataccatccttgaccacatcagactctggtaacaccaacacaccactaccacccccaatcttcaaattcctctggcacctaacatctgtaccacagaatttagcacctggctacatacttgttctctttctttggtataaacaaggcagagagccagtctgttttccagtgatttgcagacatggtaaattcctcccagagtttttcccagaattgtgtctttgagggggaatttatattcttcctttcttcagatggtaaaaacctgggtacctccttgtgatatgatgtgttttcccttttgtcttagttatcaggaaatttagagctgttgcagaaccatattgtaataatcagcttatctcaggatcctggtaatagctatgtattctacctcccttctttagaactctgttgtgtgtttgttcttaattttgcagtatatttaacttgtaagactccataaatccttttagaacaaagtgagaaaacagatccccaaataagcaatattcttctcttattatatcataattttcattctcttacctggattgtttgtgcttgagaacaaaatcagttcctgtatttcttttgattacccaaagaagaaagcatatgttaggtccttaataaatcattgctgaaatatgtgccttgttaaagtaagttggattattttaaattgagacagaaacatctcctaaaatgacatcattctaacaaagggaccttaccgtgttttatttctgctaacggcaggagaaataaacatcttctgatattttgaacattttggtaaatgttcaaaatatcagaaaaaacatgtcataaaaataaaaagttgaagttttagctatcaccggcatctagacataagacttaaaacaggcaagaggattaacaaaatcaatagtttactgccagtaacacttaccagataacagagtgcatttttttcccgcaaccccaaagccctgctggctgcctttctaacaaacacaatgttcaggtggtgtctgacttatttttttttcttcccttatccccattttcattcccctttcctaacataagatggcaaacattaaaattggctttcaatgaaactacctgtgccagtcatcaaattcttttctttctttcctttttttttttttttttatttcttcttaaagctcacccagggagaatactttgactttgaaagaaaccacaagaatgtaatcataaagtcacctccagacttggcctgtgttcatacttcctgtccttttacctccacctctaccctacccacccccaaacattcatacatttatccaccaacacatacctatggctgttaaatatttatgcagacgtgtgaataattcataaaggtacaaacacttttgagacttgaaatttattcagctgactgggcttttccattgtccaacaagtaaggacttggtgaatcctttcttttgctcctttaaccagagtggaaatgttttccttttcattttaatgatatattaaacgagttgccttccccaacctcctcctcctaagtaataatgttgcagagagagcatacacacttagaaagagagagagagaatgagagtaacaaatacgactatctacataattatgagatcaaagatatccccaccccacctttctgctctaacctacattttagtctaatgttggaggataaattaaaactcatctttatccccaaagtagctatttttggaccaaaccaatgtgggtccatcttgaccagcctcctgtgacctcaaccttgcaaattgtccaggacccataattaatactagactattttcccactgccacttccagcatcctgaatcacctcacctcacatttagagcatatttgtttcttgaacagaaattgatttccattcggctttagtgaaacagaataaggtaaacaaatctgctacaaagcaggaagcatattaaatatattttacatttgaacaaaatatgttgaacttctgctatttgtgattctccatgctagttctctccaccattaaaataaatacaagtaatatctgtactcatattaaatataatgtaaaatacataacatttaacaatgggagatgtgggagtgcagagctacataaaaaacctctccttgactctttgaaaatgtgtcttttatatatatggtcaattgttgacgcaagaggtagaattaaacgtttagataattttaccattagattttattagacatgtttgataggataaatctgggcacttgggtatacatttcttgaaaaacataaaatcttctaaatgtcatggttactaaatgtagcgagatcactaatgtgagattagctttggaaactagaaaatgtttacctgagcatgtgagaaataaatatgaagggggaatcaaagtgtaatccatagatctgagtttatatctgatatttttatgcctttctttaagaattgtgtgtatatgtacatatgtatatttaatttatttatatataggtgaaatgggttgttagccagatgttagagtaaaaggttggcagtttaagggcgagggtgaaaatattttgctacttaacttatccactagtaaaatgtggttgcacaatttgacattaaataagtaataaataagcaaaataagtcaagcctgcatattctactttatttgctcattcttctaacttttcaaggcttccaggccctgatacaaccacatatctagctgcctctaggtccagtccatcctcatccctgtacaccctcctaatccttaataccaatgtccaccttttccctccagtctcctaataaagtctctaatcaacctgatcatcgtagatatatagaatgcttctttgtctaaataataccatgttggacatgaaaccactcagccatggtaaaaatagagttggagcaaagcaatcaaaggggggctcttttgaacctgcttgcctcctttactgccacatgatctttcagagagcaagactatcagtccagaatgagaatagcaatcaagagaacagctgcctcaattttgctaatgagccagcttggctgaacctggttttggagacatagtgactctgccctcctcgactcaaataagcaagaagccagaatgtcagtggagccataggcattgaattggctgtaagaggtaattcaaaagagcatccttgcttgcttactgttttcacaatggttctatatagatttgtgctattaaaacgccagttttgaatgagaaccttgggtggagctgatattcatgaaaatcatgccagtgtgggaaacactccttttatgaattaagcaaagcttgtagcttttttccatggctttaaacactcaatactagtcaaaacctgtgaatatgtatacattcttttatatggataattagcttctttattggtggcgcctcttggattaggtggattcttccatgcaaataagcagtagagggaagcagtgcaacaaagaacacctttcatgtggcttcagtacttatttagcaaaacttctacatttatagagaagcaaatgctaaattcctgaacttctataaccttctttcaaattgtttcatattaactaattcaggttaaagtccttgcctaattttggtttatgcacacaaaaaacaaatagaccactatacatagtccattgagaatagttcaccaaaattgtttatgtccaattttgaatttctgaccacgatacacacaggtaaagatatcatttagagatcataagtattgtttgaatattagccacagaagttaagataaatataggatactttgtgcattagaaggatctcaaattaagttgcaaataaagtttcccagtgatagtaccaaattcataacacctcccttgggccaagagagttggttttttggtttggtttggtttggtttgcgagttttggtttacttgtttgtttaagcactttctttttatggtggaagcatccatttttgtgtgagcctgaagttttggggtcctttggtggttttttaaaagcgatattgtggtctcacattttaatgtttcctggaagaactagctagctatttattttaactacttcacaggaacccacatgacaatttttgaaggacattttcttattactcattgtttattattttggtcatcatttttcccaacaggatatagtttttaaggtaagattccatgagttttccttttatttcagaatttataacttagaaattttactgttactttatgccccttttcccaccgacccacatggtaccccctaccacctacccacccaaagatattttcatggtttgggtcatttagagacaaatgcagcctcgagaaccacaacatttttaggtgttaggagacattttaatacaaatcttcctattcaccaaaacactaaatcctattgggatgcctagaggcgtgtgataagagaaaagtaaataatacagaggaaaagaaccattatattctctagatttaactttggcatatatctgacatcagaaatagaaactcacctcttgtgaaatcattttgtttacttgatcaggaaaatctgcaggtctattcattttcagacatatatttataaaactaaagctcaattctagagatcaagtcttattgtaaaacactgatgaatgctgtgagtttcattttttaaacagatttcactacttgcctctcctatgtgaatttaatatttttattccttctctaattgatcaaataagaagtttattattacttccataattttaactttttcattaaaaaccaccctggtgcattttatatgtctgttttcatgaaatatagagtaagaaaaaaatcactgtgatatgaactccacaaaacataaaggaagatggctttaatgataatagttacctttggaaaatatttttacatactttttttccattctatccttaccacagggtaacaaagcacgtaataaagcagttgtagaatcacaaagctaataggagcccttgaggtcagtagctgcagctttccatcgtaagatgcgaaaagtaagatccaaggatgttaagttaaatttcccaaggtctgtagttttccagtttctcccattaccttttctgctccatgctacctttgctattcccatctttcagataatataattatagtccctcacccagagtcatacaaaccttcagtgaactgaaacaggtctttaccttctgacatcatttttttccactctccactgcgtagcctgctgttcatctttactgtctaaaggaccattcctgtactttttctagctttcaggagaaaaagattcctgttcatctcacaaggtgctaaagactcttgcaaatatatagataacatcctcaggatcattaacagactcaggaaatgaaataagcatctgactgcattatttttaaactgtttctacaagttacatagtatgtgcttagtaaatattgatggaattgaatgggagagtaaagaatagaggtaacagatctattgtcttttttaaataaggactgaaggtcattgctatgttttatagaaggaccatatagtcccagcaaatagaggatatgcttaacagctaggaaaacctgagaaccaaatccagctttaccacttaacaacctttgtggccttgggaaagttactaactttcctgaactgtaattttcttttctgtaaataccgtctactttacagagattttatgcggattaaattagacaatgtacatatagagtcaggcacacaacgaacacccaaaaatttaccctcccttgcccttcatgtctgcctgggaggtgaccggtagcccgcttctctgctctgtttgagtcagagtattaaaatcaagctgggctgtgcctggatactttaccattattgtaacagccctggaagcacaaggtgtcacaattttatttcattgacatgtaccacacgtgcagtaggccgtgtaacagtgtagttttcctttttcccttttctttaacagtttgctgatactgaacatgacatagaaaaggaaacacaggtgaaggggtttttttttctagtgaaatttgattgttttgaaaaatgttctttacagtaacttgctgtggaacaatatttcatttactaactggccttgagaattttgtagagtaaatctttaaaatcatgaagcttctgtggctttcatatgtacaaatagtattataagattcattctcacaattattggtcaaatttgcccccatcatctccagccttttcaaaacttgcagtattctaaaatgagtggtaaagcacaagcaagctataacatgtttgtggatccagaaatttatgtctcataaattcaaaatctttagaatctttagaacctcatgcttttaacttctttatgaaaattttaatacttcaaaatatacatgagtttatgatatacatgagtttaccagttctaatactttatgatatacatgagtttaccttaaaatattttatgcatgagacagatttttttaatcaggtcttcagattaccctttgagcctgaataaaatagaataataaaatccctttatcaaaaaacacaactaatattcaaagagcactattgtaagtgacattcgcctgtgcccatatgttatgcttgtgctttgcttggcaattagtggttcacagatgtcaacctacatggtactttgataacaagttcaatcaatcctgatcaagactttcccaacctgtgaatttatcaatgttaaacagagcctttgaaaatataagccttcctcccttctcccaaacacacacgtactgtagcctagaattatttgcacagcaacttttataataaaaggctcagtcttggggtgaagggtgataaggaggttggagaaaggctagagagcaatagcatttcaatcaatactattaaatataagaaactgggttttggtaacatgaacaatagcagttatttccagatacttaaaatgtgaagtctccagaatatactacagttttggttacatttctcagagaagaaactactaaaacaaaaaaggaaataaaacactgaagatttacaggataattaaagaattaatgtatcaaataatatcagttccttagaaaatgactgtttaaagctggatggtcttttaattgatcaaaataaggatttgcaattgtgttacgtgtttagtataggtctgtatgagtctatctgtatgaagacctctataccctcagatatactatcagctgagttgatgaggatcctgacaattgactttttaaagcatatataaacctttaacaccctttgactttgagaaaaatttgttattcgtgttctttaacaaatagtgggctggctagctataaaatcaagaatttgcagtgggaataatcttctactgagagttagaatttaatatttacaagtagtcattgaaggtgcagccactccacattgccttttaaaaaatataaataaggaaaaatgatacaattatgctattttcaggtgtcattggacagttaggttttatcgagaaagtagtttgaatcatgtagtccaaacagggagagaaagaaagatgctacagaaatagccaataagcaaataattttggcttcaaatcacactgcaaacatagtacataatacatactttggcataaaagaattatagaatcataaaatttaaaaaactataaggctaatgtccagttgatcattttgttatctcaatgtcatataattcttttcaaatcacaccctctgtcagatattttttgaattaaaaataagacacatctcactatatccacatagtggcccatctaaaatattctgtgttgctttaatgtattaaaagtttgttcaggccgggcgcggtggctcacgcctgtaatcccagcactttgggaggccaagacgggcggatcacgaggtcaggagatcgagaccatcctggctaacacggtgaaaccccatctctactaaaaatacaaaaaaaagtagtcgggcctggtggcgggcacctgtagtcccagctactcgggaggctgaggtaggagaatggcgtgaacccgggaggcggagcttgcaatgagccgagatcgcgccactgcactccagcctgggcgacagagcgagactccgtctcaaaaaaaaaaaaaaaaaaaaaaaagtttcttcagttctaagcggtgatttttaaatgtcaaagaaatacagtccatagaaagagaactcacagttactacactacatttttgtgtgatatttaggttacagttttattgttttcacactgatttttctcactttcatttcagcagagatattttgtgcattttatattaacagttcacttggagaaatcactctaatatttggagccgattccctacagatacattctttaaacattctgtgcagataggatttgattgttcatattgcatgttatcttttcttgatcttattactctggcctgtacaggcattcagtggaacccatgaagagagtacagacagctgactggatgaagaagacattggggaaaaaaactcccattgtttagatttctgtcagaggatataagaatacttaatttcttttatctctagggctttcattatcatttaaatttcattttacattaattgatcagggattagtaaagccattatgcagaaattagaataagacaagccagatggaatgaataattcatgaagtccaattacgttttatttctggtgtactttcaaacttgcctctgacttctgtgctattttgatgtgacaatattcactggaaatcaagagtgccattttaatttattgtatccctctggagtggaagcatttgtatgcactaggggtatgttaacgcatttccacacacacaccccaacacccaaaagtcaattttgggggttttgaaaacactgggtgatctaggaatactgttcattttgtacagaggttcaggggcacttcaatgagccacaccagttcaactgattggggtgagctgaccctatgcagagagactaaaggcgtaggatcgcgaaatgattacctcctggaagagcagtaatcctctttaaaatatttgcacgcattcctctctgcaaaagaacccttaaaatgtgaatttggcctagagttggactggaggtagcagcagctgttgcagctacagacgaggaccacgaggtggcaggggttgccttcaatgaaagggttcggggcggtcgggaccgccggggcttcagaacatccccgcgggtctgagccgggccgaccacggttgggtttaggctccgagcatctcgcaaagcgttgccgggcgagaattccgaactaatggaaagtccggtccacctgtctggaatgtctcatacaactctgttgtctgaaaccgcctccccacccccggtcccagccaccagccccttgagaggccccctctccccccggtatttatttatgccactggacagttctagtcacattaaagctccggttcaccttctcgaggactttcatctcgggaagttttatgacactttgtgaatgtgcaaagtttttaattaggctctctagacagcccgaggcagcagcagcgccacaaagtcttcacggtctctctgctttacagcacaacaagccgctctactcctttgaagacaatgcagactatgtgtacgatgtcatgtggtcccccgtgcatcctgcgctttttgcctgcgtggacgggatggggcgcttggacctctggaacctcaacaatgacaccgaggtgagcggcggctcaggcgcccgggccggagggctgggaggggggcgcagtcggccactcgcagtctctccctctttctccaaaacggccttttttggacagaccttccaactgcagcagggctgccggcccccattcttgactaccctgaagggaattggcagatgcattggccaaaaatcacttaatctcccttcatccctaaacggtggctgctctcggacaattaacgacccttttttgcaaagagcaaaacgttatgcgttcacacctttccctatgggacaggacacacaggcatttgtcagagccgtgttgaaataactttataggcaaatacttggaaaagaaagcttttgtggacgtcgatttttagattgggcttttaaaaagggctatttgtcagtgtttgctacttgtaccgtttctattttgaatccacaaaagacgattctgttgactattttatgtttagatctctcatccatttgatttgtaccaaggtaaatattccttgtctaagatatcaaattcagaggcagacttttacaacagtctccaactttaaacatgaatatcaaactcagtatttttttaaaaatagattttaacatgtcacatttacagcaagtgaaaatacccatttattttaaaaatcagccagtaataaatactgtttttaaattatgctataaaaatttatgttttaaaaactatgccacatgcattgttcctttttgccagtctagcaaaattactgagttgctaattcagctacttggatttttttttaacataaatattattgtccttcaactttataaaataaaatggtctctgcatcacttcttggtttctgattcaagaaagctctctataaataagaatggacaggtaagaggaacaagtgctgcgaactatatgtcaagtggagaacaacaaaaaggtcttttgaagtgttttgagcaggaaacagctcagcctttttaattaggaagcccacagctggaggatctgaggaggagcacacttccctagtatttgtgtgtgtgtgtgtgtgtgtgtgtgtgtgtgtgtgtgggagggggcagggaaatattcttcaggtgttattattaagtctttgtatcttcaagggtatatacacctataattgctgccaagtagttatcttttaaaaatctttcaatttgagtctatttttgcttttagctacaagaattctgtgacaagaatgagttaggtaatgaagcatctttgaaaataatcaaaaggcatgagtatgtgaaatgtcccatcatttggatgttgaaatgtttataacattattgtttttaatagaaagatgttattaccctacattgtaagggtttcccagagtcttcatcactgtttattaaaatcatattgcttctatttgctaggagaaattcattcatttaaagcaaccaaaaaaactaacattttcctgattgacttaggagaccgctgtagtagaaatccagcttagttgagatgtttaagtgatacccaactacaatgcatatgaagggagtgagtgttctacaaactccttaacaattcctatgtaactgtttttcttttaaattttttttaggtaaaatgaaactaatgtctcaacattgataaatataattttttcccttctctttctctagatatcaagagacaaccacataagagtttcatagctaaacattttttaaaaatcattattggtcatgcaaactgtttagttttgtggtaaacataattctgctttaacaataatagtagagatacattgagtccagctcaaatccagtaatgaaccgaacactttttaaaaccttcaaatcatttttgtcttctggcaagttgaacaagatttttcttaaaaattagatttcttaaaaaaatctgaattatcagtagagcagtatgtttggttgttgtttttattattacatttttggaccaggttattccagctgttcctatgcaaggatagttcatatttcccacctcagtatttctgatttctactgcttaatgtaataatttatgatatataaatcttgcctttgcaattaaaatgattgagccaggaaaactgtggaaatatttgtgaaacaaagtacagtataagagacagagagaacatatgaattgttttttattattcatcaacttttgaaaggtcattactgatcggattaatgcaaatatattttgtcattttcttcatgcatttatgaattttctagcgcataatataggctgtgatcattattttctatcatttgtaatatatatgaaaagaaactatttttaaatgtttaaaatattgtttcactttgttatagtacttatattccaaataaaaattcttgaaaatgtattaggtattattttaaatgtgtcacaatgtcagtttattttcagtgatttttttgttatattcgtattaagattaaacattttattctatttttaagattgttcatagattacctaattctattcaatatcagattgttcatggaattaggtaatagaattaagcaagaatcctgtatgaaccttctaaattatggtattaaaaattaactttgaagagtctatagttgaatcacagatttgttttctgggcagcacagtcataataaagtgtattgacagcattatgatccatctaaattcacattgtttcagcctctgaaagatttggttaaaaattcagactctagcttgcacagcaggtacttttattatagaaattgtgtatttttaaaaaataaatgagccggggacttttggggtttttttttgtttttttgtttttttgctcacaattgacatacagtgatttaagcgggtgaaagaatttttattgatttcaagattaagtttaaacatagattcttatatatgatggagtttttattgctattttaaagataggtattgggtcaataatttcgtataaacagatggtttcaattccctgaataacaaaatgccggtggtgctaagccacagtacatgttgtgtttccattctaatgcgacatgtttattagacacaggtcttaaacagtggcatgagatgatcctagtggcccccttttcactgtattttttctttatgttttaatatttaccttttcctttcttaatggcatgttgtcatttcctattcaacattcttgtaaaaggctcaagagatctgagctttatgtcaattataaacttctaaccttgaagacaagcttttacacaactgataatgggagagaggtagacacactaaaaagtctttccaaatactgaggctcttggaacaaatactacaggttccattgcagcacctccagttcactttaattattattattgttataattatcaatgcttttagatttgaagtgtttattaaaggagatataaggcattttctatgagtgggtggctgtattctatcacgatgtcaccctggagacagtgccaaagttgtggatcgcttattacacttcggtactgccagagggaggaagacagatttaacaaaagagagagaaagagagagagagagaatttgagttttttgaaaaattttttttatctttatgttttccttttttcttctgatcatctcctccctgatgaggtttgagagatcaatacatatgtttactttttccttgaagactcacattaatatgacttttttattccaccatacacctgctttctgcctttttagtatccttaatcttggtaaatcctgagatctgtctctctccatctgtccataaactatgaccctatggggaaggatcccatttagctcctgtattttttgttggatgtacacttgtcataatccaaagaaatattcatgccacttactgcccggtgactatgtaaaaagactctccctccttttcttttttgttaaagtgtctcttctctctaccccttaattcagtggagcatatgatttaagaacaatgagccctttttccccccggcacaagggatgtgtattacttaatgcacatgaaggcagttggtgactcatccagttaaacgtattattgtaaatttgtatatttaaattcatattcagagattcttttattctgttgtgaaccctttggcaggttccaacagcaagtgtggccattgagggggcatccgccctaaaccgtgttcgttgggcccaagctggcaaagaagttgctgttggggactcggaaggccgtatttgggtctatgacgttggagaggtacgtgtgtatttgtgttgttgttactgttttgacttgtgtatctactttagaaacctagtgaaattattagcaagaacttgtaggccacaaggaccctctctaacgtgcttgtaaatttccattgacttcaatgctagtttggcgagacttccttagggcctaatttgatcttctgtctccatgcacagaacacttaagttaacaatctaagctccttttagagtcctgtagaatgtcccatcatcctgtgatggagtgtggcacttcccactaatttcatgagaatgaaaagtttagaggctgggtgcggtgcctcacgcctgtaatcccaacattttgggaggccgtggcaggtggatcacgaggtcaggagttcgagaccaggctggccaacgtagtgaaatcccatctctactaaaaatacaaaaattagtcgggcatggtggcaggcacctgtaatcccagctactcaggaggctgaggcaggagaaccacttgaatctgggaggcagaggttgcagtgagccgagattgcaccactgcactccaacctgggtggcagagagactccatctcaaaaaaaaaagaaaaagaaaagaaaagaaaagtttgccaaatatatcatgctaaaattgaaaagttgagttttggttggtatgttcaattaacatatatactatttttctttcattaaagtgtagccaattgagaatgtgattaattagaattttgtgccacttggtggtattcaaatttatcatatgagatatatacctttctagtatgtcttattacatgatacacaaagtattcctgaatgtcatggcatgtaaaaaaggaaaaaaaaaaacaactacaccttttatttcagacaaatctccttgaatttgcatacgatcttaatttaatgttacattatctatcaattgtacttaagattgtgtgtttatttttactgtatgagaaagtgttgaccaaaaccttcatttctggtgaggtaaggaactttttccttaaagaaaaagaaaatattgaactttcaagcaaaacaaaataagagcgttatgtaatgctattttggcataatatgaatctaacattgcattccagggggaaaatataccacatttgtatgcatagcatcctagacctagaaagtactctgtgagtgcctggtggatgggtttagctgatcacactgagaagggttctttatggtttcatcaatcagcattctataaatttggcaatcctaaatggtttgttctacaatggaacttttgatgacatattatatactgctatatggtatagttgattatgttggaacaagctagacggtgttttttaaaattcagccaggaacaaaaaccgaatgactttagaaatgggagttttctattctggatgcataattctaagtaaaaaaaaaaaatctcttgcttttactgcatgttatctatttcatttaacatccccttgactactcctgataccacaagctgagttccaacagtgacaaaaactctgttaatattggccccagtggtgaagatgcaaatggtctggtgactattgatatagtctggagtctttgggaaagagaataccctctgagtcggaaataccgccagtagtgttacagcagtatttttcttaaatgagtattctttatgtttaatgtatctttctcatggccctcatcaaagtaaaactaaacaacaataacaaaaacagatattctttattggtcacttcctaaaaaataaaaaagagcaaaggagaatgttaaaaaaaaaaaaagccttttctctctctttcttttcttcctttcttcctttcttccttttcctttcctttgtttataacaagtgtaattgtgggagagaaatacacatgaagacatgctcagagatacaatggcagaaaatagataaaatttaaaaactctttgctctatctcctttgcatacacataacgtcccttaactcacttaagattgtatacaatattattttatccctctttgttgtattctaaaaggactgaaaaacagattagtttaacaatctgttttatattttaaaaggccttttggaaagtctttattttgacttaaatgttatatatatacacactatatatatgcacacacatacattcatacacactgtctctatgcaataaggaaacacaatatgacatatatacagaattttctgcaataaaagtgattttacagcttttggacagaattacttgaatatgacatattttgtgagtaaatatgattttacaaaagttactttggctgatatgtggctgctaaaatttctttctaggatgctatcatcatttctaaattgtaaagtgttgttatactcatatttgtactatcgtactggcaggtcaggctggttttcatttttatgttattgcccttacttttctaagtgatattacagactatagaaatgtctgcaactataggccagtctcgcctattgtctggagtctagacaggctatagaaaaatctctgtgacatataataggccaaacaatttgtagggctgtttatccctacaaattcactaccaagaaaaagaaaggatatactattttattgagagtaggtaatattacaatctctagcccttctctgaatgaccgaaaatcaggataagcttatacacttgaagagttctttaggtattgtttgatcatatacaaagcaatctatagctcagaaaaactcagacttaacaaaataattgccttaactgtggttttataagtatttttataaattatatttatttgggtagaaggggaacttttgtgtttctctttgtcaccacaaagctttattctaaatcgctgaagacctcgtctgtagaggtacaatgtactaaaaggaaaaatgacttccctacatctgaggcttagctgcagcccacttctgaaagaggtagatcccttaagggcaaatgctgccattactgtgattactataggatcgttcaccagcccagaactgacagaacataactgtgcttaaagagaagtgcaccctctagacaagtaccttctcagccttccaaatcacctaaactgcggaaggccagatggaatgcttcatggcagggtggcacatttggaattagaggtctgatctaaggctggtgcatgactgactgcaggaagggtcgtcgagcaaagagctattcaagaagaaacaaataaggtattgaagactaaattgccagtaggctctgccaccactaccaatattcaaaattggttccctggtccctattaaaacgaaactcataaccacagtcatgctggcctttagatagaaaaccttgctttgtagaaccctctagaaagaagacaaaatgctcttagataagctttgtaatacaatctgtattaaaaagtagatggtaggttttttagagcacacaatgttggtccattttcctcagtacgttgaatacatgtctgtgggaagacatctcatattcattctcccagtgttgatttgaggagatttttttttaggctggggagaaaagaggggcctgtaggctagcttttgccaagaccttgttccacaagtgaggctgtcttgaagagtataggacctgtgcaattgcatagggcaccgtgcttaggggagccctgagcttgggtcattgtcttaaaattgttaaaaatttgtcaggaaggaacgccacattttcatttttcactgaaccctgcaaattagccggtcctgtcaactagagtgttactcttaatgccactcatgaggcaaatcagaaaaaaaaaaaaataggccttaacctagatcattaggaagaaagagaaatctgtagaaatgtagttaaatggatggacacactacaatcttctcattacctgtttctctttttttttcttttctttttttttttttttttgagacggagttttgctcttgcccaggctggagtgcaatggcacacttctgcctcccgggttcaagcaattctcctgccttagcctcctaagtatctgggattacaggcgcatgccacaacacccagcaaatttttgtatttttagtagagacaggatttcgccatgttggccaggctggtctcgaactcctgacctcaggtgatccactcgcctcggcctcccaaagtactgagattacagatttgagccactgcaccctgcctcattacctgtttcttaaaactacttaaaaatgtttaatgagaagggccacgactctacattataaacgtcaaggtacatatagagctaaagccgtactggagatcccaattcacctcccacaaccctcttttgatcacatcataattttgcctgaaaatatattaataatataatttggggaaagatctctgagatgcctaccccagttggagtggagcgggacaggctttctctgtccacaccattgttgagaactccctgaagagagactgctgtgagcactgatggaaacatctccattcaagcccaggtagtcttgccttcctgtgagccctggcactccctgattagggcattgcagaaagggactctggtgttaccagtcactgacagtcatctgcctcatctcctgtcccagctgaggctgcagctgctgcagggagccccagctcagtacccccatgaccatgcctttctcttattatgtacaattatcctctatgacttttaagatgatagcagagagcacagtggcttgaatccagatttagtggtgcaatttattatgaacttctgaaggggtaaacacaggattgtgtatgagctcactgaaatcaccagactgagtttgtccatctcccttttttttttctttttgttacatttaaatgacaaagacatgagtaatatcccacagcctatgactcaagaggtaaaatataaaacagcaatgttttcaggtaggtcacatgatgctgtgtttatatagcacacatttttggttgtttgatttcagcattatatctggaaaatacactgtacacatttattttcacagataggggtctattttctttgcagagcaggtgctgaactcccattagcataaatggaagttatgcgaatctgaatctgacaaaagacagagaagacccctttttattatttggctataatttttactctatttgtgccttcaaaagttacttacatagacagtggttgcatgcaccatttaaattttctgagattcaaaattaaaaatgagcctagcttctgaataagttttgagaaatctccaaactatggcttgcaatttgtttgttttggattgtaggaaggattccattcaattaaatgaaacatgggtaggataataagtcaaaaattaactattaatatacctgaaaacagagctattgttggattttttttcaaatgatgtatgaacacacattttaaagaattaaaaataaaaacgactcattgccatgtctccattactgaagagcaagcttttctatgcatatagagctgacttcaacagcacataggccagtatgtatagaattattcacgtgtcctgatgattgatagccagcctatctacctgtctttcttgcagatgtgttttatagaaagcccaccgccattgttaaggcttcagtgctgtcacacagatgcagctgtcataaatatcccctaacaactatgtttgctgcttatctgaattagttagaatgctgtttgcagctccagttttgaaagaagcagtttatcttccacctcctattatttctttttccattaacctcttccagggaagattttgttttcagttgtgataaattcacacaggtttcaaatccctgattatattttacagtagtcaaatgataaaattacagaatcattttcagctcaaagtaggatttgaagaataaaatggaaacttaaaaaccatggtttgagagacggacaaatcttatcctagctttattgatttggtatcctattcactagttacctaagaaaatatgcataaatctttaaatttgaactctgaactttgatagcatttcaaatagcttgtttgatacgactatttgggggccaaaagaatagtattcatttcattacaaatttcaataagtataatacatttgacattggatatatgggctttgaaaaattcttggaaaagaaagatgtgggttaacatgagagatcaaatgtaacactgccaaaaaagtaaaacatgattttaaatgtccatttgaatatattttaaagccaaaacgaaaaatcaagagagaaaagtttatttgtaacgccaacaggaagaatggcctacacaatatattttagaatgatggtcaaggtgttacatgtaagaactgttaacaagtgcctcaaatagtttcatagccagcaagaataagaataaaaaaaagagattcaatgggccatttttttatgctttcaacagtagtttgatgtagtggcatgtgataaactggaagtactgggagctaaaaagggtttgagtaacacaaaataaatacaatacaatgatgatttttaaggggaatcacacttaggcaataatagtgtactttgtggaactccttcatgttttccagtaatacagggcctacatcaattctccataagcagcctgtgccttgaatataaataattctcctccttgaggaagtgggcatacgaaacacaaaattgaaaagttaaacttagatttgggaggttaattcaaacaagagtcccttaataaaaagaactgcatttgcaatcagccagttttaataaccgtgctttatgaaggcctttgtcccctgagcaaggcaaacctgattgcatggctcggtttttgcagcctccagaagagcacagttggtctcagcttagcaagatccaggtatgatcatctgaatcactggtgtttctcattaaatgagtgtggccattaatttcctagattcttgaaggcctttgcaagtactggcttattcttaggtggataaacaatattattttctttagctgataccaaatacttcctttgattttctctccttgaaaaagaaaagacttaggcgtaaattcttccagtgataccaaacatccagataaaatgtgaaaatccaaatacctggttctgtcgataacatctagatagcagttgatggcataagaacaaagcatcaagcttttcaactggatttttcagtttttacttgaatttttagtgttacagccccaatgctgtgctattaagtcaaggggcaccaagatatatttgcatgggcagatttgagatgctaataaatataattatgtaaaataagccactttgaaataatatattaattcatttgtcataacaaattatatgtatttgaaattaaatattttgggtaaaatctatgattgtaattttggtattaactttatttcttctgggaaaagtgcttaatttaaaaaagaaaaggcgcaattaattccaattaatgttgtaagtattcatcttatagtacgtgtaatagctgtggctttcactttgataattatatatgtaaaagaccatgattaaactaattattatataaatagtgtgcttattcaggtagcattagtatatgaaaatggacttataggattaatatcttctcaagcaaatgttttttctgaattgaaaagaaatacttatgacttcatgtattatggagtagttgattcaatgaaaagaaagccctaatatctaatattataaacagcaaattaatgtgtgtatagtaatttcaaaattcaatgaagttcatatattctcattttggtgataaatgatctatgaatataaaccttctgaaagaagaaccagtttgtataactaatcatcttcatgattcttctgtggtttcaaactgtcatcttcaatggcagtttggattatgaagcagttgttaattatagtgttaatttttttatggctgacaaaattgtgtttagttctataatttcaaaattgctaaattttatcttgaaaaattgctgcttagagcagtagcctcaaatcacagctttaaaagctaaatgtgaagtctctccaatcatctgtgaatcgagattaacccgggcctgtacagaatggagttgtttcttacatgtgtatgtgtgctactgttggcatatctaaaatataatacataatcaaatatctgcttattcatgtttcctgtgtaaatatttatacaccacgtaggtcggacttgaaaagcgaggaagtgaatgaatcattatatttcactttcaaggaaagcttacatgaatttttgagaatgtcagctatcagaacatcttttaaattttaaagcatgagttacttatcatttaagaaatatccaaactgctaacattgtaaaagcaatttcatacttttaacctagtagataaatcagtggcccatttctaagctctttctcctaatagtcaaccaatagtttctcaattcagattaaattttttatttgtattggtctcagcattaaggtcccttagatagaaagtgaacataaactaatattttcaaagtgaataaataaataagaaagtgaacaccttctagtatgatttaaaaaaaaaaaaagttacccttgtgacttaaaaaaaaaaattcagattgtcagccctcccttgattatcacattcctcagcttcttttttaacctttggaagaccacatccacagaattgtacaaaaagtggttatttgacaattgtctattaaaacacaataacccagtctagcaaagtgcctggcacaaaataggcacacaataaatatttgatgggtgaatgaatgattcacatgtgaaaatttgaggaaaaattaagggaaagcttaattgtttagagcattcaggatgtagcctccaagttggctacagattgatgcacaggaaaaaaattacttaactgtagttgcacagaaaaggatatttagaaaatatctttagaaaagagtacttacccttccccccaatctctttcccagtttccctcccctcctgtgcttttaaaagtgagcagttggccactagtgtaataaaagcataaccgttgattcaaacagttgtcaaaccactggaaaaatgcttccttttcattgtgctttttttggacactatagatatggtaaatcatgaactgcgttataaaaatacctcttttgtgcccaaacattcagtaggagggaatgacatttcttttattaccttggtaaatgtttttaaggtgtttagcaataagccttctttttgtcaaaactgcttagacgcagtggttgctaagaatttattagaaaacctatagttaataatatcaagaaaagaagggatatgtgtttagtagctaatatgacagttgagcttgtgtagcacatgcttttgctttttcctaccattttcttgatcttttgtgttatggaaaacaagttattcatgtttagaaagtttatttttcattattgcccatcaaccagcgtttttagcattttctccatcttttgggcagagaaatagattgttccaaatagtagggaaaaaaataaggcgaaaagatttctgaggaaagaaggatgataagattttaatacaaatgtgaagaagactattcatctttaggtctttgtgaattaactctttcttcggatatttgttgttgttgttgttgttgttttgttgttgtttttcttccacaggtaaaaccttcagaatgttgtcatgcttcctataatgctaaattttaacatgaaaaatattttacatgttactttcttaagatagtgtttaaggagaaggatatatatttccttctatattcgctggcttattgaaattgatagagacccatatttgttactatttacttgacttttatgtcctacttttatttctttccttaattaggtggtaatggattttttaaaaagtgttactgtaaaaaaaaaacgtggtaaaaatagtaaaaataaaccactcctttaaagatacaagggaagagacctttggcagagaggtctgaagcttcatgggtggatgagggttcccttagatgggatttccagatgaaaagaaattaaaaaacaatcaaataccatctgaccaccataggtaagaatgttgcttaattttacagaaatttgtacctattgactggtaatagcagactgtgctgtacagagactaatgtaactcctactttgtcgacttctttgaaactgctctaaataagttacataccatatatctttttgtggtagaacactgtagtatatttacaccctctgtatattgcattctaacttggaattctggtccgtggtttcatccattgttagctgcgatgctagactctcccgggagttaaatacagtggggctgtatttatgtgaagcgggtatgcttggtcgttcagtggctgtttcattgcatattacctcccactttgctcccatctgtgtgtgtggtaaagggaattgtcctaaaaaatacaggcttcctctgaacacagacatgtatttgtataccagtaagtcaacaatctcctgaatttgggtgccattaataattgtcctttttaaaaggcttttagagcttagagggggttagcagtcgttctgtggaaaccgatgtacatttccacattttctgtaaatgcattaaaaaataatgtgtattaaagtgaaaggaaatctgtaagatatctttttaacagaaaactttaatttttagattaatacagagatgaattgtcgtgtatctcttggaaatcaatggttaacatgatagtctcacacactttttaaaattacttcatctaattgaaaaattacaaagaggctgatgagccacacatccatggaatatttatcttgaaacctagagtcctactcacttaatgtcttggccatacttcatgtatctgagaaaccaactgaaatcagagcgcttttctaacgtcttaattatgcaagattttaaaaaaagaaaactaaagtaagcaatacctgagacagatatttttactatgaaaaatattgcactgggatggtgaaagttactgcagataatgcagctatttaaaattattatagctgcaattactaaaaaatgaggaaggtttgactgagaactattcaaaatagttattagccatgtgattataaaaaggaacacatgaatgatatttgcatgtttaaccctggttataaaaagtcatttgatttttttaacagcatgtacagcagttacaaatccttacaactttaggtaaaaatgaagaatcccactgtggaaagtgccacaaggaaagagctggattaggatgtattagtcacatgtgaaaaataaaaaatatgtatgtgcatgtctacatatgtgtgtggatgtgtatagttacaataaatacttatattttaaacttgatttttaaaccaacaatggaaagtagcaactctgaaagaatttttcttgtgatttgaaagaactctttccctgtcccccgttcatgaaagttagctattattaaaagcctgactacttaggaaattatttgtgtgggtatttcagacataaaatgtgataaaatataaggtatacttctaaaaaaaaaagtacagctctaaataggtgaaaagaagaaagagaatatgcaaggaagaaagaaaataaaaaaattggaagaaaggaataaacattaagaaggaaaaacaacatcatgtattcagggtttatagtgtacaagcactgtgttaagcttattacatttttttgttttatttaatatacagtcctagaagatggatcttacaatttgtttcacacaaatgaggaagtaaagatcagaagtgttaaaaccatgcattccctaaagacacacagcaagttaatggcaaatctgggaaagaaaccaggatctggctggtgaagcagaaaaaaagtcaaccctggctccattctcaaatgttattactccacagtctgtgcctccctttaggtatacaggacacccaggcaaggcgagcaagggttagactgataagtttttcaggggtgaggtgggaccgggttcagaggcagcctccagtccactcaggcagagaggaggggactgatccctgacatggtccgagaagtagtggggtagcctgggtggtggggctctgggaggctaaaatgatacattttcatgaatttttccacaacttttgcacttttgcttttgcttgtagactttttgtcttccaagaatcttagaagatttaaaacaatctttacaatctttgagcaggtgattcaaaacacattacctgcctgcccttctgtcatggaatgctggcatttctcaaaggggtgagtcttgattgccccacactaacaggtgaaggttatgtggtctttagcaaatcatttagctccctatactgtcctctcctacctgttaaagaaaggtctacgccctgcttcttaacatcctcacataacaatcagaattaattcccaaggaaatttttttaaaaaacagaaaaatactgtaaaattggtatgcatgccacaaaacgtatcattttggggagctgttcaatttgactgacaatttaaagaaaaagaatgcatgacaatccatgatgaactcatagtactttctttactttgattacctttctcatgctctccacatctctgttgatgaatgggtcagatatcatcatccttattttacaattgaggcagtgagagggtaagtgcctgaccgttgccagcaaccaagataagaacaggacttgagtctcctgtccaaatctgaggttcattttacctctttcttatgtccaaattgctacctcagtaactacctttgcccttagtttcattggctgtaaaaatgggattgtatcatatctataaaaggtgatctcttttagagttaagattttattatctcaggaatctgagcctcaagtacttttggcatgaaaatgctttatatgtttagcaaaaaattagaaaacagtcattgaatcaggagatggactggctgttggtgaactcagtcgatgaagcagttggaatatctgagtcatccctaacctatgatgcagacttcatcagagatgaatctggaggcagaaaatgtttccagatccacattgacttagaacaatgctgggaaatttttgaagtttttttttttaatggtgttcccttaattgaactatacatttttaattggtcaaaataacttatgatcttttttcctatcacaaacataaattgtttggaaattattctaagctattattctcagagaaaaaatccatagtgatactctagatttagcctttatgccttaatagaaacttgaagagatgctgaagcaatgttattaacatgccatttgcctccctgttacttgcttgacacacaacagatatcaggaaatgttacagttgtcactgaaggaaggtaaattttaggctattcactttttaatgtcagtgaagtttttttaatgccagtattcacacagtttgacctacaaaaaacataattaatttttgtctgtatttcatagtcttcatattccaaaatgattcactactgtatctttaattcaaacacagtgcctgacatataaatggcactcaatcaatgctgattgaatgagtattgaatacatttatatgcaaggtaggacatgagagcagtctgttctgtaagaaacatgaacaaagatttttcctatttaatgattaagatagtgttggattaaaaaatctcctagagaaaatcataaatgcatttatgttcttgagcctactttctagccatttctaatcagagactaccacgtgagaagagccaggaactgccaagggtaagaagggcagttctgtccaaacagatgccatttacagtcatggaaacagcaaagtgaaaagagtggccctggccctcttgtttgttaggacacctgtttggtcttacctacaagtaattctaatgccaaaaattattactttgggtgtagaaacagcctgtgaatacacattcacactttcaagctaagatgatacttaaagtacttcctgatggtgatatttaattctaaaaatggggcagtctgcagttcaccttctaaatctaacattacaatcaccttgggttatttttacagtcaacaagatgaaaaggatagtaggatgaggtagataaattgatttcaagtttctaggaggaattgtgttttcatcatgttctactctagaatttttgtgaagcaagaaaataaatatttctgtgaaaattaagataccatgaaaaggaaaagacttggcaaaacaaatatccctaaaaaacaaacttcaaacattttgccagtctaaatgaaacttcagcagatcaaaaagaggacaagatgtgttagattactgtgacacttttatgagggtgaatctatatttctaagggcatgtgttagtattacagcactattactcccacctccatgaagaaagtcacatgtagttcactcgctggcttatgttttgtgtgtttaacagaaacatttaaatttgataaaactcatttttatgaagttatgtaatttttgagatgtgtaattttatatagtgtaaatgagactcacttctgttctaaactgtgtgtagacatttattcaaaccttaatgttccataatctttactagggccgtttctgaacagtcttgccatgactactacatgaaactatgtaaatacatttacctattttattgttaatagtctatagtttctacacatggctatcaataacatattgcataggtcatcatgtattaacttaaatttgtacgattttaactaataatatagctttatgtttgggaaccaaactcagctctttatgagcaaggtactgtgtattattgagacctatttttttctccaatatttaaagttatatgaagttatggggcattttagctttagcttgattcttactttatatgggaaaaagttataaatgtgttaccatgattaggcttttgtctcttcttgggcttttgtttcatggttatttttggaaaggcttgctcagcggttggaagaaggaaaagaaatagtggtcctattcttttacataaatgtgataccaacccttagttggttatggttttcgtgagcttgtttgtattgtacattttgggggcctcattttccaggtggagtattttctaaaattgaagaaaaaaaatgaagaatcgtggaatataggaaaagagtccaaagtagggaaaacagactgagcaaaagggtatcagaatcattcaagactattgtgaacttgtgttattgcctacaaagaaatttggattcatttcaataattatagtagcatttaaccattcagaaactcattcatgtgactaagtaagaattcttattggtactgcacttcgcaaaataagtcagagaacttactttccttgcctctatatcatttccagaattatattcttgaaacatttagccttaataccagaacactaatttaaggatatactttgcacaatgaagttgccactttccaataagttttcttggacagatagtatttgagaatattatccttgtaataaaaattttaagttctaatcatttggctctgtgtggtgggaaattttccagctgtagaagcaatctcaaagcttaggtttatttgcttcctcttttttcattaaaaaatatattaattgagatggctgtatgttcttaatgtttatggaatatgtggatagtgtagtgtagcactagtacctataggtaaattacactatattatagcgtaaaactccaagaaaatgcgtgtaaaatctaaatgaattttattctgtgtgaaaagcattcagacttctactaaatcctgtttctcatcctcaaatttttttttctatcccagatacttgcattatatttttaagcaatttatttttggatgctatgtggagaaatcattatcctttaaaacgactaacaaaaattcatacattcagtttgcattggaggaggcgttaatttcctcctcactgaattgtacacagaagatgttttggaaattttataaatccccctttttgatgaatcagtatagcatactggctaaggatgctcatactggaaccagattccattgacacttatatttgcttgctatgcaaccttggtaagattatttaatctttctgtgcctctaatataggaatgtgaggcacaataggattattatgacgaatgagttaatgcatgtaatgtacttagaacagaactcttggtaaataatagctactattactactattcatagttatcatcatataaatcttactggaaaggcccaagtactatttcataggaggaatatttctttgtatatataagctattcttttgcccttcatactgccccatcagcaacactttagaaaaaggattaataccattgactaggaataaaatatacagttatttgaaaatcttggtcattatatgcagtttttatttgcgtgttcactgtaagtctggtcttcttatgaaaaaaatttcattactaaaagcactttgatgtggctactgtaattgtatagtttgcataggtttttaaagttttataaattatgtgagtgcttttgcttccaagagtgacatggttctcttgttagtttaagagcaacacctcaggccctgcttgatccaaagaagaatgtttgatttcctttacattccaagggaaacatctgctttggagggtgtgggggcaaagggacagtcattcaggcttcaaggctttcagacatgaaagatatcttgttcatcatttctccattgatttgctttgcagcttgcagttccccacaatgatgaatggacccgatttgccaggacccttgtggaaattcgtgctaacagagctgatagcgaggaggaaggcactgttgagttatctgcctagtggaaatgagccacccccactgcagcccccacctttgtgtcctagagctcagcgtctgcagtcaagtctcttgtattcggtgtccattcagtatcagtattgctgtgatattttgggtgccatattgtgccagctttgctccaagtattctaaatgtgtcccatcatgctttccactgacccaaaattcaccacagcatttctatctttatatttctgtctcaaaaatgaagagaagggggttatgggttaagttgctgccttttaactactttgtagctgtatttaatagctggaaacctctggttaaatttgtgcttacatgcactcctggcatagtcctattaaatccatatgaagccagatatgattgggtgcagatgtggtgttcctcatattatggtaca

SEQ ID NO: 99 - DNA, 52857 bp, Homo sapiens
ggttggagtacggggcgggggtcggccgagggcgcggggccccggggctccgggctcgcccccgccgctcggggcaggcgcgccgatggcgtttctgaggtgacgccgcccacaccgggcttctccgggggcggaggaaacacctatgaaccctccggcagccttccttgccgggcgccaggtaagcagcggttccgggcgcggcggggcgccgcgggaacggtgcacattggtcgaaatctattgcttctcaagaacggtgtctacttaaaatgtgaaacaggccgggcgcggtggctcacgcctgtaatcccagcgctttgggaggcggaggcgggcggatcacgaggtcaggagatcgagaccatcctggctaacacagtgaaaccccgtctctactaaaaataaaaaaaaaaaaattagccgggcgtggcggcgggcgcctgtaatcccagctactcgggaggctgaggcaggagaatggcgtgaacccgggaggcagagcttgcagtgagccgagatcgcgccactgcactccagcctgggcgacagagcgagactccgtctcaaaaaaaaaaaaaaaaaaaaaaagtgaaacaatacactagaggaaaacggcgtcacgaccgtttccttaacccaataacaccttgttattcagcccgggccacagagtagcgcgtacccggtgcttactgtttaaggaggacgattggcgtctggggagctgctttcccatttacctctcagggtgtccttaatttacacaacctggcgagtagaggaaggagctctcacaactccactgtaccaaaaagtctggaagtgggcttgcccaaggttcgcgtccatcagtgtaagacgacctgcctttgtgtactcggcttactgcctgttttcctggagtggaatatgtgctccttgcctggaggtctgtggcccagccactggcgctcaataaattatttgttgagtgcatgaatgaagggctaacccaacactggaattcaagccttgggacttgaaatcccttgactccaaattccattttccttgttaagactagcaactgtaatttattcatcattcttatttatttatttttgagacagggtctggctctgtccccagggctggagtacagtgacgcaatgtcggcttactgcagcctctgcttcccgagttcaagcaatcctcccgcctcagcctcccaaatagctgggactacaggctcccaccaccatgccgagctaatttttgtgtttttagtagagacagggtttcgccatgttggccaggctggtctcgaactcccgacctcaggtgatctgcccacctcggccttccaaagtgctgggattacaggcgtgagccactgagcccaacctcattattcttgtttatttacaaatcttacttttcaaaaagcagtaaggaggtacaaagggcctctgttgaacctttaattactgtctttaaggtggaactctattaaagtaacacttttagttgtttatttcataggcagggacagcaccatgatttgaaatgtggtttacagtgttaatgagagctgatgtttgttgagtgattacaacgggccaggctttgtgctcagtactttacagagtttgtcttgtttaatcttcaccactccaagatgttaaaatgcagttgctatcgttttacaggtgaggaaactaatgcttagagaagttaagtaacttgcccaaggttatgtagccactaagtggctaattctgggatcacaatttggtcaggccaacttgttagattttaaaatgctgtatacttcaaagaaattattgtattaatagataatattgttagatataaaaatggcatcatggttatataggaaatgttcatttttagagatgcattctgaagtatgtaagggtgaaatggtattttttaaccaataatgaaaagaaaaggacattgaagcagccgcagtgaaatctcaataatggtagaacccaggcacagagtatatgggagtttatcgtactattgtctttgggtacatgtgaaagatttccttacataatttattttttaatgatgtatgttgtatttggatcagttacaatattaaattgcccttaatagattgagtatgtatagatgccttagatgttgtagttgtcatgcatattgaacactggaagacttaattttctttttatagactaaaattcccattgtttagtaaggatcatttacatttaaacagtaactatttcgtgattttgtttggttttttttgatagagttttgctcttgttgcccaggctagagtgcaatggcacgatctcggctcactgcaacctctgcctccagggttcaagcagttctcctgcctcagcctcttgagtagctgggattacaggcgcatgccaccacactgagctaatttttgtatttttagtagagatggggttttgccacgttggccaggctggtctcgaactcctgacctcaggtgatcggcccaccttgacctcccaaaatgctggaattacaggcgtgagccaccacgcctggccactatttcatgtttacctgtacttggttactcaaattgctggggcaaggtaggggataatgttattgactggcagagaaaagggttgttggcaaagggggagaaaaagtgcagaaataggtttatttgtttacccagtgggttttagaaacagtcccactttttaggcatggtacgtatggcatgacagaaaattgtagagaggcagagtgcatggtagattttaacttgaacatgttttaagtatacataatcttttgctgccatgttattaaaacttaattgaactacttagaattggccgcaaaagaagatatacttatttggaaaatggactttggctgatttgttattgatttcattctattttgatgtgaaaccgctttctatgtttagaacatcgggtcagaagttgagatttccactatcgagaaacaacggaaggagctgcagttgctcattggagaattaaaagatcgagataaagagctcaatgacatggttgcagtgcaccagcaacagcttctttcatgggaagaggatcggcagaaagtgttgacactggaagaacgttgcagcaaattagaaggtcagaaatacattcagggacaacagttatgcacttctgtgtgctaacacattgatgggctcatagggaagatagagaggaagtaaagactgcaatccctgttgtcctcaagtttaggctcattggagacaggaggactttatgaacagccacaatgggacagacacacacaaataaagtaggacaagcaaagtatttcagtatagaaagggggctggatggagctccagtcaacatggggtgagcgccagtggtgaagttgaagttttgagcaagagtatgaatgaagatgccatatgactagccatttctcttaaactaaactgaaagattttaggcttttggtattgaacttgatcttaagttcctaaaatggtcatcttttaaagttatagctgtccggccaggcacagtggctcacacctgtaattccagcactttggcggatcacttgagctctggaactagagaccagcctggccaacatggtgaaaccccatttctactaaaaatacaaaaagttaactgggcatggtgatgcacacctgtaatctcagctactcgggaggcagaggcacgagaatcgcttgaacccaggaggcggaggttgcagtgagccaagattgcgccactgcactccagcctgtgggacagaacaagaccctgtcccaaaaaaaaaaaaaaaaaattatagctgtctcaaaaatggttgcaaaaagtttatttgacaccatattttaattctgtcattcctttagtgctgccctaaatctgaatgttccattgactctagattgttagtagaatgcattagaggagaaaacactagatctgtataatagaaagataacctttttttacttaacattactcaaaggattctgtaaatgtgacaatccaaatctgtcatttttggtggggtgcggtggctcatgcctgtaatcccagcactttgggaggctgaggcaggcggatcacttgaggtcaggagttcaataccagcccagccaacatggtgtacctcgtctctactagaaatacaaaaattagcggggcatggtggtgggcgcctgtagtcccagctactcaggaggctgaggcaggagaattgcttgaacctgggaggtggaggttgcagtgagccaagattgcgccactgcactccatcctgggcgacagagcgagactccgtcaaaacaaagaaagaaacaaacaaaaaacccaaatatatgattttttcgtttctttgatgaccatctgattttactctgaccacacccacacacgtatatacacacagtgtttaaaatggttgctcattaaatgcagtataacatcttatagctcttatatagacatgttaaagaacaaagataacacatataacatatataacccacattatatgtagccatcagtatttgattttaaaatgagcaagatttgaataggcacctcatggaaagaggaaaattgaatggccaataaatatattaaaagtttcctgttctcattagtagttagggaaatgcaaatgaaaaccaaattgagatactattttacctttaccagcctggcagaaattatcaggtgttggtaaagtatggcaccaagggaaagctgagacgctgctggtgggagtcagttgtcactgctagtgtgcaaaatcatttggcagcatctagtgaagctgaaggtgtgcatatcctacagcccagcaaagccacttctaggaatattctcaccctttaatagacacatgaatcacctaagggtcttgttaaaatttagattctgatacaataggtctggggcccaagggtctgcatttctaacaggcatcctaggcgatgccactgccgctgctggtccagggaccacattttgagaagcaaggctctcaagaaactcttgaaaatatgcacccagatgcatgtaaaaaggcctggcgctgtggctcacatctgtaatcctagcactttgggaggccgagtcaggcgaatcacctgaggtcaagggttcgaggccaacctggccaacatggtgaaaccctgtctctactaaaaatacaaaaattagcagggtgtgctggctcatgcctgtaatcccagctacttgggaggctaaggcagaagaattgcttgaacttgggaggtggaggttgcagtgagctgagatcacaccactgcactccagcctgggctacagagcgagactctgtctcaaaaaaaaaaaaaaaaaaaaaaaaagatgcatgtaaaagaatattcagagcagcattgtttatcatagctgcaaagtggaaataacctaaatgaccatcaatattagaaataagctttggtaggccaggtacggtggctcacgcctgtaatcccagcactttgggaggctgaggaggatgaatcatggggtcaggagatcaagaccatcctggccaatatggtgaaaccccatctctactaaaaatacaaaaaaatagccagacatggtggtgctcgcccgtaatcccagctacttgggaggctgaggcagaagaatcgcttgaacccaggaggtggaggttgcagtaagccgagatcgtgccgttgccctccagcctgggcaacagagggaggctccgtctcaacgaaaaaaaaaaaaaagaaggccgggcatggtggctcacgcctgtaatcccagcactttgggaggccgaggtgggctgatcacgaggtcaggagatcaagaccatcctggctaacacggtgaaaccccgtctctactaaaaatacaaaaaaattagccaggcgtggtggcaggcacctgtagtcccagctactcgggaggctgaggcaggagaatggcgtgaacccaggaggcagagcttgcagtgagccgagatcgcaccactgcactccagcctggacaacagagcaagactctgtctcaaaaataaaataaaataaaataaaataaaataaaataaaataaaataaaataaaataaaaaatagaaataagctttggcgtaatcattcagtggaatattacctagcaatgttagtgcacaaacacaagttacacacaactgagtgaatctcagaatcattatcttaagcaaaaaaagcaaacagaagaattgtcagaatatgattccatttttatatggttcaaattaagctataattttgaggcatgcggtcactggtaaaactgtaatggaaagcaaggaagtgattactctaagatcagggtcatggttgggaacgcggaaactggagtgattatgttcgggaagtgacctccagaggcttccaattgctcacagttctgtttcttgattaggtgtgatattgtgcatttcataataaaaggttttaaaagaagattgtctttttaaaaattctctaccacatttttaccttttaaccacccattttgaaaataatgccttttaagctgaaggtgtgactacaaattattgatgaacttccctcaggtgaactacataaaagaactgaaataatcaggtcactcacgaagaaggtaaaagctcttgaatccaatcaaatggaatgccaaacagctctccaaaagacccaactacagcttcaggaaatggctcaaaaggcaacgcattcttctcttctctctgaagaccttgaggttgggattagtttttgataagcttcactagtccaaattccctttgtgtttcagttattgaaaaattagatttgaccgggcacggtggctcactcctgtaatgccaacactttgggaggccgaggcaggtggatcacctgaggtcaggagttcgagaccagcctggccagcgtggagaaaccccatctctactaaaaatacaaaattagccgggcgtggtggcacacgcctgtagtcccagctactcaggaggctgaggcaggagaatcgtttgaacccgggaggtggaggttgcggtgagccaagatcgcgccattgcactccagtccgggcaacaagagcgaaactctgtctcaaaaaaaaaaagaaaaaagaaaaattagatttaaatgtttcattaaaaatgcatgtgaggctgggcacagtggcttggtggctcatgcctgttatcccagctctttgtttgggaggctgaggtgggaggattgcttgagcccaggaattcacgaccaggcttggcaacatggcaaatgcctgtctctataaaaagaagaaatacaaaaatgagctgggtgtgggggtgcactgctgtggtcccagctacttgggaggctgaggcaggaggatcacttgagcccaggaggtcaaggctgcagtaagctgtgattgtgccactacaccccagcctgggtgacaaaaaaaaaaaaaaaaaagcgtatgtaagccaagcacagtggtgtacgcctgtagtcccagcctctggggaggctgaggcagaaacattgcttgggcccaggagtccaagtccagcctgggcaacatagtgagacctcatctcaacaaaaaacaacaacagcaagcaaccaatgcaaaaatgcatacgtgtgtgtacgaaggtatctacactcatccaccccttgtagttttgtgtttctcctacagttttggttagctgcacggcattatcctgtcttagagattgagcttcagtacaacgctttttaaccgttatgccatttggtttagtagcatctaccatttaatcaacaatgagttattttagaaagctttcctcaaagatgagagggtataatcaagttttggtagcctcaatgatgttttctaaattattgtgtgttttttttgagatggagtttcactcttgttgcccaggctgaagtgcaatggcacgatctcggctcaccataacctctgcctcctgggttcaaacaattctcttgcctcactcccccgagtagctgggattacaggcatgcaccactatgcccagctaattttgtatttttagtagagacggagtttctccatgttggccaggctggtctccaacgcccgacctcaggtgatccgcccgcctcagcctcccaaagtgctgggattacaggtgtgagccactgtgcccagccaattattgtgtcttatctcataatgttagtggcatattgggaataaaaactgtaagactggttttttgagcccggcatggtggctcacacctataatcccagcactttgggaggccgaggtgggcggtgacttgaggtccaaagtctgagatcagcctggccaacatggtgaaaccccgtctctactaaaaattcaaaaattaaccaggtgtggtggtgggcacctgtagtcccaactactcaggaggctgaggtaggagagtcaattgaacctgagaggcagaggttgcagtgagccgagatcgcaccactgcactccagcctgggggaaagagcgagactccttgtcaaaaaaaaagatggatttttttggttttctcttctaactggtcagtcatcagatattttttgagttcatgcttataagaggtgcagaaagccagcttgtttatttgttatatccttcattctttttttttttttttcctgagacggagtctcgttctgtcgcccaggctggagtgcagtggtgccacctcggctcactgcaagctccgcctcccgggttcacactattctcctgcctcagcctccctagtagctgggactacaggcgcccgccaccacgcccggctaattttttgtattttagtagagacggggtttcaccgtgttagccaggatggtttcgatctcctgacctcgtgatctgcccgcctcggcctcccaaagtgctgggattacaggtgtgagccaccgcgcctggccccattcttttatttcttagtgatatttcatatacgtcttggtaatataatgagtctttattcataatagtatagatttttattttatggtttttaaaagaatactattctagatagtttctagctataaaataagtaaaaactattctagaatatctactgattatgttgcatgaaaaagtggaagagatcttttttaactaatacactttatttatttagtgcatttttaggttcacagcaaaattgagcagaaagtagagagagttctcatacacactctgtatccacacacccagccttccccacgatcgacctccacaccggggtggtgcatttcttataattggtgaatcttcatggatacctcattgtcacctaaagattacagttaacattaggggtcactctttgtgtttacattctatggggttttgacagatgtgtaatgacacatatcctctactatattatagtatgtacagaatagtttcactgtcctaaaaatcctctgtgatctacccttcatcccttcctccccctcacccctggtcacacgaatctttttaccgcctccatagttttgccttttccacaatgtcatatgcttggaatcctacagtatatagccttttcagattgccttttttcacttagtaacacacatttaaatttcctcctaaagatatctttttaaaagtctaaataggctgggaggccgggcgcggtggctcatgcctgtaatcccagtaccttgggaggccaaggcgggtggatcacgaggtcaggagttcgagaccagcctgaccaacatggtgaaaccccatctctactaaaaatacaaaaatcagctgggcatggtggcacgtgcctgtaatcccagctacttgggaggctgaggcaggagaatcacttgaacccaggaggcagaggttgtagtgagccaagaccacgccactgcactccagcctggcaacagagcgagactccgtctcaaaaataatgataataataataataattaggctgggtgcagtggctgatgcctgtaatcttagcactttgggaggccaaggtgggaggatcgcttaaggccaggagttcaagaccagcctgggcaacatagcgagaccctctctacaaaaaatacaaaaataaaaattaactgggcataatggtgagaacctgtagtcccagctactcgggacactgaggtgggaggactgcttgagcccaggagttcaaggttactatgagctatgagtgcaccactgcactccagcctgggtgacagagtgaggtcctatctctttaaaacaaaaacaaaaacaaaaggccaggtgcagtggctcgcctgtaatcccagcactttgggaggtcaaggcgggcagatcacccgaagtcaagagttcgagaccagcccggccaacgtggcgaaaccctgtttctactaaaaatacaaaaattagccaggcgtagtgttgtgtgcctgtaatcccagctacttcagaggctgaagcaggagaatcacttgaatccaggaggcagaggttgcagtgagccgaggtcatcccaccactgcactccagcctgggcgacagagtgagactcagtctcaaaaaataaaaagcctgatggttatttttctcaactagtaaatagattgtatacataataattatatccgacatagcactatgtgtttttttaaataattgttgagtaggaataccccagtatgaagttctttcgacaaagaatattttttaaattcacacaattcactaatgctactttatttcaacaaaggaaatctcttactaatacagttctcattcattcattttcttgcctcttcccaacctaaaattacacataaaagatactaggaaatagacatgtttacaagcatcaccaacataattcaatagggcaaatacaagtactgagaggatggtagaattaatagagaaatatatatttgtattcctttttgatgactgctttcttaggccacttcattactaaaacaatgtaggctttattagcccactccattaccaactcttttttgttactaacgagttaaacaaggaaaaaacaaaatagagaagtaagcgcagattgtggctagcaagagtagtgaaagctttaaaaggactcaagcagtatcatctgtgttgttttcttgtaggctagaaacgaaactctcagcaacacgttagtggaactttctgcccaggtaggacagctacaagctcgagaacaagctcttacgacaatgataaagctaaaggtaatcaaaaataagaattcctccatttgccagagtgcttggtagttatatccatattcattatcttacctaagtcgctaggatcccagaaatgtgaagctaccaacgttgctcttgttttttaaaacgcccatttagaaatgagggaaacaagtttaaaatgatgttcccaaggcatgaagaaaggaggcaggactctgcttctggtcttctgtctccaaggcccattctgtgggctggcaggtctgaattaacttgttttctccccgggtatccattattaggtctcatagagttatgggccattagattgcttgagaggttttttttgttttgttttgttttgagacggagtctcgctctgtggcccaggctggagtgcagtggctccgtctcagctcgctgcaagctccgcctcccaggttcacgccattctcctgcctcagcctcttgagtagctgggactacaggcgcccgccaccacacccggctaatttttttgtatttttagtagagacggggtttcaccgtgttagccaggatggtctcgatctcctgacctcgtgatccgcccgcctcggcctcccaaagtgctgggattacaggcgtgagccaccgcgctcagccagaggtttttttaatggagagaaaaaccatctgcaatcaagcagttgatgtagtcactaacatgcaatatacaacgatacacactctcctgctgttacacatgtcattgacaattggtatttaagggaacaatgttggtataatgaaatgctcacgctaataaatatgtgatttttctcagcacattgttttcaagtgattggggcaagtgctgttaaaattaaagagaaaggccgggcacggtggctcacgcctgtaatcccagcactttgggaggccgaggcgggcagatcacgaggtcaggagatcgagaccatcctggctaacacggtgaaaccccgtctctactaaaaatacaaaaaattccccgggcgaggtggcgggcgcctgtagtcccagctactcgggaggctgaggcaggaaaatggcatgaacctgggaggcggagcttgcagtgagccgaaatcgcgccactgcactccagcctgggtgacagcgagactccgtctcaaaaaaaaattaaattaaattaaagagaaaatattaaaatctacagtcatgtctttagtcaagtagcagacagtttagtggcttcaacaacctctctggtttccatcatagcaaactctggcaaagctataggtatgtctgaaggtgctgccaaggcatttccccaccattaaaacagtgggtgcgttaggaaggctgtgctcctggaggccgggtgccgtggctcatgcctataatcccagcactttgggaagctgaggtgggtggatcgcttgaggtcaggagtttgagactagcctagccaacatggtgaaacccctgtctttactaaaaatacaaaaaaattagccgggcatggtggcacacgcctgtaatgccagctactctggaggctggggtgggaggatccccggaagccgggaggtggaggttgcagtgagctgagattgcaccactgcactccagcttgggcgacagagcaagactctgtctcaaaaaaaaaaaaaaaagaaggtcggtcgtggtggctcacacctgtaatccctacactttgggaggctgagccaggcagatcacaaggccaagagattgagaccatcctggctaacatggtgaaacctcatctatttttaaaaatacaaaaattagctgggcatgatggcacacgcctgtagtcccagctactcaggaggctgaggcaggagaattgcttgaacccaggaggcagaggttgtggtaagccgagatcacgccactgcactccagcctggtgacagagcgagacttcatctggaaaaaaaaaaaaaaggctgtgttttcctagtcttagagattttatttgatgaaaatggtttccattagaagcagatgccctccaggacatccttatcaaaggagcaagtaggaatcccaggtttaaggctgaaagggattgactgtcgtgggtgtcctggtgttaatggaactgtgttcctgtacttattagaacggttattttttgctactgacctggtcacaaagttccatgggtttttgcatggcctgccccaaccctattattctataagtcctagtgtgagatgtgcagacaatgtgatttttcaggagtgcatttatgatgctgtagcagaaatgtttagacttcagtaggggtaaaacctcttaataacagttattccaggtgagtgggggagggatagaacttttacttatttttatacttttaggtgttgtttgagttgcttttcaagaagcagataccttttttggtaactaaaactgcctcaacaattaagagattctaatttgggagatttggaatgatgttgttgtggagtctgtcatgttaacaagctggaaaatgggagggaatgatgggccattagacttacctgtataatccagaggacgattttcccatccaggggccacccaccctcttgctgctattatagtttcttaggtaatggaatggtctggctctaactttttgagagagagtaaggggtagtggttcagtacatagtgtctgaggcagccagctaggttcaaatggtggctccaccactaactagctgtgtaaccgtgggcaaggaacgcagcctttctgttgactcatctgtcacttggcaagaacaatagtaccaccctcatagagttactgtaaagattaaatgaattcatatgcgaaaaatgcttagagtggaacctggcacacgataagatcttagtgttatcttttcttcttggttaattggaatttaagaatctaggataaccattttcaaatttggtttttaggacaaagatattattgaggcagttaatcacattgcagattgttcgggtaaatttaaaatgctagagcatgccctacgtgatgccaagatggcggagacttgtattgtgaaagaaaagcaagattataagcagaaattgaaggcacttaagattgaagtcaacaaactaaaaggtaaggaagagacctacatttaagatacaaatgtattatcttgggaatatagtttttcatctgggttcacttaatcttatgcttgagagtagatcaattcctggccttagaccctaacgtgaaatatccatttcatttatataggattatgctgcaatttgtgtcttataagatatataacagagttggggaaaactgcagaatgtatcatattttaaagtaatcctgccttagttgaggtggctgtaccattagctatcgctaatacatgctttgtggcagacaacatcagtatctcagtggcagacagtcgtagcatttattaaacccacatgtctagaggcaaatgggggagttggctgactgtggttgggcctcactgagcttcccatctgggcagttttggctcacacatttcatcgtcttgctatcaggctagcctgggcatttcttcccatggtgagggcagaaacttctgattctgaaattaggaatttttatttttgccgatttatttattttcgacagaatctcactctgtcacccaggctggagtgcggtggtgcaatcttggttcaccactgcctccacctcctgggttcaagctattctcctgtctcagcttcccgagtagctgggattacaggcacctaccaccatgcctggctaatttttggatgtttagtagagacagagttttgccatgttggccagactagtctggaactcccgacctcaggtgaatccctctgccttggcctcccaaagtgctgagatctacaggcgtgagccaacacacccagccgatctttgctgatttaacttaaaagattcagcattcaaaaatgttgtccttatgatgccttgacctatggttagccataggtcttatctccatttgtagcttcagctaaaaccataatcgtattatcatccccttgacagcaggaacagactctgcttctctttttcagtgtactgttaatagcatggcacaagggctacactctaggtatttggtatttattgaatgtttatatacaccgaggtaaaatattcaagtagaaagaagtctgttctgtcaatatttatatactaaaaacattttataaattcaatattaaaacttttttttttttgagatagtgtcttgctctgctgcccaggctggagtgcaatggcgtgatctcagctcactgcaacctccacctcctgggttcaagcaattctcctgcctcagcctcctgagtagctgggattacaggtgggtgccaccatgcccggctaatttttgtatttttagtagagacagggtttcatcatgttggtcaggctggtctcaaactcctgagcttgtgatccacctgcctcagcctcccaaaagtgctgggattacaggcatgagccaccacacccagcttaaaactttttttttagaaaagaaaaatagtggctgggcatgatggctcacatctgtaatcctagcactttgggaggccaaagcaggcagattgcttgaggccaggacttcaagaagaccagcctggataacatggcagaaccctgtctctacaaaaaattagccaggcatggtggtgtgatcctgtagtcccagctactcgagaggcaaagtgaaaggatttcttgatcccaggaggtggaggttgcagtgagccaagattggccactacacttcagcctgggcaacagagcaagatcctgcctcaaaaaaataaaaaaaaagaagaggaatttttatagagctcaatctccagccctccctccccttcctggaggtccacaagtgggactgcaggttccagccctgtcttcacttggtgtttctggtggctgtctgcatcctgaggccacgtaggagctccaccctgagtcacctcgttagcatgtagtctggtgtaatcaactgactcttcatgaatgacaaaagatgcttctgtcacttaggaaattccacaagttttaggagctctgttctccaggaacagaggacaaaaaccacatctatttcttcttataccacagacatactcaaggaacagaaggaaaggagggaacggcggtggggagatgggcaggtcaggtcatgctgggctctgcagtttgtggtaatggatttggatttcatcctcagtgcagtagcaaggcttctcactgagaaatgacacgagcagatttttatttttagttttatttatttatttatttttgagacagaatttcactcttgtcgcccaggctggagtgcaatggcgcgatctcagctcactgcaacccccgcctgcctctcaagcaattctcctgcctcagccttctgagtagctgggattacagtcgcccaccaccacacccagctaatttttgtatttttagtagagacggggttttaccaggttggccaggctggtttcgaactcctgacctcaggtgatccacccgcctcagcctcccaaagtgttgggattacaggtgtgagccactgcacttggcctttatttttattttactttacttttttttgagatggagtctcactctgttgtccaggttgagtgcagtggcgtgatctcagctcactgcaacctctgccacctggattcaagcgattttcctgcctcaggctcctgagtagctgggattgcaggtgtgtgccaccacacccagctaatttttgtatatttagtagagacggggtttcaccatgttggccaggctggtctcgaactcctggcctcaagtggtttgtccgccttggcctcccaaagtgctgggattataggcgtgagccactgcgctgggcagattttgatttttaaaagattgctctgtgtacactgggctgtcacaggagaggcaaggctggtgcagggaggtcagtcagatgagagcaagcgaagcctccaaccaggggtccttgccaggtgtggagatgttggctgtgaaacagattttgtctatagatccatcaggaccggaaggagccgctgaggatgtgagagttaggcatagtgtgtatatgaggactggaacctagtatttatttgaggactttctttttcttctgttgtgaagaggacctcaatgaaaagacgacagaaaataatgagcaacgagaagagatcattcgcctcaagcaagagaaaagttgcctgcacgatgaattgctttttactggtaaaacagatgatcgaatgtatttgtaacctagacttgcaatgatgacaggctgaaggaattatacctctcccaaaatggtttttttttttttttttttgagacagggtcttttttgagacagggtcttgctctgtcacccaggctggagtgcagtggtgcaatctcgtctgactgcaacttctgcctcccgggcccaagcgattctcctgcctcagcctccttagtagctggggttactggtatgagccaccacgcccggctaaattttgtatatttagtagagacggggtttcaccacattggtcaggctggtcttcttgaactcctaacctcaagtgatctacgggccttggccttccaaagtgctgagattgcaggcgtgagcccggcttttttatttttatttttttctgagacagagtctcactctgtcgcccaggctggaatgcagtggcatgatctcggctcactgcaacctctgcctcccaggttcaagcagttctcctgcctcagcctcccaagtagctgggattacaggcgcatgctaccatgcccggctaatttttatatttttagtagagacggggtttcaccatgttggccaggctgatctcgaactctggcctcagataatccgcccgcctcagcctcgcaaagtgctgggattacaggcatgagccatcacgccaggcctttttgtttgtttttaacaccctttgtgggaccgatggtggaccaagcagcgagtgttaatgctgccatcccgttcccagtcactatttcctcttctgtaaaatgagctattctcccttccagcttaagcgtgtgactctgcttcttactaaaaacataacatagatgctccttgacttacagggttacattctgataaacccctcgcaagtcaaaaatgcatttaatgaagccaacccagccaccagcatagctcagcctagcctgccttaaacatgcacagaacactcgcattagcctgcatttggacgaaatcatctcacacaaaggctgttttataataaattgttgaatatatcatgtaatttactgaaagcgaaaaacagaatggttgtatgggtgctcagagtaggggttttttaatgaatgtgtacccctagtaaaagggggactgagggtaggtatcagtagaccaaaaagtgttcatatgattttctcttcggaactttacctctaaatcaatgactttcctaacacaaaccactgaaaagaaagcccagtagaatcatcttggctggcagggatgtcaacaagctctctatgtcagtcattctcagttgggagtggagaagtaggccttcaccagtggaaactctgagatactgggggtaggtaaggaatatggcagggaatggaatgcagtttgtctgtaaattaatgggaaaaaattgaggctcatcacagcctcaaactcctggactcaaggaatcctcccgccttggccttcctagtagcctggctaaatttttaatttttttgcagagaaggggtctcactatgttgcccaggctggtctctagctcctgggatcaagcgatccccttgcctcggcctctcaaaatgctgggattacaggtgcgagccaccatgcccgacctaagaagttttaagtgaaatggaattcttaattttaatctcttgtgattaaagatcggggtgaaagtgtggtattctgccactagaggtcactattttcaccatttctaggattgctgcatctgcaagtagtgataacccgttaacgctgctaaagatatcacatatttgtagctttacagttgcattcaaacagtccttggaccagcatttgtacgccaggtgccctgcgatatgctcagaagctcacaggcccacagaattcactactatacaaatgctatgcataaaatgctatgggaggtcaaaggaaagaacaaagcttaaaggatacgttagtctcttttctttttgattaatcactttttacccatgcactctactatgtattactaagtaaaatacatggaatttgttagctaatattataataaatcgattttgtgaaatatttttatcatatactaagcagatttctttacccaggctggagtgcagtggtacaatcgcagctcactgcagcctcaaactctgaggctcaagtgatcctcccacctcagcctcccaggtaggtgggaccacaggcacatgccatcacacatgcctaatttttaaattttttgtatggatgaggttccactatgttgcccagtctggtctggaactgctgggctcaagagatcctcctacctctgcctcccaaagccccaaagcgttgggattacaggcatgagccaccatgcctgtcatcctaaattgattccttaaacatcttcttaactaaagacaatctcacaccattgtctgaaaacaatttttgtatgttttattcttctttttcaaaatatagacaattgatagatttgcatgtttcaattataaaagtgaacaaagcctacaaaagaatttatttatttagtagagacagggtcttgctctgttgcccagcctggagtgcagtggtgcaatcatagctcactgcagcctcgactgtctgggttcaagtgatcctgccacctcagcctcctgagttgctgggactacaggcatgtgtcatcacacctagctaattttattttattttatttatttttagtagaggcagggtctcgctatgtggcccaggctgctggtcttgaactcctagcctcagataatcctcctgccttggcctcccaaagtactaagattataggcatgagccatcgtgcttggcttaagcccaaaaaagaatttttaaagggcataacatgataatatgccgtcaagtgctatggctaaatgtcacgattttttttgtttttgttttttttcggagatggagtcttggtctgtcgcctaggctggagtgtagtggtgcgatcttgtctcacttcaacttccgcctcctgggttcaagcaattctcatgcctcagcctccggagtagctgggactgcaggcacacgtcacgacacctggctaattttttgtactttagtagagacgtggtttcattgtgttgcccaggctggtctcgaactcttgagctcagacaatccacccgcctcggcctcccaaagtgttaggattacaggtgtgagccaccgcacccagtcagatgttaccatgttttatttgaagttggaagatgtcttaaagttttacttttaagtttaaaacttgtagaaaatgcagttctttttttttttgagacggagtctcgctgtcgcccaggctggagtgcagtggtgtgttcgcggctcactgcaagctcagcctcctgggttcatgccattctcctgcctcagcctcccgagtagctgggactacaggcgcccgccaccatgcccagctaattttttgtattttttagtagagatggggtttcaccgtgttagccaggatggtcttgatttcctgacctcatgatctgcccaccttggcctcccaaagtgctgggattacaggcgtgttcttttacataggctgagggacatgttttgcttgtacataactaggagtaaggagtttgcaaagagaacaatgatactagtttacatttctgtgggtcctgacagtcctgtaggtgagctcttatagactgagtgtctgcctcaggtctcccaggcggtaaaaggcagagtcttgatcagaattcagcaggttccaggcgtctaagtcccttcccattgttttagcttaggctgcttgttcaggcagatagcagcagagagttccttacctctgttttctgtggccaacttgtgaaaatagtcagacccaatccactttgatctctcagctaaacccagccatggagaaaactatctggactagggaaacatttatatttacattggcattgcctcttatgcaaaagtagattattctgaaatcagagattaaggcaacattcaaatatacatatattttttttttctttgaccacctgccctcccccaccgccccccgacaaccccactggccaacattcagatatatttaaaattactctgagggccaggtaaagtagttggcttttgtttagggaccatgctgtatccaaaacaagtatttatttattttttttaagagacagtgtcttgctgtgttgactcaggctggtctcaaactcctgggctcaagcaatcttcccacctcagcctccaaagtagctggaaatataacaaaacaggtttatttaaacattaggaaatataacaaaacaggtttatttaaaccctgcttggatgctgttaacatgaaaggcatgtagaattgagacccacggagtcagatgcactacggatatcacttccactgttaaaatgtctcagttttggccgggcatggtggctcatgcctgtaatcccagcattttgggaggctgaggcgggtagatcacatgaggccaggagttcgagaccaacctggctaacatggtgaaacacaggagttcaagaccagcttgggcaacatagtgagacccccatctctatttttaaaaatattttatcttttaaaatttttaaataaataattgaagtaatatgtattaagtatagagatttggaaatcatccttattctatctccccacaaaaggaaagacaaataatccctgaatctacaaatcacttcttctttttttttttttttttttaagacaaagtcctcactttgtcatccaggctggagtgcagtggcgcaatctctgctcactgcaacttccacctcccaggttcaaatgattttcctgcctcagcctcccaagtagctggaccacaggcaggcaccaccacacccggctaaatttgtatttttagtagaaatggggtttcaccatgttggccaggccagtctcgaactcttgacctcaagtggtctacccacctcagcctcccaaagtgctgcaattacaggtgtgagccacttcgttcagcccattctgctatttttaagtacaggaacaacaacaacaaaaatgttagctgagcattaaattgttggaaatggagaggtttgtgtggctatagctgatgaaaaatgttaataatacttgttcttaaatagtagagagagaaaagaggaaagatgaattgcttaatattgcgaagtcaaagcaagaacgcacaaattcagaactgcacaatctgagacaggtatgtccccaatcatccttctctgtcacataagaaatgtttgtaaacaaatagcaaattaggaaaaatgtatgcccgtcgattttgtttaattggtgatttggaatcctaactacattagttgtatatcatgtttatttatttttattattattatttttttgagacggagtctcgcactgtcaaccgggctggggtgcaatggcctgatctcggctcactgcaacctccacctcctagttacaagcgatcctcctgcctcagcctcccaagtagctgggattacatgtgcccaccaccacgcccagccaattttttgtatttttagtagagacagggttttactgtgttggccaggctggtctcgaactcctgacctcatgacccgcccacctcagcctcccaaagtgctgggattacaggcgtgaaccagcgcacccagcctgtatatcatgtttagtatagcaaataggtcttgcttgtggtgatcaaaggctgggagcccagctatcctagcaaatcttagtgctaacaaaggaaaattaaaagcagacatatttagcatatttctctagtaactatctgacctgttttaggatttgtgaactgtttcagggaaagtgccaaattgttggttcagtttagttttgttattacatttcatgttgatttgtcaatatctatgacagatttatgtaaaacaacagagtgatctgcagtttcttaatttcaatgtggaaaattctcaggaattaatacagatgtatgactcaaagatggaggaatcaaaggctctggactccaggtaatcttagcaagatgcaattaatatgatcttgtattatattccatcagccagtatttactgcgcacttactgttggccagtactgactactattccccatatggtaggaaataaatgtggccgggcacggtgcctcacacctgtaatcccagcactttgggaggccaaggcaggtgggtcacctgaggtcaggagttcgagaccagcctggccaacatggtgaaaccccatctctactaaaaatacaaacattagccaggcatagtggctcatgcctgtagtcccagctacttgcaaggctgaggcacgagaatcgcttgaacctgggaggtggaggttgcagtgagccgagatcacgccactgcactccagcctggtaacagagcaagattctgtttcaaaataaataaataaataaaaatataaaaattagctgggcgtgttcgcgggtatatgtaatcccagctacttgggaggctgaggcaggagaatcacttgaaccccggaggtggaggttgcagtgagccgagatcgcgccattgcactccagcctgcgtgacaagagccaaactccgtctcaaaaaataaataaataggcctggcgcggtggctcatgcctgtaatcccagcactttgggaggccgaggcaggtggatcacgaggtcaggagatcgagaccatcctggctaacacggtgaagccccatctgtactaaaaatacaaaaaaattagccaggcatggtggcaggcgcctgtagtcccagctattcggcaggctgaggcaggaggattgctggaacccgggaggcagaggttgcagtgagctgagattgcgccactgcacttcagcctgggtgacagagtgagactccgtatgaaaaataaataaataaataataaataaatacaataaatgtgtgtgagctaataatgattgtcataatcctcagtcgcaggaagacccaatctaagaattttagtcatgatcctgatttagccactggatagaagtaaatttatttaacctgattttcccttctgttgtgtagaaggctttgagctagaatagacactacagagatgaatcattcattcatccatccatccatccatccgtccatccatccatccagcattcagtgtttggacactaggctaggacttgggcacatgtaggtatatagggcatggcactcgcccaaaagaagtaatgccaaggaatgcattgattactgagtaggagccccactccaccgagggtgatctgtgcccttaactggattttcctgcttgccttattaataggaaacatcttcccatccccacaacaagcagtgtgggaattaaattggttttggtaaaattaaaatataaacatataaagtgtggtttaatttaacaggcatataactgtaccacagctcaacttagtctacttttctaagccaaaattttacaagaagtctttgaaagggagagggattagggaagctccccatggctgtttggaaccatggaggctggactgggttgcagcagcgactttccctgggagaatggagttgagagcagcagggcttagtagctgcagcactgcagggatcaccccaggcgtgtggcgtgtggctggggccgccctgctttccgctgcacttgcttcactttcctttggggccctctgcgaggggttgtggcctgtggctctgggtcctagctgctgccgctgccaccagacaccagactaactcagagctctcttgcaggcagaagccccttacatactggctctttcttctttttcctttttttgagatggggtcttgctctgttgcccaggctggcatgcagtggtgcaacctcagctcactgcaacctccacctcctgggttcaagcgatcctctcacctcagccttccaagtaagtagctgggcccacaggcatgcgccaccatgcccggctacttttttttttttttttttttttttgtacatatggggtttcgtcgtgttgcgaaggctgtctttctcctttttgaccttcattgcctctaggaggtactagatgagttgaggttattccttaaaagctaaaaataggctggacgccatggctcacacctgtaattgcagtgctttcggaagctaaggcaggaggattgcttgaggccaggagttcaagagcagcctaggcaacatagcaagaccctgtctctataaaaaaaaaattttttttttttttttgagatggagtttcactcttgtcacccagactggagtgccaatggcgcgatctcagctcactgcaacctccacctcccaggttcaagcaattctcttgcctcagcctcccaagtagctgggaatacaggcctgcgccaccacgcccggctaatttttgtatatttagtagatggggtttctccatgttggtcaggctgggtctcgaactcctgacctcaggtgatccacccgcctcagcctcccaaagtaccgggattacaggcgtgagccactgcacccggcctcaaaaaaaattttttttaagcataaaatagtttatagcattatggaaagagagagttgtatttcctaagatatcagaatgatgcagattagaatacctgaatacaagtgacatgaaaaattttaaaggaagatttattaaaaggttttgtcacatttctgcagtattctttttttctcatgtagacagtaagtgcaataagaggaggatggaaaagggaatgtgggctttgtggtcagaaaggattcctggagaaggtcgggctggaattgggctctgaggttcagacaaacgagtctcattgggatttagctctactgagttttgggtgaaatgtttagaatgatagcatcaagtatatcttataacctccattttttttctaatgccaccatagcagagacatgtgtttatcagaccttgaaaataaccacccaaaagtcgatattaagagggaaaaaaatcagaagtcactgtttaaggaccagaaatttgaagccatgttggttcagcaaaataggtcagacaagagctcttgcgatgaatgcaaagagaagaaacaacagatcgatactgtgtttggggagaaaagtgtaattacgctgtcatccatattcaccaaagacttagtagagaaacacaacctcccttggtctctgggaggaaaaacccagattgaacccgaaaacaaaattacattgtgcaagatccacacaaaatcaccaaaatgtcatggcactggggttcagaacgaaggaaaacaaccctcagaaacacccactttatctgatgagaagcagtggcatgatgtcagtgtttacctgggcctgaccaactgtccaagttcaaaacatccagaaaagctggatgtagaatgtcaagatcagatggaaaggtccgaaatctcatgctgccagaaaaatgaagcctgtctgggcgaaagtggcatgtgtgactccaagtgctgccacccgagtaacttcataattgaagccccaggccacatgtctgacgtggagtggatgagtattttcaagccttccaaaatgcagagaattgtccgcctcaaatctgggtgcacctgttcagaaagcatctgtggcacacaacatgactccccggcaaggtgagtaacgttcacatctgtaaacacccacggagcatgcatgccagtatttggaaatacaaagggtgatggaagccacgccatacctactattaatccaaaaggcatgtttgctaacagaaatcttccttaggaccaatggttccctcttttcatcacagcatggactgttgagtctttaattatagaggctctattaggttccagggatgtgtttatactgaggacggcttctgaggcaaaggttttgtttaaaaacaaaaccagttgttatgacttgggcagatatgctttattaaaaagcaaacgggtggatcgctgcacagagtggaacgccaccctagagcattcctcaccccagaagccattctgaactgacacgctgaccatttctggtccagatggcattacctagaccccatataaaaatgtctcttggtgcattgtggtggctcatgcctgtaattctagcactttgggaggccaaggcaggagggtcacatgaggccaggagtttgagaccagcatgggcaatataacgagaccctatctctacacttttttttttttttttttttggagatggagtctagctttgtcgcccaggctggagtgcagtggcgcagtcttggctcactgaaacctccgcctcctgggttcaagccattctcctgcctcagcctcccaagtagctgggattaaaggcacacaccaccatgcccagctaatttttataagttttgtaaagatggggtctcaccatattggccaggctggtcttgaactcctgacttccagtggtccacccaccttggcctcccaaattgctgtgattacaggcatgagccaccacacttggcctctacacatttttaaaaaattgtttttaagttagctgggcatggtggtgtacacctgtagtcccagtacttgggaggctgaggcaggaggaccacttgagtccaggaatttgagactagcctggttaacatagtgaggctccatctctacaaaaaaaattttttaatttgctgggcatgggtggcaaacacgtgtagtccaagctacttgggaggctgaggtgggaggatcacttgaactcaggagtttgagactgcagtgagctatgatggtgccactgcactccagcctgggcaacaaagtgagactctatttcaaaaacatttgtcatggctctttttttaaaaattgagatgaggtgacacgatattgcccaggctggtctcgaactcctgggcttaagcaatcttttcacctgtggggattacaggtgtgagccaccgcatccagcatctctcagctcttatccagggtcacttagtatatttacatatccgaccgtgcctgcctttgtgttcattcatttcatatctgtttgagactttacattgcccagactttcttaatttttgaaaatcattcaggaaagaggatacttgtatttaacaagctggtaagttattggtttttttaagagaagaaaatttaagagaataaggcatatgctgccttattcaggcttgtcttattgttggaatagctgaatcttgtgtgtgagtgtcgtcataataatgtctgctattttaaaataaagcatagctctttaatcttaaattacagaaaggatgaagtttctatattgagaggcgtattttaatcattacattggcttttataggactttatgattaaagtttatttctagtgcttaattatttggagtatcctttggctctttaattgtattttgtttatttatttcctttggcccttttagaaacttgaattgtttaaaagtcatgcagatagtcattctgccagttgcaaattattttaaaaagtcggtcatcacgctaaatgtcatctattcatatttggtctttaaagatctttggataattgcaagtatcagggcacaatgcctatttttcactactgaacaaggacactcatatattaagggacaagcttatgtcagatagttttaagagcatagaggattaaatttaacgtatgaaataagttcagatttacattcagagtttccttcaaggcccttttgacctcaccgacttaaaatgattgaagtgattgcctgttctgccagcagagacggatgccaagatatcacatgacaaatatgtgattaagtagaaagataattatgtttttctctttttccatagattataagaacttgcgtacctactttattatctaactaaaatgttcacatctgtgccagcattccatttgacaaacagaggtttacccgtgcagggagaaactgggggcagcctgttctcacttcattgtagcttacagggaaggaagcagttctagtgcctctggtctgttccagaacagcttttgctgtcaaactcaggcggatcacctgaggtcaggaggtcgagaccgacctggccaacatggtgaaaccctatctctactaaaaatacaaaaatgagccggacgtggtggcacacgcctgtagtcccagctactcgggaggctgaggcacaagaatcacttgaacccaggaggtggaggttgcagtgacccaagattatgccactgcactgcagcctgggcaacagaatgggactcggtctcaaaaaaaaaggtcattggccaagtgaggtggctcatgcctgtaatcccaatactttgggaggccaaagcaaggaggatctcttgagttcaggagttgaaggccatcctgggcaacagcatggcccatctccaataataacaaaaataaataaataaataaagccattaacaaaaatcaatctcacaaactgaaaacctaaaattttcacaagtataaccttattccatgttgttttttttttctctttttagagatagggtctcgctatcacccaggctggagtgcagtggtataatcatagctcactgcagcctctaactcctgggctcaggtgatcccacctcagcctcccaggtagccaagactacgggcacgagtcactgcacttggttccatttttttttttttttttttgagatgaagtttcactcttgtcgcccagcctggagtgcaatggcacgatctcggctcactgcaacctctgcctcccgggttcaagcgattctcctgcctcaacctccagagtagctgagattacaggcgcgcgccaccatgcccggctgatttttgtatttttagtagagatggagttttaccatgttggccaggctggtctcaaactcctgacctcaggtggtcagctctcctcggcctcccaaagtatggggattacaggcatgagtcaccgcaactggccggcttttttttttttttttttttttgtgagaattagtctgttttaatttttccctcccttttagatgatcctatctttagaactttcatttcattgtatttttagggggaacattctttgttctatagttacctttacctaataattttgtcttaattctttttttttttttttttttgagacagagtgtctctctgtcaccaggctggaatgcagtggtgcgatcttggctctccgcaacctccgcctcctgggttcaagcaattctcctgcctcagcctcctgagtagctgggattacaggcacatgccaccacacccagctctttttttttttttttttttttttgaggcggagtcttgctctgtcgcccaggctggagtgcagtggcgcgatctcagctccctgcaagctctgcctcccgggttcacgccattctcctgcctcagccttccgagtagctgggactacaggcacccgccaccacacctagctaattttttgtatttttagtagagacggggtttcaccgtgttaggatggtctcgatttcctgacctcctgatccgcctgcctctgcctcccaaagtgctgggattacaggtgtgagccaccgctcccggccacatccagctaatttttgtgtttttagtagagatggggtttcaccatgttggccaggacagtcctgatctcctgacctcgtgatccacccagatcagcctcccaaagtgctgggattataggcatgagctaccatgcccagccttattttaattcttatttgcaaaaggtatgcattaacttataatattctattccaatctataatgttctactcaaacttgacctgcttcaataacaaaaacacttatttgtccttttaagatacttttgagtataagagtgatctatgtatgatattgttttaagatatttgtttttgttgggttttcttattcttagtgagctaattgccatccaagattcccactctttgggttcttcaaaatctgccttgagagaagatgagacggagtcctcttccaataaaaagaactcacctacgagtttgttaatctacaaagatgcaccagcattcaatgaaaaggttcgtattttgcttagacatccccagcttactcaagccaggcctctcaccagcttttaatgcttctctagcaaccactgttagcttgcttattttggctattcctccgtttttttttttttttttttaattctaggattttaagatgcttttaaggcaatccttttatttattttattattttgtgttttgttctgtttctttgagacaggatactcagtcacccaggctgtagtgcagtggtgcaatcgtggctcactgcagcctcaacctactgggctcaagtgatcctcctgcctcagccttccaagtagctgcaactacaggcacatgccaccacgcccagctaattttctcatttttttgtagagacagggtctcaatttgttgcccagtctggtcttgaacacttgggctcaagtgatcttcttgccttggcctcccaaagtgtgctgggattataagtgtgaatcaccgtgctgggactatttttttctttcgagaaaaattgtattttttttttttttggcaacttgatatatgttggttgtaaaaaaaaaaagaaagaaaaaagaaaaagaaaaacaaaccacaagaacaatacagaaatatagatatcacctaactgcttggtctcagctgccccttcctccaaatacacaacccctggcagtgtctagagagacccaggtgacacgttggtgggcttgcttacagatttctctatctgcagagacatgcatacagactaatgtgtggtaaatgggatttcattatatgagaaaatgtgtggcaaggtacagtgcctcgtgcctgtaattccaacactcttgggggccaaagtggaagaattgcttaagcccaggaattcaggatcagcatgggcaacatagcaagaccctgcctctattttttgtttcaataaaattttaaaaacataaaagaggaaaacatcgccaggcgcagtggctcacgcctgtaatcccagcactttggaaggccggggtgggcagataacctgaggtcaggagttcgagaccagcctgaccaacatggtgaaaccccatctctactaaaataaaaaaattagccaggtgtagtggcgggtgcctgtaatctcagctacttgggaggctgaggcgggagaatcgcttgaaaccaggaggcagagtttgcagtgagccgagattgcaccattgcactccagcctggcaacagagtgagactctgtctcaaaaaaaaaaaaaaaaaaaggtaaacatctgacatctatgatttaccaagataccagggtggcaaattgaaatcttcatcccactaatgggattacaggcacaaggcactgtacctggccagacattttcttgtataataaaatcccatttaccacacattagtctgtatgtgacagactaatagtgacacattcattacacccaaacccctttggaattcttcctctgccctgtgcgtccctccctattcccagacaatcactcactaatctgtcttctgtaacccagattagtttgccttttctagaattttatataaatgcattcaaacttttgtgtccctcttgtttctttcactcagtgtaattattttgagattaacttatgtgactgtgtatataaataattcctttttgttgctgacaagtatcctattgtgtggatatattaggttgatgcaaaagtaagtatggtctttgtcattaaaagtaatggtaggccattaaaagtaatcccaacactttgggaggccgaggcaggcggatcacttgaggtcaggcgttcgagaccagcctggccagcatggtgaaatcccctgtctactaaaaatacaaaaatgagcctggtgtgctggtgtgtgcctgtaatcccagctactcaggatgctgaggcagaagaattgcttaaacccgggaggcaggggttgcagtgaaccaagatcgtgctactggactccagcctgggtgacagagcgagattcaatctcaaaaaaaaagtaatggcaaaaaccgcaattacttttgcaccaacctattaccacagtgatttagccattcatttgtcagtggacatttgggttgtttctggtgtgctagataatacaaataaagctgcttgcatattcatgtatcataagtctttgtatagacacatttttttttcgtttatctaggaatggaatgctagctagctcatatggtaggtgtatatttaacctttttttttctttttttagagacagggtctcactctgtcgcccaagctggagtgcagtgatgccatcctggcttactgcaatctcaaactcctgggctcaagtaatcctcccactgcagcctcccaattagctgggactgtaggcatgaaccattatgcccagctcatttttacatttgttgtggagatgtggtcttgttatgttgcccagggtggtctcaaactccttacctcaagcaatcctcctgcctcagcctcccaaagtgctggggtatatttaacattttaaggaactgcaagatgttttccaaagtggttataccagttacattcccaccatcagtgtggtgctgatgctccggtcccagctgctccagattccagtcaatacttgcaatggtcaatttttaaattccagacattctaataggtatgaagaggtatctcagtgtggttttaactttcattcccctaatgactaacaatgttgtgcaccttttcacacgctaaaccaccatctatttatagcttcgatttcaactgatagagaagttctagccagttattcaatcccaaagagacgctattctttatgtctgtgtagaatatcccttctttaattacttctccagatttacctcctctctgcactatgcgaacaaaacacttatcaggccatcaggccgggcgtggtggctcatgcctgtaatcccagcactttgggaggctgaggtgggcagatcacctgaggtcaggagttgaagaccagcctggccaacatggtgaaaccccatctctactaaaaatacaaaaattagccaggtgttgtagctcgtgcctgtggtcccagccactcaagaggttgacgtggaagaatcacttgagcccgggaggcggaggctgcagcaagctgagattgtgccattgcacttcagcctgggcgacagagccagaccctgtcttaaaaaataataataggctgggcgtggtggctcatgcctgtaatcccagcactttgggaggctgaggcgggtggatcacctgaggtcagaagttcaagaccagcctggtcaacatggtgaaacaccatctggctatggcgaggtgccaatgactttcttcacagaattggaaaaaaatactttaaagttcatatagaaccaaaaaagagctcgcattgtcaagtcaatcctaagccaaaagaacaaagctagaggcatcacgctacctgacttcaaactatactacaaggctacagtaaccaaaacagcatggtactggtaccaaaacagagatatagaccaatggaacagaacagagccctcagaaataataccacacatctacaactatctgatctttgacaaacctgacaaaaacaagaaatggggaaaggattccctatttaacaaatggtgctgggaaaactggctagccatatgctgaaagctgaaactggatcccttccttacaccttatataaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaatcggcaaatgggttctaattaaactaaagagcttctgcacagcaaaagaaactaccatcagagtgaacaggcaacctacagaatgggagaaaatttttgcaatctattcatctgacaaaaggctaatatccagaatctacaatgaactccaacaaatttacaagaaaaaaacaaacaaccccatcaacaaatgggcgaaggatatgaatagacacttctcaaaagaagacatttatgcagccaacagacacatgaaaaaatgctcatcatcactggtcatcagagaaatgcaaatcaaaaccacaatgagataccatctcacaccagttagaatggcgatcattaaaaagtcaggaaacagcaggtgctggagaggatgtggagaaatagaaacacttttacactgttggtgggactgtaaaccagttcaaccattgtggaagacagtgtggcgattactcagggatctagaactagaaataccatttgacccagccatcccattactgggtatatacccaaaggattataaatcatgctgctataaagacacgtgcacacgtatgtttattgtggcactattcacaatagcaaagacctggaaccaacccaaatgtccaaaaatgatagactggattaagaaaatgtggcacatatacaccatggaatactatgcagccataaaaaatgatgagttcgtgtcctttgtagggacatggatgaagctggaaaccatcattctcagcaaactatcacaaggacaaaaaaccaaacactgcatgttctcactcataggtgggaattgaacaatgagaacacttggacacaggaagggggacatcacacactggggcctgttgtggggtggggggaggggggagggatagcattaagagatatacctaatgtaaatgatgagttaatgggtgcagcacaccaacatggcacatgtatacatatgtaacaaacctgcacgttatgcacatgtaccctagaacctaaagtataataataaaaaataaataaataaataaaaagaaattaagtttccttttttttttttttttttcagacggagtttcactcttgttgcccaggctggagtgcaatggcacgatctcggctcaccgcaacctccgcctcccaggttcaagcgattctcctgcctcagcctccctagtagctgggattacaggcatgtgccaccacgcccggctaattttgtatttttagtagagacggggtttctccatgttggtcaggctggtctcaaactcccaacctcaggtgatctgctcgcctcagcctcccaaagtgctgggattacaggcgtgagccaccgtgcccggctgaaattaagttttcttaaaaaaaaaaaaaaatcaggtggtggctcatgcctgtactcgcagcacttttggaggctaaggaagggggatcacctaaggtcaggagatcgagaccatcctgaccaacatggtgaaaccccgtctctacgaaaaatacaaaaattagctgggcgtggtggcacatgcctgtagtcccagctactcgggaggctgaaaggcaggagaattgcttgaacccgggagttggaggttgcagtgagctgagatcacgccactgcactccagcctggcaacagagtgagactccatctgcaaaaaaaaaaaaaaaaaaaaaaaaaaaaaaaattcagtctaggcccctttaagagcaattggcagtgactaattttcatgccaaacttcacatcccaaagttgaaatttaataggaataaacgaaggcacatacccacatatttttcaaggcttataagcctttaatgttgtcctattttgcaagtattttgacatgctaaatacagcattgacaagttggttgaggagagttaaccaatgcctaggattcttttatcgcatgggtgttacttcattagctgtagtaagttctgtttaagtcaaattatttaactgagtaggttctaagaaataaagggggctgggtgcagtggctcacgcctgtaatcctagcactgtgggagttcgaggcggatggatcactggaggtcagaagttcaagaccagcctggccaacatggtgaaaccctgtctctactaaaaatacaaaattagccaggtgtggtggcgggcaactgtagccgcatctactcgggaggctgaggcaggagaatcacttgaacccgggaggtggaggttgcagtgagctgaggttacactattgcactccagcctaggcaacaagagcaaaactccgtctcaaaaaaaaaaaaaagaggccgggtgcggtggctcacacttgtaatcccagcactttgggaggctgaggcaggcagatcacgaggtcaggagattgagaccattctggctaacgtggtgaaaccccgtctctactaaaaaatacaaaaaaaaattagccaggcatggtggtgggtgcctgtagtcccagctacttgggaggctgaggtgggtggagcttgaagtgagccgagatgatgccactgcactccagcctgggtgacagagcgagactccgtctcaaaaaaaaaaaaaaagaaagagagagagagggagggagagagagagagagagagagagaaagaaagaaagaaagaaagaaagaaagaaagaaagaaagaaagaaagaaaaggaatgaatttagttattcttattctactatttgatgtccagctttgctttgtaacacctaaagacaaagaaatattcacaggtgatcgggtgtagtggctcacgcctataaccccagcactttgggaggccgaggcaggagggtaacttgaggccaggagttcaagaccagcctgggcaacatagtgagatcccacctctaccaaaaaaaaaattgctcggtgtggttgcacacacctatggtcccagcttttcaggaggctgaggcaggaggatcactcgagcccaggagcttgaggcaatcagctgtgattgtgccactgcacttcagcctgggcgtcagagcaagagaaagaaaaaagaaaacaatattcctaggtagttagcatttgtgtttgtaaacctaagcatttaaaggtgcctcttaatttcctgtaggcttcaattgtgttaccctcccaggatgatttctcgcccacgagcaagctccagcgtttgctggcggaatctcgtcagatggtgacggacctggagctgagcacactgctgcccatcagccatgagaatctcactggcagtgccacaaatgtatgcgtttcattttctcttgactatatttgtcacatccaaacacaccactgaacaccagtgtgcaaatatcaccggcagggcggcctttctgttagagggagagtttctgtgtctctagggaggaaagggaacatgcttgttttaaggaggaaaaagttacacttagatgtcactggacccaaacttcctctttctaatgatctggggcatatgaagataaattcttggggacttttttcttggagggggcgggtacagagttttgctcttgtcgcccaggctgaggtgcagtggcacgatctcagctcattgcaacctccacctcccgggttcaagtgattctcctgcctcagcctcccaagtaactgggactaaaggcctactctaccatgcccggctaatttttatatttttagtagagacagggtttcaccatgttggccaggctggtctcaaactcctgatctccagtgatccacccaccttggcctcccaaagtgctaggattacaggcgtgagccaccacggccagctggaaatgttttaaaaaaccaaattttattatagaaagtttcaaggccgggcgtggtggctcatgcctgtaatcccagcactttgggaggccgaggcgggtggattacctgaggtcaggagttcaagaccagcctgactaacatggagaaaccccgtctctactaaaaatacaaaattagccggacatagtggcacatgcctgtaatcccagctactcgggaggctgagacaggagaattgcttgaaccccggaggtggaggttatggtaagccgagattgtgccattgcactccagccttggcaatgagcaaagctccacctcaaaaaaaaaaaaaaaaaaaaaagagagagagaaagaaagaaagaaaatttcaaatatgcactgaagtggaaagaatggcacggtcactcacctttgaccaccatcgattttatcttaccccatccatacacgttttctttggaagcattttagctcagcatcatatcatgtcactcataaatatttcatgatcatgatgtctctctaacagatatggacttttaatttttttttttttttttttgagactgagttttgctcttgttgcccaggctggggtgcaatggcacgatctcagctcactgcaattctctgcctcctgggttcaagcaattctcctgtttcagcctcccaagtagctgagattacaggcacctgccaccatgcctcactaatttttgcatttttattagagacggggtttcaccatgttgaccaggctggtctcgaactcctgacctcaagtgatccacctgccttggcctcccaaagtgttgggattacaagcatgagccaccctgcccggcctaattttaattttgtgtatttatttatttttgagacagcatcttcctctgttgcccaggctggagtgcagtagctattcgcaggcgtgatcacagctcactgcagcctcaaattcctgggctcaagcaatcctcccacctcagtctcccaagtagctgggaccacaggcacgcactgccatgcccactctgtttgccaggctgcttgaactcccggcctcaagtaatcctcctgcctcagcctcccaaagtgttgggactatcagcatgagccaccatgctcagcttatttatttgttttttagagacagtcttgctctgtcacccaggctggaatgcagggccaacttgaacctccaactcccaggctcaagtgatcttcccacctcagcctcctgagtagctgggattacacgtacacgaaaccacacccagctgatgtttttattttttgtagaaacagggtcccacaatgttgcccaggctggtctcaaactcttgggttcaagcaatcctcctgcctcagcctcccaaagtgctgggattataggcgtgagccgctgtgcctggcctggcttttcttaacagtgtcttttaaaaagcgaaatttaaaattttgattacttccaacttaacaggtttttttttttcttttttgagacggagtctcgctctgtcgcccaggccttggtgccagtggcgcgatctcggctcactgcaagctccgcctcccgggttcacgccattctcctgcctcagcctcccgagtagctgggactacaggcgcccgccaccacacccggctaattttttgcattttttggtagagacgggctttcaccgtgttagccaggatggtctccatctcctgaccttgtgatccgcccgcctcagcctcccaaaatgctgggattacagacgtgagccaccacacccagcctattctagtagtttttttgtagattccttaggattttctacacaatcatgtcattcatgaatagagacagttttattcctttttccaatatttatgccttatttcattttcttcccttactgctctggctaggacctccagatgagtgttgaatagaagcaggggagcaaacatctttgccttatttcacgaaatgctctctgatggcaattcttgcttagtccttcagattggtattttgttagattcagagttccctggagcagtttctatgtgccgcgaatagatccaaaactagaacattaatcattttagaatcaagatgctcactgccatgagcctaaacaggtagttgcagagattaccttaaagcagaacaggatccaaaactagaaatttttcaaagtataccatgtgtgccatataaacttttcaaagtggaaaccgtgatggactctggtgtttcctaggaagatttcttcttcacaagctgtctctgaggcattagtgaagcgttgcatttatattggggcagaggaaggtttttaatgacaaaactattttggtgcttagctatccctttaaatgtatgcagtgaggctgcttcttcccctgtgtctggggagaacctttatgacttttctagtcattctttggcagctatttctttaaaatacatttttttaattgagatataggccagccatggtggctaatgcctgtaatcccagcactttgggaggccaaagcagatggatcacttgagccaaggagtttgagaccactctgggcaacattgaaaaaccccacctctacaaaataaaaaattttttttaattagctggacacactgccatgcaccagtagttccagcaactcaggaggctgaggtaggaggatcacttgatcctgggaggtcaagactgtggtgagccatgatcttgccactgcattccagcctgggtgacagagtgagaccctatatcaaaaagagagacagaattcacattttattatttacatacaattcacccttctaaagtgtacaatttggtggttttttttaaatcatattaataaaatcgtgcagccactaccgctatctaattctagaatattttaatcaccccaaaaggagaccccacatccacagccactggttaccacaatctactttctgtctctatggatttgttggacagataattttaatcagaatttgttgactagaattcatgggatccatgaactttgatggaataaagattacatgccagtttatttttatttttaaattttatttatttatttatttattgttttgagacagagtcttgctctgtcacccaggctggagtgcagtggtatgatcttggctcactgcaagctccaccttccgggttcacactattctcctgccccagcctcccaagtagctgggactacaggcacccgccaccacgcctagctaatttttttttttttttggatttttagtagagatggggtttcaccatgctagccaggatggtcttgatctcctgaccttgtgatccacccgcctcggcctcccaaagtgctgggattacaggcatgagccaccatgcctggcctatttttttatttttattttatttttgagatggagtttcactctttcctccacttcctgggttcaagcgattctcttgcctcagcctcctgagtagctgggattacaggtgtgagccaccatgcctggttaattttttgtatttttagtagacagagtttcaccatgttggccaggctggtctcaaactcctgacctcaagtgatcctcccaacttggcctcccaatgtgctgggattacaggcgtgagccactatgcctggcccaaattcacgttttccaaacaagcattatagcaacagatgtctcctccttgtcctcgtggcttcaggttgttctctcaacctctttgttagggttttatgtcaaattcctgagatataatcaatcactccctcatttttgtcctgctagtgtagctctgtgtgtgtgtgcctgcacatgtgtgtgtgtgcatgcatgcgtgtgtgtgtgtgtatctgcctccatcagagtgcacgtcaggtagccaacaggtgactgcgtccatgactcctgctcactgtgaacgcctcaggacccttctccaccttggcaccctggctgcagcacccagcatctgccacaggcggtctcagggcctaccttgaatggaactgacaggaacatgcagaaaaaagaaaaagctggccaggtgcagtggctcacacctataatcccagcactttgggaggccgaggtgggaggatcacttgagggcaggagttcaagttctgctggggcaacataccaagactttgtctctacaaaaaattcaaaaattagctggatgtggccaggcgcggtggctcacgcctgtaatcccagcactttgggaggccgaggcaggcggatcatgaggtcaggagatcaagaccatcctgtctaacacggtgaaaccccatctccactaaaaatacaaaaaaattagctgggcgtggtggcgggcgcctgtagtcccggctacttgaaaggctgaggcaggagaatggtgtaaacccatgaggcggagcttgcagtgagccaagatcgtgccactgcactccagcctgggtgacatagcgagactctgtctcaaaaaaaaaaaaaaaaaaaaaattaactggacgtggtgacccatgactgtagtcctgggtacttgggaggttgaggggggaggatcgcttgagcatgaggtcaaggctacagtgagctatgatcacaccactgtactccagcttgggccatagagtgggacactgtctaagaaaaataaaataaaattagctgggtgcagtgactcacacctgtaatcctagctctttgggaggaccacacaggaggattgcttgagcctgggagttcgagaccagcctgggcaagatagtgagaccccattgctaaaaaataaaaattagccaagtgtagtggctcacgcctatagttccagctactcaggaggctgaggtaggaggatcatgactttgagcccaggagttcgaggctacagtgaaccacgatcacaccattgcactccagcctgggcaacagagcaagaccctgtctcaaaaaatatatttttttcagagtgtttgagctagaaagatccagaagagatatctaattccaaccttacattttacaggaagggaaaaatgaccgaatctctttagtcaacaaagtacagctagaatcagaaaatcatttaattggaaaaactgttggctccagatatcatacattttctggtgcattaactgattctagagatattgggaagacagaatttaaataacagggatttacctggcaacacgctttacaaactcctccccccatgcctttgtactgagtacagctaggtaccgaaaaagcaaataattttgtttaaaaattcttaatttctgcaataaggaagcagggtaaagttctgagcagcgtgtctgcttctccagggctttgccatctgtcgctacagacaagggtcgcaattcagagccttgctgtgagacaggcactctcccacgttgccagggagcaggcaatgattcagtcctcctgttggggaaattggcaatgttttctaaaaatcactgaagaactgacgctttgacaatgcagtgtcactttgggaatctctcccacagatacttctgcatgtgtatgaaatggcataggcacacgtgtttctttgcagcattgctttacaatagcaaatgataggaggccacccacccagtgtccagcaaaagggaaccgagggaataagctgtggtccacccacacggtggagttctgagcagacatagaacagaatgaggtgctctagtatgtggaaatatttccagatatattgctaagtgagaaacgtgcaagatactgaaggttcatatggcattccacatacataaggagagggccaggagcagtggctcacacctgtaatcccaccactttgggaggccaaggtgggaggattgcttgagcccaggagttcgagaccagcctgggcaacatagctaggccctgtctctacaaaaaaaggtttttaaaaacattagcggggcatggtggtgcacacttgtagtcccaggcactcgggaggctgggacaggaggattgcttgagcccaggaatttgaggctgcagtgagctgtgattgagcaactgtattccagcctgagcgatacagcaagatcctgtctcaaaaaaaaaaaaaaaaaaaaaagaagaagaagaaaagaaagaggatggaaataagaatatatatttgcacaaagacacagtggaaagatgatataaattttaccaataggaggcatgagggatgaggcagaagcgggacttctcagtttatacctgtttttattattttgatttttaaactattcaagaaaaactccaataatttaaaaatagacaaaggagaaaaaaggagttagagtaaggggaagcgcacagctgagcacattgcctcatggcgggcttcctccttgcctggagggtaggggtgaggagcggaccctaccataaactgagcttggacttgtgcctgctgtgtgggcctggccgtcctgattgctggcttgagatggttggtgttacctgtcggggctcttggcctttctcgtggcaggctgataaagcctgcagatccctttcagaatgaagtttttaaacgaataagagaaaatacatagcatggtagcaaggcacggtggttcacgcctgtaatcccagcactttgggaggcccaggcaggcagatcacctgagggcaggagttccagaccagcctagccaacaaggtaaaaccccctctctactaaaaatacaaaaattacccgggcatggtggcgtgccgtaatcccagctactcgagaggctgaggcactagaatcgcttgaacccaggtggcggaggttgcagtgagccgagatcacgccactgcactccagcctgggcaacagagcaagactctgtctcaaaaaaaaaaaaaaaaaaatcagatggtaaaatacatgggcaatttgcatagagaggaagcagcatgagtaaaagcacagaggactggaagcacccttgggtgcccctgaggaactgtgagggatcccggggtggctggaatgcaggccacacaggcagggggaggtgaggaggtgggctcacctgcaagccaggggtcaccacggaatgcactggggtctttccaggcatcatctccccttcattcctcccccttacctctccactccccttcttcctcttttccccacccagacacctaagaaggctaacgaggcacttagagttgccgatgcttaactactgaccactgttttcaacacggctcactgagggctcactggatcggtgcctgtgttaggactgacagcgagccagttatatctgggcattagctgatggccagcgtttagctgtaacacacatggtgaagcagacagagaagtccttccagattagagacaaaggggaccccacacatgaatgggaagtcaagaagcctttgttggatggatggatggcaattgtatgcagtcacttcattatattttattcattccctaaggtcttatttatttattattttctgagacagggtgtcactctctcgctcaggctagagtgcagtggcacgatcatggctcacttctgcctcaaactcccaggctccagcggtcctcccacttcagcctcctgaatatctgggagtacaggtgtttgtcaccatgcctggctaatttttttttaagtgtattttttgtctccccgtgttgcctaggctggtctcaaactcctgggctcaagagatcctcccacctcagcctcccaaagtgctgggattgcaggcgtgagccactgtgcgtagccactatggtcttttttaaattgacaaataataattgtatatatttacagtgtatagtgcaatgttataatatgtatataacatagtagaatgactaaaccagctgtgtatctatcacctcacatacttatcatgtctttgtagtggaaagatttagaaccgattcatttaacaattttgaaatatatcatacattattattggctgggcacaatggctcacacctgtaatcctagccctttgggaggctgaggcaggaggatcacgtgaagccaggaatgggcaacaatgggagaccctgtctctataaatttaaacacacacacacacacacacacacacacacgacattatttatcttttttttttttttttttgagacagaatgtcactcttgtcaccaagctggagtgcagtgtcgtgatcttggctcactacaacctccacctcccaggttcaagcgattctcctgcctttcagcctcccaagtcgctgggactacaggcgcgtgccaccacgcccagctaattttcgtctttttagtagagacagggtttcaccatgttggccaggatggtctcgagctcttgaccttgtgatccgcctgcctcggcctcccaaagtgctgggattacaggcgtgagccactgcacctggccaatacattattattaaccatagtcatggtgctgtgcaatagatcactaaaacttttcctcctgtctaattgaaactttgtacctttgaccaatagctcccctttccccatccactccctccccaagcctctggtaatcactattctactctctgcttctatgagttccacatttttttttttttttttgagatggagtctcggtctgtcgcccaggctggagtgcagtggtgcgatcttggctcactgtaagctccgcctcccgggttcacaccattgagttccacactttttagatttcaaatataagtgagatcaggcagtatttgtctttctgtgcctggcttctttcacgcagtctaatgtcctccaggttcatccacgctgttgcaaattacagaattttgtttgtttttatggctaaatattactccattgtgcgtatatactacgttttcctgatccactcatctgctgacaggcacttatgttgcttccgcatcttggctgcagtgaacatggagtggagtgcagatatctcttcatctaacgtctttttttcttttttctttttttgagacagggtctcactctgtcgcccaggctggagtgcagtggcgtgatcttggcttactgcaacctccacctcctgggttcaagcaattctcccacctcagcttcccaagtagctggaattacaggcgggcgccacgatgtccagctcatttttgtatttttggtagagatggggttttgccatactggccaggctgctcttgaattcctgatctcaagtgatccgcccaccctggcctcccaaagtgctgggattataggcatgagccaccacgcccagcctcatctaacatctcttaaaggcatttctgctatatttgtgtttagtcttcttaagaattttttagtttctctatcctgaatactaatctgggagttgttttctagaagtcagaggtcccagaagagtcagctcaaaaaaatacctttgtcagttattgaaggaaacaaaaggcaacttcagtattcatcgtgatcacgagtaagtcacctttgcttatctcaccttatatctcaattaatatttaataagtaacttgggaacatcgataacgttgagtcaaggccatgcatttgtttgacttgtaatactttctcttttgctcgaccaatttatgcatacttctaaatttaatcagagtaaaatgtcaattacttgcaaagaaatgcagatcaaaaagttctcctgcactccagcctgggaacacagtgagaccttgtctcttaaaaaaaaaaaaaaaaaggccgggcgtggtggctcacacgtgtaatcccatcactttgggaggctgaggcggctggatcacgaggtcaggagttcgagaccagcctggtctgtcactactaaaaatacaaaaattagccaggcgcggtagtgggcgcctgtaatcccagctacttgggaggctgaggcaggagaatcacttgaacccaggaggcagaagttgcagtgagccaagatggcaccactgcactctagcctgggcaacagagcaagactccgtctcaaaaaaaaaaagttattattctcaatacctagaattttaaatctagggaagtgaatacatagacacagctttaaaaatcagaatctaatatgaaaagatgttcaacatcactaattatcaggggaatgcaaatcaaaaccacaatgcgggccgggcgcagtggctcatgcccataatcatagcactttgggaggccaaggcgggtggatcacttgaggccaggagtttgagacaagcctggccaacatggtgaaaccgcgtttctactaaaaatacaaaaattagccaagcatggtggcgggcacctgtaatcccagctactcgggaggctgaggtaggagaatttctggaacctgggaggcggaggttgcaattagccaagattgcaccattgcactccagccgggcgacaataatgagactctgtctctaaacaaacaaacaaaaaaccaaacaaacagaaaaaccacaatgcagtaccaccttactcatgcaagaatggccataatttaaaaatcaagaaataatagatgttggcatggatgtggtaaaaagggaacacttttacactgctggtgggaatgtaaactagtacaacccctatggaaaacagtgtggaggttatccataaagaactaaaagtagaactccgatttgatccaataatcccactactgggtatctacgtggaggaaaagtatatgaaaaagacacttgtacacacatgtttatagcagcacaattcgcaattgcaaaaatacggaaccagcgcagatgcccatcaatcaactaatggataaagaaaatgtggtatatgggccaggcatggtggctcatgcctataatcccagcactttgggaggccgaggcaggcagatcacctgaggtcgggagtttgagaccagcctggccaacatggtgaaaccctgtctctactaaaaatacaaaaaattagctgggtttggtggtgcatgcctgtaatcccagctactcaggaggctgaggcaagagaatcgcttgaacccaggaggcggaggttgcagtgagccgagatcgtgccattgcacaccagcctgggcaacaagagtgaaactcagtctcaaaaaaaaaaagaaaagaaaaaaaattatagctgaaaaaaaatcaaaattaatgttttagcatttcatctgtctgtccagaaagaagttttttgtttgtttgtttttgagttggagtcttgctctgtcgcccaggctggagtgcagtggtgcaatctcagctcactgcaacctccacctcccaggttcaagcgattctcctgcctcagtctcccaagcagctgggattacaggtgcgcatcaccacacctggctaatttttttttttttttttttttgagacagagttttgctcttgtctcccagtctggagtgcagtggtgcgatctcagctcactgcaacctccgcctcccgggttcaagcgattctcctgcttcagcctcccaagtagctgggattacaggcatgtgccaccatgcccggctaattttttttttttttgtatttttagtagagacggggtttcgccacgttggccaggctggtctcgaactcctgagcttaagtgatccgcccgcctcggcctcccaaagtgctgggattaaaggcgtggccccccacgcctagccaagaagtctttatgtggagtaaagttttataaaagttttacatggggtagctgggcgcggtggctcacacctgtaatctcagcactttgggaggccgaggtgggcggatcgcctgaggtcaggagtttgagaccatcctggccaacatggcgaaaccccgtctctactaaaaataccaaaaaaaaaaattagccgggcatggaggcgcatgcctgtaatcccagctactggggaggctgatgcaggagaatggcttgaacccgggaggcggtggttgcaatgagtggagatttggccactgcactccagcctgggcgacaagaacgaaactccgtctcaaaaaaaaaaaaaaaaaaaagttttacatcgagtaaaatcttcataaaaacgtgtattgacccagtaagcactttctggatttgtgtttacttctatcaaacctgcatttcatatgcggtttcctcagaacccagtttgataagctaaagcgtacaggcatttcggatcttttcaaggtaagcatatcagcatttcaaagacactggggaagcagagagcctgagcagcgccgtccccgcccccatccctcctcctctcccctccctctctccgctgagttttcatatttatagtattttgcatgtcctgatgttgatgaaaatcaggatgtagagttaatattttagacgccaggagcttatagcatgctctccaatattaattgattgtattttattaatgttgtgttttcttcatccaaaagcagatttctcatctatgtggaaggcagaaagcagacaccaatactgaatgaatacttaaccgtaaaactgaaagaggattctagttcttcataaacggcacttaattccagctgggagcagaactagaaagttaatttttaaacatctacacttcattttcaagttaaccatttttgtgctgaagaaatattttcatgtgtaagaaagtagaccttattgtacatatagaaagttggaattatgctaagaatgaaaaagacttctctgtaaagatacggactacagttaaatgctagagaagctctttaaaaatgtgaatgtcaaatagagaaagaaccctgcatagaaagtgctgttttaactatctgatttttaaaaaatctgtgcatacatttaaattctaaacaatagcttatcagagtcagctcaaaatatatgagaaacagtattctctcatggttttagcttttgactttgctgtgtaaatagacataaggtgctttgatataaaatataaaatgtaactggaaaatagctcgaggtccttctgtcccaagctgagcagagccccatctttctgggtctatattagtcccacctactgacacaaacaaaagcttgctggaagatcgagttttagacgcatttttaaaaatcttaaagactaaaacacttccattttaacttgtaaagtaatttaattttttaaagattatactatatgcctctgtgtcttctctaaaagaatagatcaacttcagtccataaaagatatttttaatattaaagaaaaaatatgtttccttggtttctttttattttacaggagtaaaataaggaaggaacgttcatcactttaaactgaacctggcaagttaatttcctcaggaatggggatgtatttttttaagcattgcagatatcaaagttctattgtgctgaataaatgcccctttgttaaca

SEQ ID NO: 100 - DNA, 51637 bp, Homo sapiens
aactcctgactccgatagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcaggtaagggcctgtgggtgcccccggaattccgggaaggctgatgggcatccctcttcccagccacagaaccagagggagtccccaggtagatggttccaagaagggagttgaatcttgggttccacctcttgcctgtgacccacggggaccccagtttatgcctcactgttccttggtctgtcaagagagcctgaaatagcattaggttctcctgtccttctcagtccttgacaattaattctgggaagaatagtgtggcatgatatttgggatatttggatgttaacagggtcccgatgagcaggtttctcaagaaattatcttttattcttcaatgaatttccttttattctctgcactcccaccccccaactaagaagctatcaggaagctctttaagttcaggttaatttgctggagacatgagtactcatatatcaaacactgggagaatttaagatctcagaaaagtttagcttcaaggatgtatacactgcttttacgtcttaggaaataacacctaggaatttccttacaagtgcaactttacagaaatttttaaaaatatgcatactcacttttagaacattactacttctcataatcctatgtatatacatgatatgtatatgtatacgtgtttatatatgcaaattttaaatttcattccttgtttcaaatggattttctcgaagattttttttttttgacactgtctctgtcagccagactggagtgcagtggcgcgatattggcttactgcaaccttcgcctcccaggcttagcgatcctcccacctcagcctcctgagtagctgggactacaggcatacgccaccacacctggttaatttatttttttgtagagatggggtttttgccatgttgcccaagctggtcttgaactcctgggctcaagtgatccactcaccctggcctcccatactgctggtactacaggcatgaaccaccgtgcctggccaatatttttttttaaagaaataaaaaaccaccaacttctacctcaaaccactcttcctaattgagtgtgaattttctaataatgtcttccctttgcttactcaggaagacagataagaaagtttatagtgttttttgaaagtctataatggcaacaagtagaatgctaactggctgtagaaagaatttattaagaaatgaaacataatgatgcatttcaggagtctgcttgcttgtttaggggaagtgcccagtcatgctgggctgtgtactggcccagatgtaggagtgtctttaaagagggcattttatttacttattacatttttatttattttttttttactttttgagacagagtctcactctgttgcccaggctggagtgcagtggcgtgatctcagtccactgcaacctccacctcatgggctcaagtaattctcgtgcctcagactcctgagtagctaggtttacaggtgcgtgcaccaccacgaccagctaatttttgtatttttagtagagatggggtttcaccatattggtcaggctggtctcaaactcctgaccttgtggtccaccagccatggcctcccaaagtgctgggattacaggtgtgagccatcgcgcctgacctatgtgttttattttaataggttttggaggacaggtggtgtttggttacatgaataagttctttagtggtgatttgtaagattttggtgcacccatcacctgagcatgtatgctgtacccaatgcgttgtaagattttggtgcacccatcacctgagcatgtatgctgtacccagtgcgtagtctcttttccctcacccacctcgcaccctttcccctgagtcctcagagtccatcgtgccgttcttataaagagggcatacttttaggaaggtttttcaatgtgatttctacatccacagggtctttgctaactcagtctaagccaagaacaggaaaatcttgacaattaatcatgctctgcctctggaagacacatttcaagtaaactcgtgttatttctagctattggtgacttatccaagggtctgagtggtcttggagggagcaggggaactagagtcccataaggactccttcacgccattctcaacatctatccataccccatctgcccctcaacactataggaaatacaaaaatgagggagatatagtcctgacacttaagcaacttataacctggtgaggaggagaaaaacatagatataaatatagtaataccagtcagagtgtggtaagatctacggagcgttgggctatcagagaaggcttcatgaggatgacatgtaaagggagccccaagggaccagtaaatttccatcaatgagattccagggagagagaccccaatgagccaaaacacaggagtgccttagggagcagcaggtggtccaatgtgctcctgccctggacagggagggtggggatatggggaattcaaactggaaagttaggatgaggtaaaatgaatcatctaaggcattaggcatttttagtctgtatattgctgggccctgggatgtggtcagaaagagaattctcctagtgataacttcttaacttcacctagtaggcaataaagaactacaagaaaatttaaaactaccatttataaagtaacttctatgtgccagatatgtgtcctattgtaatcttcatagccactttgcagtatggatatcatgaacccctagatgaagcaagaacccaaaactcagactcgcacaggcagtgagagtgccagggtttgaacctggtctccctggattgttctgtttctgttcattgcaaacagggtcagcgctttatggagatgatactggcatagagtggagagagatcaggtgcacagagacaggtcatgaggctcttaaaatagtccaatcacaaggcaaatgaggacccagtggccaaagacaatgacaggggtcaagtttctggaatcaacaggaatttctaggcatcactccagggtaagaaaccatctcatcacagactttttctccaagaggaacctagtcttgaaacaaatcagactttttattcctcagggtaagagttctctaatgaaatcagactgtcaacagatgcaatttctagctgattcataagggcagattttcattctgaaaatttccaaagccaccatttaacatggcaagggtttatgaggacatattagtcaacttgagtgtttttagtctctatattactgggctctgggatgtggtcagaaagagaattctcctggtattaccaatatggcacgttattgaaggcacctttctcagaactgtggaaattctgagagcttgtatgtcccttgatcatctttctttcattctaggaattctgtgatcaaatctttatcctctagactcaaaaataattctttaaaaaaacagtgtggaaacccattgagataatgtgtttgtgtaattatccattcttgtaaagacaactgcccacaatggaatttcccatcttcacctttgtcagtcaaacacaaaatgtttaacccttcacatttaatctttcaacttcttgagatcccaaagtattattgctactgttacttcattcatcttcaagacatgtcttgaggctgtaagggctttcctaaacattgggagctcttcataagacagttgctactttccttaaaacagcatgccttaaataggcagtttgataaatcacctgtgcatatacttcattttagatgtgagaattgaaaaagaaaaaaattgacttcacaattctgcaccaaaagaatgagtttcacgaatgcgtcagttagaggtgctaatatagaacggttgctgagctctaaaactccactactccaccccactcccctgatagagaagtattcccagactggtttttgcctaaagccttgggtattctgaatacctctttgtgatttttttttctcttcctttttgagacagggtctcactctgtcactcaggctggagtgcagtggcgagatattggctcactgcaacctctgcctcccgggttcaagtgattctcctgcctcagcctccccaagtagctgggattacaggcacctgccaccacgcctggctaatttttgtatttttagtagagacggggtttcaccaagttggccaggctggtctcgaactcctgacctcaggtgatctgcccaccttggcctcccaaagcactgggattacaggcatgagccaccgcacccagtcctctttgtgacttttttgttggagtcattcttctgcgagctatggatatcatcaaggcaggcagtccctcaacgtggcagctgttcccacccttccctgctcctcttcttgcccaaggatgagcagaaactttacagaaaaagagagaattccctcaggaaatgaggcatgttgcttgaggtcacagggaatagaattagcaggaaaataaaccttgcaggaagcagaaagtgggccaaagcactgaggagaggacacggggagggcgtgagtttttgacagatttctctctgtaaaatgaggaggtcacccagggatcttgaaactcccttccagttccttcactctatgtcaaggattccagaaaggaaataaaataagctctgcttaaaaggcattttcaagctggggaactttgggatgaaaaagtttcccaaatgaagacatactggcacggtcagggttgagcgacttttgtgtatcaatgcacccaagcctgatgtctcattgtgggttatttccagctctgaagaagtactgcctggcagccagcatgacccactgcttctgtaattgctgcagttgcaggtgtcaacgcaaaaactccactcactcaattctcaaaatctatccaatatctctcatgccccttttcaatactataggaaatgtaaaaatgagcgacatagtcctgatccttaagagagtcataagttggtgaggaggagaaaggcatagatatagtcatggtaacacaagtcatatgtggtaagatctactgagcatggggctatcagagaaagcttcatgagggtgacatggaaagggagccctgagggactggtaaatttccatcagtgacattccagggagagaggccccaagacacaggggcagcaggtggtccactgtgctcctgccctggacagggagggcggggtcctctgctgtttgtttgcttgtgtaggaattttcccctcaaacaatgtccttgtctcccatgggagaagttttacatgagtgggaacctgtttctcttctctatcccaggccattccctgagagaagagaaaggggaatcttttttttttttggacagtttcgctctgtcgcccaggctagagcacagtggtgcaatctcaactcactgcaaccttcagctcctgggttcaagtgattctcctgcctctgtctcctgagtagctgggattacaggtgtgcaccaccatgcctggctccttttttgtaattttagtagagagggggtttttgctatgttgcgtaggctggtcttgaactccgagcctcaagccatccatctgcatgggccttccaaagtgctgggattacaggcatgagccactgtgcccagctgaaaagagaatcttaattcagttgattacttctaaaagttataagaccttcttcactgaaagagttcacatagaagctgaacttgaatccagccctcttaaatttcagttcaatattccctgcacatctgcacatctttacatgaattctcagtgatattccttcatccatccattcatgcatgaggattacagagatgaagaaagttccagctcttatcctcttgtgctcacagtttaacacgggagatgaaactgctgctgaatggctcccattctgaagtcagccaacagtgtttgccaatagcccccactgaataccccaccatattctcaagtaactcactcatttaggggaaaacaataatataattgtctctagaaattttaggtattctccactctaagattactcagtgttttgactgatctcaaggcgactccgtggtttgcttctgtcaaaaagaaaacacagttcccactgggaaatgtgtggagagtaatggttcaaaacgccagctgtacattagtgtatatccaggatgctttaaaaagtgatggccaacccctactgggaagtgaggagcccctctgcccggccagccgccccgtccgggagggaggtggggggagtcggcccccccgcccggccagccgccccgtccgggaggtggggggcgcctctgcccggccgcccctactgggaagtgaggagcccctctgcccggccaccaccccgtctgggaggtgtgcccaacagctcattgagagcgggccaggatgacaatggcggctttgtggaatggaaaggcgggaaaggtggggaaaagattgagaaatcggatggttgccgtgtctgtgtagagagaggtagacatgggagacttttcattttgttctgcactaagaaaaattcctctgccttgggatcctgttgatctgtgaccttacccccaaccctgtgctctctgaaacatgtgctgtgtccactcaggattaaatggattaagggcggtgaaaaaaaaaaaaaaaaaaaaaaaaaaaaaaaaaaagtgatggccaagactcataagatgaattaagcggactctctggggaacagaaccgaacatcacaataccttcccttccagttccttgaatacttccaaatcgcacttaggattgaaactcaccaaattagagagatggaataatgatttccatggttggtctgattcactaggaacaggtatgctcaagcagtacttctcaacctttaatgcatttagaaatcatccagggatcttgtcacggagcaaattctgactcgggaggtcaggggttaccgcctaagattctggtgcaaacaggttccacaggaggcctatgttgtgggtgcatgaaccccattttgagtaacaaggctatcaagtcagagaataaatacgcattgcttttacccacacagaacttgcgactgaaatgagaaaataggctgagtgtgatagctcatgcctgtaatacctgcactttgggaggccaaggcaggaggatcccatgagcccaggagttcaaaaccagcctgggcaacatagtgagactctgcctcttaaaaaaaaattagaaaaagggaaaaccaatctgggaaagatcaaatattgatcaaacattgcaaataatgccataaatgatcagaatagggagagtaacatgctacctggagaactagaaaaaaaattctcagagaaggtggccctgggacctcctggctctgaatggtggttctgaatatcaggagaggggctggagaatggtgttttctagtgatgctgctggagtcgtgtacatggaccgtgttccatgagtagtgagctgaccaattagagagatgaggggtttgccaggacaactacataatgagccatatttcaacatacatgaagttttgtgtgtgtgtgccaagcaaatgagtctcagattctcggacaaaaacgaatacttttgctcagacagacagcatgtgagtgcttctcccccagcttcaaccctgcagtgtctacaggtgtcattggtccccggtagacgtcctcggttcaatgggtcactgatcacttatcaccagcaccacatgaccctggatggcagccaaagagttcctgggtcttgtttccctacctccacatttttttcctgacccagcccgagccacgtgcacaccacagggctggagtcccagtgcttttgtcctgacagcccattctcccactcccacacccaaccagttccccggggggtttttgaccagcagctccgcctgcagccctcgacccggatccaggcatcctgcttaaggaggggttcaggtggcaggaaactccagggcaacaaagtgtgggtggcatgggtggggttgaccggaaggtcactgtgctgggaggaagaggaacgggtggagggaaggcaagatacggatcaggagtattgacatcctgtgccagtagaggggcctgccccatggtggaaggtgtggccggatgagctcgctggcccatgtccccccgtttcccaggctttttcctcccacgctgtatgcagtgcaagaacaagctggtgcaattggactagcagcaattgagtccttttacccaaaagaagaagaaagagcaatgtttcaaaagaataaaaaggaagctgcagccaggtgcagtggctcattcctgtaatcccagcactttggggggccaagaggggaggatccctggagcccaggagtttgagaccagcctgggcaacatagtgagaccccacctctattttttaaaatgataattaattttaaataaggaagtttgtgaaagccattggtttctttattctaaagagcgtggaaaataggacagtctccaacaggccctgatttcctttggtaagaaaatgagcaaagctatagactaggaaacatgactggttaaagccggcccatgcaccaactccgatactgatagttatgtttcctttcgttcttatttgcttcaagctttgttccagaaaacatttgaacactagctagaaccaccacagtgaatatccattgcctaaatgctatctttcaggtattatgttcagacatagtattactttggttaattctcaaaataaagtaggtcatatgattatccccattttctgcctggtgaactgtggttaaatgggcttacagagattaaatgggttgcctgatgtagcccaacgaggaaggggctaggataggaagcaggcgctctcattccagaacctgccttttttcctcctgtctaaactgctgctaaaggtcaaagacaaaggtgccatgtgagcagggaagttatttttgttttttacaaaggtgaagtaataggctgtgagtaatgcccactgctccttcagccccaggtacatgcagtgaggcggtacccacagagccgcgtggcactcctcaacctgctagagcagccggcctcctgcaggatggcttaaggaccacctggtccttggggtctgggttctccgggtcctgctgttccctgcagccttccttctacccccagagcagcttgggggcatctttagagaaagcggcagtgtcgcacctgccccagcagccacaaaacagaggaaattctgagcacctccgggcgtgagtcaccataccacattcaggaattgccacctctgcccacagaatcacccactcttttctgtttgggaccaaaatagatacctccttcagaagccgctgctttctgtactctcagcaataaaaaaacaaaggctaggataggtgtgtgcctctgaggcgtgagggggggcgcgttttctcccctgggaaggttttcagagagaagttgttgctacagcagtacaggcagctgatgggttgagggtacaggaggaagagggaaagtcagggagattggagacaacctcttgtgtggtaggacttccggctattggtttgttcattcctttgttcattcattcattcagcaaatgttcattgaggaactgctatgtgtcaggcacagggtttgagacacagagatgaataagagcccatccttgacctctgcacagacaattatgacacaggctaagtgctgagatacaagtttaaagaaggagtcgatggaacacacagatcgatgttcattacccctgcaaaacccagcacatctcacatcagggactgcctcattcacatcatgttagatgtgacagagaggacagcagagagcgttgttttgtcatcaactactaaaattattaaaaccaaacaccactaattttgaacttcaggtagacagaggatgtagagttttcctttgctcaagaaattcctttacagagaaaatgggaacatttcaagtgggagtatttcaattcctttaataacaacctgttttctagctcccacattccccaagtattctagaagcacctttcataatggacagctctgaccaactgccccacacacatgcatgtgaaccgttctccaatcctaaaagtctgtgacttctccaaggaaaggaggaaggaatcgtattagtccagtttacattattatatactttgtagcaaagcagcaatgtttccttaaaaaattctatatatatatatatatatatatatagctgggcatgatggctcacgtctgtaatcccagcactttgggaggctgaggcgggcagatcacctgaggtcaggagttcgagaacagctgaccaacatggtgaaaccccgtctctactaaaaatacaaaagttagccaggtgtggtggcacatgcctgtaatcccagctactcagggaggctgaggcaggagaatcccctgaacctggaggctgaggttgcagtgagccgagattgagccactgcactccagcctgggtgacagagggaaactccgtctcaaaaaaaaaaagaaaaaaaatatatatatatatatatatatatttgtgtgtattttctcctcatgaaatgagctccttgaagcaaatcggcccatcttttcagagaaagatcagtttattacgtcaccaagtaaagggcaaaggaatcatttctaaaagtttcgtttgaagtccccggagttaaagttgacgtcagcctcttcctgccctggtgccccgagagtttcccgggagttttggggatgacacccggctgcatgcgtgacatctcgctggctgggggcaggcctggtggcttccccgacaatgaaaccaggcagagcctgcaacccagctgagcaccagtgtggtctctgcttccggtccttgtggtagcacctctgtttacagcctgatttagaacaaaaagaacttttgtaaaggagaaaactccttatattaaatggaaagcaaaacaaacaattaccaaaaaaaaaaaaaagttggaggggtgtttcagaataaaagagccgtctctccagacatctgtctgacgcccaggtggcgctgagaccacagggtgagccttttggctggagatgttgatccctggtttactgcacttcgggctttcactacctttcacccaccggaccatcagtttcactttccctctcccagcgtctctcaagctctgcttctctggccccgttttcaatctagtgcaagaggacctgtagccagggcacccatcctcctcctcctcgtcctgcactgggatcccagctctgagcactcccgggccagggaggccttgctgcgtgctctgcttctgtgatcttacagattcctcatggccaccataggagatggggactgttagcactattcccccaccccaaccaccttttttttgagacagagtctcactctgttgcccagactggagtgcagtggtatgatctcggctcactgcaacctctgcctcccgggttcaagagattctcatgcctcagcctccccagtagctgggattacaggcatgccccatcgccatgcctgactaatttttgtatttttagtagagacaggttagtagagaccatgttggccaggctggtctcaaactcctgacctcaattgatccaccagtctcagcctcccaaagtgctgggattacaggcttgagccaccacgccctgccaccattcccattttacggatgaggaaactgagaccatgaggcagtaattcactctcccaagaaagcaaggagccagtagatctgagcagaacccatgcattcaggccgacacaggaagcaagctgtcaacaggcactgttcatctcctgggctgcctaggcaggccctgaagctctggttttcagtcaccctgttattcatccccaagttaatctcccctgaaagcacctgtcgtgatgccctttcggctgcaagagctccagtcatttccattgcctcaggggcactttgctacctcctctgcctggcacacaacatgctccccagccaagactgttccctcagcacatagcacgccttggccagcaggtctcctcctgtccttcaaagggaacctcctcatttgtgatttcaaagctggactcccaggaacaccctcctcccttactggaacaatcttccccatcttgtctgcctaccggaatttttcccaaccagaaaagcgtcttgagagaatggaaaagtcttatgaatttggaaagttgacagcttgaattcaaatcctagcttgaacttgtgaatttctactttcctttacgaaaacctttgcatgccattctgtgcaggcactagcaaggtggtgggagggagatggatacagtagggtgagtgccgtgtaaagaaaagggagcaaagtctgggactgcagagaaatgccacaaagcacagacagaagagtcccggaggcttcccagagaaagatgacagccaatgggagacctccagggaaagcaggagttaagaaggtagaaatgcattagggaagtgtggcatgagcatgatggtcaatttcaatgtgtccacttgcctgggctaagggatgcccagatagctggctaaacagtctctctgggggtgtctgtgagggtatttccaggagacactagcatttgaattgaatagactgggtaaatttcttgttggtagactgagtaaagaaaatcaccctcaccagtgtggtggggatcatccaaccatagaggaccagaatagaacaagaaggcagaggaaggttgcattctctctgttcaagctgggacatccgtcgtctgctcttggacatttgcactcctggttctccagcttttggactctgggacttacagcagggcccctctgctcctcaggccttcagtcttagactgagccacaccaccagctttcctagttatccagctccagctggcatattgtgggacttctcagcctccataattgagtgagccaactcccattataaatattctcttatttatctacatacatcctattggttttgtttctctagagaaattctgtttccctgaataatacaatgaccaaggcccaagacaaaacacatggtgagctccaagagccacgcagagtcccgcaaggcaggagagctcaggcacatagtggaagcagagattttgaagttgggcatgagctgtgtcttggagtctccccatgtcactgggcttaaactgtgtcctggaaggaacagaacatcccagaggggtctcagtcagggcatggcttgtactttggagagacagcattgggtttatgtgaagaatgaaggaagaagagaaagcactgggtttatgtgaagaatgaagggaagcagaaaggcaaacccatagggcattgagtaacctccatggaagtccatgagggtagggttttaacctcggtgggcctcagcttctgttcgtataaaatgggaataacacagaccctgctgggtgctgtaaggctacataagctagcctgcctagagtgaccagagcacacagtaggtgctcactaaatgtgacttgctgggcttctagtctgcatggccaaaggcccttccctcggacctttccgtgtggatgcctcacaggctgctcagtctacacatccagaactgtcctccctccctggaacctactctttctcctctctttgctatctcaatgaatggcaccccatcctccccatcgcccaggaaatctgggcaaaatcctcatttcttccttgctgtcctccatgcacctaataatccagcctcaatttttggcaattccaacttctaaaatctcttaacgccagcaacccctcttcttgcttacttatcaccacccacctcaggactcccatgacagccttcctgtgatgcatgacgggcacatgacaagggcagttgagggtcaggggccacgggagcaggatgcagccagcacatgagggaggataggcgggaggacaggcagacacttgtgcgtaagagcacgcacttgtcaggctgcctgggtccaagtcctagctccaccactgaggggctgtgtgtctctgggcaagtcactgggcctctctgtgccttagttcctgcctctagagaacggagatgagaagaacacatcacctcataattaattactgcataagtaataattttaattatattgactattatactctattagtgtatgatgtcttttattatatatatttatcatataatatactaattatattaatgagtatactatagtattttatataacataccctaattgcttattatatatctgtataattattttatcatataagataatttcataagctaagatggtattttatatatttcatttattatatatttatatttatatactttattgtatttgaattgtgatgtctaataaaataatagatacgttaattatccttcatattcataataagctccttcattggtgtctgggaagccgagaacatttgtgcgtgtgagctctcctgtgtgttcggcatgcagtgtgttgcgtctcagctgacgtgattgctgtttttggtggcccggaggcacagggtgcatgctacaggcaggaagagctttggagcaggctgactcctgagctctcctctggtgccgtggcttctgaggcccccaggtgacaaccagcctttgccattctagtgtttcctctatgttcatcccgcgttctgagtgtggcacaggccacactcctgaccccaccagcatcaggtgctgtgcacatggtatgaggtcgggatggagtgctgttggcatgggggttgttccttgggctacctgtgtccacatggtctgattaaccccttctgcacatcagcaagggttcagcacctcctcagggttagggcatgcgcagggcatgcagggatttgagggtccttggacaatgcatgttctccatgcaagcatgcagagacatggagagggtctttgtccctttcagtcctaacattctgtggcttcataactacttgtcccacacccgagtaaaaagcaggatcttctcagcactgtgctgaggaagtctttaaaccttccagtaggacatgggatccctgcctgcatcttaagttcccatgtccttaggaaacgtggccaccttggaattcagctctccaagaagcccagtgtgaatgcccattgcaggagcatctgagctcacccccactaaccctgaggtatctgttgaaaagaatagaacccacccactgaaactatcagagatcaaatgttgtgtgttgactaagaatttgtgttaaggcagggatagttgagcaccaatgctttcaaggaactctggagaaatgcaagcctgtatttcctctcagcatggctgcagaagagggccagggcagcagacaggcattttgacccactcacagatgaatacaaagactaaactcagcaaaagccttgaggttgcatttatgtgtctgagaacagtccctggagcacaggcatgggcttttggtaccacgtaacctacaaccgtaagctctctgctctatgctgtccactccatcaatcccacagtgcctgaaatgtcattgtcttacccgatgtctggggtagcatctgtgaacacacggatttgacacttttatgatgctgtttgtctctactgaacccttcttaagcaaaatcacagtagactagcagatcatggtagtatctgaaagcgccaggaccccagaacctcaatcagtgctccccacttcccatggttttctccctgtgtttccacatttggattgtcattgtctgtgaaaaggcatgatccctgtcaacaacacacagtgtatgcaatgtgtgtcttgtgtaaaacggagtgtgaattcttgagagcaggaaggaaaaggggtacaagaggttcccctgcgagatgggtgaggagcagggcagagtgagcctggctgctgggaacccctgaggagagctctggagagggttctggacacgtgggcttggtcagcctgacaattaggatttgtgttaacaggaccggccctcacctgacaccaactggactgaggttcccaggagaaactcttagcatcatgactttggaggttgccatcatttttgatgactttttctttttccttcttttctgtttccctcttgtcaagtttctacctgtaagttatacttacttattctgtgtttctttacagtctcaggggaaattccgttgagttgaaaatttcctcagctcctcgctccagtttctcagaagagtctctctccttgcagaaaagactgtgggtgggagtcaccaatttagcatatttctactaaaaatatgactccatcccaagaaattggttttaaagatttgaggaaaaactgcttttagatttcagagaaagaaaaagagtgtgtttctacttcccccttttaaatctgataacttttattttaatcaggttgacattctgtggtgagcttgtggttaactctttcatgcccggaagcctgttgtcgaccgagaagactcccaggattagaacataaccagcgcccaacatttcatttgcagaagcatctgaggtcccaaaatgtgatggtttagcggcagctgcttgtaggggtatttttggtttcctgcttcttttttcccttctaagtaaagacaaaataactagatccctccaccccaccaccccatcatttcgttgttgtttaacaagtgttgagtaaggcacagttgttctccaaaagggtcttaccctgtgagttactcattttagggttacggaaactctgactatttgacccagtcaaccaggcctcagaaactgtgggtcagataacaaataactcatggtgcttctgtgctaattactgcagagatgtgtccaagtgctcggagatctcctccttgaagccaaggtctcctccttgaaccacaccgccttcttctcctttcccgagggaatcaggcaacttttctttgatgacagcaacttccttaaatcccccaagccctgagacaggcactttacttctcccacatttccttcaacatttgtgcttgctgaatgaaacaaggaaggtgaatgtttgcttgaatgaaccaatcaatgggtaacagcaccagtgctaatgctaatacactcaactactcattcagaacctaccatggcccaaggcttgtgctctgctcttgggtgctgatccagcaaagagtgggtggagggggagtgggaggtgaagtccctataccaccacttatattttgcactgtcttattttttcctctggtcacatgcatacataaattttatatctctgtaattatgccatttaaaaatcttcctactgaggtagaagttgggactcaacccccgaggcagggctcagacatcggacaaaattgaggactagcaaaaacaggattggggcagaagcagctttccataagacatgctcatgagtgtgccatgtcagtttaccattgccatggcaacacccaggcgttcctgctcctttccatagcagtgaccggatgacccaaaagttactaccccttccctagaaatttctgcaaactgccccttaaactgcgtgtaattaaaagcagatataaatatgaatgcaaaactgccctgacctactactctctgcctatgtggtcgccctgctctacagaagcagtcacggagctgtagcacagccggaactataacattgccacttcaataaagctgttttcttttattctaccactggcttgcccctgaattccttcctgggcaaagccaagaacccttgcgggctaagccccacctcggggctcgcttgtcctgcatcactaccaccttctctaggaagatgctctaggcttaatcattgtgttgaattcagctgctgaggactgagaggtgatttggatgattgacttcataaataaaattgggagttagactttccccgctgtggacttgccactgagtttggggagaggggggtttctttctctgataaagttccacatccacagacagaaggaaaaggccctgaactaatcacttcctttggaagaagctttggtaaagaattaacatttgggaggttgtcaagaaaaacctatttgttctataaatatttaaaaattattaaaatttcaaccaatacagaaaaacacaaagattaatataaccaacatgtgcccatcatcaggattcagtaaatgtttacagtttaccttggttgtttcatgtcctttttgtttattttaaatacatgctcttgtcgtgcgtgatggctgatgcctgtaatcccagcaccttgggaggccgaggcaggtagatcacctgaggtcaggagttcaagactagcctggccaacatggtgaaaccccatttctactaaaaatacaaaaattagcctgatgtgatgcaggcgcttgtaatcccagcttcttggggggctgaggcaggagaatcacttaaaccttggaggcagaggttgcagtgagcccagatctcgccattgcactgcagcctgggtgacagagcaagactccatctcaaaaaaaaacaaaacaaacacaaacaaaaacaaataaatacatgctgtagatacagtggagctccctctcggtccaacccaatctcattcttcccctccagtaattgctctcttgaatctgggctgtatctcatgatgcaatatacactactggtttgttttttattttatacataaatgcataatatactgtttctatttgcaactttgcttttttcactcagcagtgtttctgagattcatttttgatgtttattctttttaacaactgtacattattacattgtataataatacagagttcttgataatgccaagtttattaatctaaccttcttttgatggacaattagattgtatctgatttttccctattacaagcaatgctctaataaacagccttgaatgtgtgcacatatgcaagaatttctctaggaatatacctagaagtgagatcactgatcctagaacatggacagcttcaattttactgctatatttaaaatgttctctttgaaatcgctatgctaatttataatcctcatcagcaatttatgaaatttcctgaattcctcacatattcctcatcatcacttaccatagggaaattttaacattttttgccaatctgataatataaaataaaatctcattactatcttaagtttcattgatacctggtgatattgagaatgcttccacatgtttttttggtcatctctgtggcctccttgttcatatcctttgtccctatttttattgggttgttggcctttaacttattgatttgtaagtcttccttatgtattacggatactgagtctttggataagtatagattcttggatcttctaagtagacgttattacttataaatgacaattttattttttgttatccacttcttattcctctaatttcttttgcttgttccattgcattagctggggtgttcaatacagtatagaataaaagcaggaattgtatatgtttccaccattaaatagaaggcttttaaggtatcacgtacatgttattttctgtaagctttcagtgtctactgtctattggttaaataagtttctttttatttctactaccttaaaagttttttttcttttaatcaataatggatattcttttcatcatcattagatgctcttcttcatctattaaaatgattgtgtaggttttcttcctttataccataaaagtatttaagtacattgagagattttctaacgttaaaccattcactattgctgggataaactctgactgatcagaattttttttttttttttttttgcttaatacattgctagcatcaggtgcaaatgtgttaacattctccagtttgactgtagaattaatttctttttgtaattcttcaccttatcaaccatatgtattgttgagtgtatacatgttcaagattatcataacttccagaataatttttatttgtgaaaatgcctttttgatctagtttctcttatgttattgtagctatggagctttcttatatctggctaccttatcaacaatatgtattgttgagtgtttacagggtcaagattattataacttccacagtgatatttatctgtgaaaatacttttttggtctagtttctcctgttactaaagctatcgagctttcttttggttgctaaatatctgcatataatgtgttttccagccctttagttcaaccttcacatgtcactgtattttaaagacgtctcttgacataacaaaaatagaccttgtgcaggactttgggggaaatttttccccctcaatcagaatacctctgtcttttacaagcaagcttaattgatttatatttattgtactacatttggacttatttatgctattttactttgaacttttattaaccattatttttcttttactgttgtatttatcttttcttgtcttctgttaaattgattgagtttcctttattttctcttttccttctactggtttgtgtattatatgttttaattctacttttagaattaagtcaccattggccgggcgcagtggctcccccctgtaatcccagcattttgggaggccgaggcgggtggatcacgaggtcaggagattgagaccatcctggctaacacagtgaaaccccgtctctactaaaaatacaaaaaaattagctgggcgtgatcgtgggcgcctgcagtcccagctactcgggagactgaggcagaatggcctgaacccgagaggcggagcttgcagtgagccaagattgcaccactgcactccagcctgggagacaaagcgagactccgtctcaaaaaaaaaaaaaaaaaaagaattaactcaccctttaagttctcaaagtactcgtgatgttaaaagtccacagttaattaacatctctcccagttccaggatcttctgttcagaacttagcacatttctggcaactaaggattgacaactgttaaaaaatatcatttcccattatatttttggattggttgttgctgatatataaaaaatgttgaattttataaatgaattttctatctggccaccttatgaaactcttaatagttctaatactttaaccgtcttgggttttctaagtacttaattaaattcctcacatagaatgattatttttatcttctctttttccaacaattgtatgccttatctatgttaccagttttatcagatcactaataacgagggttcttttaaagtcaattggagtgagaaaaacccaaagatgccattaagtccttgagtgtctttggggaagaaaaggtaggtttaggaaaagagagacaaaaggcaaagtgaacaactaagacaataccatgtattgcaaatttaggtgtgatttaatgatggctaagaaaaaattctaaattatatataaaagtgtattcgtatataaggtagtttaaataaataacaggtaatgtgggcaggcaacaaccatcaaaaatgactggaaatattcaaattcaaccatggtgatttggttggcagcaatcagagaattgactatgcttcagtagattgaaatccgttataatctattaatgtgaatacaggtgacaggaaacaaccgaatacagcattctcataaatagttcttagaatatgaattcaaaagaaactctatttcctcgttgtgacacaatcaagctttaagcaatgaacgctttaattattgtttttcagcttagaaagtaactatatattttatcattgggttctaaaaacaacaccgctcaagaggtcattgtagcaacaatcaaaatttgtggagcattttacagatttcaatgtcacttatgttatttcaactgatcctcatatttccatccttcataccctcacgattcatgcttcagcaaaacattctacctgtagtctcttgtatcttccatatgatgatgctgttttacacttttacacattctctgccagaatggcctgacgtgcctaaccttccagttgaactcccacccacctttcaggcaccttatagttaagagcagccttcattctgttgcctggctcatgggcaggggcaggattcccagcaaggggtactatgtcaagaggcctaaaaggacatatcagcatggtaaaaggaaatggcttggggtgtatgagaagctcctatggttacatgattgggaggaattcttttcatttcgtgttacagacggagcatctgaaatgagaagggaccacagtgagccagtgagtgaaagaggaggaagattctgacacccagagctttaccttcaacatttccttctgtttattccttatctagacttccattttcctaccccatagatacccactctttgcccctaacttgccttcaactcctctactgccttgtaaatgtcccatgtgtgcttgaaaaaagagtgggctctgctattgttggaatcaaatttgttaattgtggttatcacatttgattgttcttactgattttctgtctgtcctatccatcataaaggaagacactgttaaaatttctcattatgatagtagatttctaaatttatccttgttttgtcaatatttgctttgtgtattttgaagttatgttattgggtgcatagaagtacgtaagtgttatgttttcctgattcttgatttgtatattttgaagtgatgtttttgagtgcatacacatatagcatttttatgttttcctggtgaattgaatctttagcaatacgtactgacttctgtatttctattaatgcttctgccttgaagtctgatgttaatataactccttggattcaattgtccattcttttagtttcaaacttttggagcatttatgctttaagcatgtctcttataaacatcatataactgcatatttttaaaaatatatgcagtccaacattctgtaactgcagggttaatctatccacattgataattattactgatatagtttgatgaatttccactgtcttattttgttctttattttttaccttctctttctatgcatttcccccttcttttgatttaagtaagtttttatcctattttattttcttccaatagcttgtaagttattcactttactctgtcattttagatgtaatttttaacatcttaacatgaatccagactttacaaagcctagatttaaccaatatcatagccttcctctcaaataataaataaccttagaacaaattgcctccacaaaccttttctacacagttccctcctcttcctccttgcttctttgtgcgcatttatgtttgctatttgaaagaatttcctgaaagtaaaagtgagattttttagaaggctgacatgagggcagcaatagtagactttcacgtgactcctgtcccaccaccttgagctgtgtggtttagccaacttacttaatctctctgaacctcaatctcttgctttctaaagtggggatgacagtatctaccttccagagccatggtgagcattgaaggtaatatatgcaaagaagcagcacataggcagggctcagacatcatagttattattatatagataaccccaaatggagggcctgggccctctgacttcttcaaagataataatctgaactaaaccacaacatcacacaaacacctcccagcacccagatagtttagacatagctccacctctttgtaagagataaccttcaacagataggtgaaaagcacgctccttcctgaagattatgattctgggtgttggaaaagcactgaactaggagtcagggaacctggtgatctgttgtaatccaaggcttgccacaaacttgtggaatgaccacaggcccagtgttcttatctataaaatgtagaggttggcctaaatgatctttgagctctcttctagttctcatattctatgataccattaaaagggatgttctacatcccttttgcacccaaaccacttactttctatacggcctaaacttctggtttgggtttcccaaggaagcgagagacaaccttcaatattaggcatatctttggagttcttattaaacagtaaacctcacctcactatcaaagatagcctctggctccagcgtcctctttccagtctcccacagagatttcctctgggagtcaacgagcttaaggtgaaatttggctaggggtctgggaggaattcttttcatttcatattacagacagagcatttgaaatgagaaggggccacaggggggcagtgagcggaacaagaggaagattcgggtctctgacacccagaatctatctgattctgacacagaagatgaaccgcgttagagcaagaaccagatccctctttacccagtggcccaagctcttgatgcgtacctgtgtcccttgtaaagctcagtgaaatcatcacctagacatttcctgtgctccgtgcgttattctaatcttcactgggtacaagtagagcttaaagttctgatatatggacaggaaagagaagagggatgaagcctttatccagggctggctgggctaagagtaaaacaacttcacctggattcacccaaggggcaaagaatcttatctcagactcggtccacatctttatcagcccccttttccctttatctttcatgttgctcacatgggctccaggggccagatgagttttctcttactttgaacatcagagaaaaaaaataacgacaaaaagttactcaaccgacaaacgtttctcacccacacacctttcctccagtcaatgacgtttccactgcaccctgttagacgctgagtgaggaagcatctgggcacaaaccgctgtggatgcagattgagcagcactcactgtgcactggagggatgggagtcctgtcctcacccagggggcagatggagagggggcagagagagcagccggggcttcactccctggaaactctcatactccaagtgcggcctggggctctgcagccccagcatcatgtaggagcttgttagaaatagcctcaatgtccacacctgccctgacaaatcccagtctgcaagatcccgggggctctgcacacacgctgctgcgaacaacctcagcatccgtcctgccggctctagagcagccaaccgggatatccttcttcttcagcagtggtgtccgctctctaaaatgactgtcccccacatctctttccagggttggtatttctggttaactcaagggacacaaaaatagctcagggaaaaattaattttcattctactccaattctaataatgaagtggtaaaaattaaagggacagctttcagattatgggagtgcagctgcgggtatgtggcaaaatcgaagaaagagggctcataattccacgtcagggaagagccgctggcctgcccaggctgctgtttatctttactgtgaatggggcctcttttttgtttgtttgttttgttttgttttcacttaacctcagtggcaagaaaaatggggcctcttgccaggaggagcagagagtgacgcggaaggcaaagaccacctcatttcaccaagttcctcgtcttttatttgaaatccaagacatagaagctgcacatttgtccttctgggaagagtgacgagtgactgagagtggagtcgaacactcgaaaggagagagcaggtgcctgggagtcagaaaagctggcttgaattcctaaatctgtcgccgtttgtcctgggtgaggtcattctggtcatctgtggcaggaggactacaaatgcctggcttttccctttctagcgggcacacaaagagacagagaagttgaatctttagcaatccattgaaggggaaaccccacaatgcaaagagaagcattgtcgagggcccttcacctgcaccctctgttctcccagacctgttccatgatgcattccagaggaggtggctctccgtcactgtcacttgcgattgccaaggcgtcagccagacaaggcaaaagctcccaagggatgttacccttcagctgcatacagaactcctagaggcaacaaatccacaaggaaagatacacccatgatcgtgtatttcagccacaatgatggaggtgaggtggaaaaggacgaggaacaagtgggattctgcccatgtctgtctaatgagcatccacagcaaactccaacggaagatgtgaaacacgctcaacactagaagaactcggtttgactctgtcttggtgtgggtcccaggccaaagccctcggcattttcaggattaatgatcactgctggctgtctctttttccctctgcccacataaaaggcacaaaaactaaagaggaaggccacatcaccgcagagcccgtggttcaggattctcctcctgggagccccgatttcttttcttttctcaccttaacagtgtccagagtacttttattgccagaatagagatatagcctgctcagagcctcatgtgcggcccaccactcaggaacaaagggagagacagatactaagcatgtgtgcaacagagaaaatccagcccacgaaaccgtgtgcaagagcagctccgtcctgcctgaatgtggctttgggaagcccacctagaacttggcctggcgccagtcacccactcagagcctactgccatgaaggcaggccctcactctccatccctgcccacacagggagacccagggcaaacagaaagtcccctagcgggggcccaaggaacccctggctctctcagggtcccattcaagtttctgggctagtcttgcagactaaataccactcagttgcctggtgggagtaggtgctgggcagggtggacaggagccccactgcttctcagccctgtgccaacccctttgtgtgagaccctagtgcagggtggggagccccaatttctaagccttgagtgtttaccaccctacacccccacctccaactcccgaattgatcatctcaaattttcccacagtccataggcaccagacacttcaaataatctcagaaaagaaggtgatgtctacatccagaatcgtgccaatactttaaaattacagggagaaaaatattccccttcccctcttctaaggaaaattctgtctgcctcccaagctcccaggtcccttggtgtgagctgggggagtgcgtagagctaggaattggaaaatattccgggagagaatgatttatgttgagaagacccattgggagaagcaggaagtgggtctggaaagacaggaggaagtgtaaaggcagagaaaagcccttgttagctgaattttgagaagtaatttttggcattgttagtgagtaaaactagagaatgaggacagttgtatgctgtcttaaaaaataaaagaatgataatatagggaaagatgatttcaacattttggagtcatataagtggaatcctcctgttattactgtgcaagacttttagacaaattattttttattctttttttggatgttgttctgttgctgcttttataacactacactgagaagggctaaaaaaaaaatcccaaatttattcctattagattgaaaaagagcaaccctccagcgtacctttccacacactcttctacctcctgctgccttcaggtgatgtttggcacttcctgacaaggcctttcagggaaaaggattatagccaagctctttagtggttactgagctacagacctggaggtgtcaagatcctaaattccaggaaagattctttatgaaaggaaagtctgtgagaataagaagttctggaacttccccttgtccccgcatgacctcttcagacactcgggctaatttatgatgactctgaaaatgcccatgacctcatctagaaaaacgcactctcatggaattcaagagtttctaagggcacaaaatagcttccaagacaatttgtttccttcttttcaaattgatgtgtttagaaatgttcttggcttgtgattgacatctcagattccaaaaacatctgaggtcaatcctggttatttgtgctaatgaataattacaaaagagtagctaaatatgcttctcgctcattttgttgagctaaaattacttataaagaaatgcatagatctgcggcatacaatttgatgagttttgacaaatgtgtacagctgcaaaaacgttttcatcacttctgccttctggtcaatacccacctaccacaagaaaccactgtctgctttctatctctggatataacttttgtctttttgtgaacttcatataaatgaaagcaaagtgtatgcactatttcgtgtttagcttattttgttcaacataacatttttgagatttatcaatattgcctgtatcaatagttcattattttttatttttgaatggtttctatagtatgactatatcataagctacttgtctgttctcccaatgatggatgtttgaattattgagttggttattattaataaagctactatgtactagaatggaaggggcttaataaaagaaagaagttactataaatattttataaaagtctttctgtagacacatcccttcattcctcttagataaatacctagaagtagaattgctgaattgtagggcaggtatatatttaacgtcaataaaaatactttctttttttgttttttttttgttgttgtttgtttgtttctttgtttgtttttgagacagagtctcactctgttgcccaggctggagggcagtggcgtgatctcagctcactgcaacctctgcctccttagtagagaaagggtttcgccatgttgaccgggctggtctcaaactcctgacttaaaatgatccacctgtctcagcctcctaaagtgctgagattacaggcgtgagccaccatgcctggccaaatactttcagatagtgttccaaagtaattacattacttacactgccaccagtaacataagagagttctggtagttctacttcctccccagtatttgacgtatcagtcttttatccatttcctccatttccccaatgggctatctcatcattgttttcaacttgcattttattgatatctgatgttaaatacactttcaagtgtttattgatagtcgtgtatcttctttggggaagtgattgttcaagtctttgcccatttattgggctgtttgccttttactcttgctttgtttttctttatatattctggacacaagtatttgtgacaaatatatatattgcaaatattttctctcagtctatcatttactttttcatttttttcttttttttttttttgagatggagtctcgctctgtcacccaggctggagtgcagtgacgcgatctgggctcactgcaagctccacctcccaagttcacgccattctcctgcctcagcctccccagcaggtgggactacaggcgcacaccaccacacccggctaatttttttgtatttttagtagagacagggtttcaccgtgttagccaggatggtctccatctcctgaccttgtgatctgcccgccccggcctcccaaagtgctgggattacaggcgtgagccaccacaccctgcctactttttcattttcttaatgtctctggatgagtagacattctcaatttttttcttttatagtcagtgcttttgcatcctctatgagcaatctttgcctatctccaacttgcaaagtcatttgccttaattttcttctgaaatctttttagttttgccttttatggttacatctataagatatagacctagtacatagatctttatctttatatatataataaaattaattcttgcataagatgtgagtttttttctcatacatttatccatttgctccagaagcatttgtcgaaaagatttttcctttctcattgaatttccttggcacatttatttgtttaaaaaaaaagcagttgaacaaacatgagttgagtccatttcaggactttctgctctgtttcattactgtttgtccttatgctaatactacgctgccttgatttccatagttttatagaaagcctgaatatcagatgtcatgaatcctccaaatgtatacatctttacgattgtcttagatattctaggtcttttgtgtttctaaggagcttttagaaataacttccaaatttgtactaaaaaattgtgttggatttttaaactgtagttgccttgaattaattgatcaatttaaggtgaatagattttttaaatgaatgttacaatctataaagatagtatatttttccatttgcttaattcttttaaaatatgtctcagcaatatttcagagttttcagtttagtggtattacaagtttttggtaggcttatttacaaacattttatgttttttgatgtaattgtaaatacaattgtttttaaatttttaattttctaattggttgtgtcagtatatagaactaactacaagtgatatatatatacatatatatacatatatatatatatatacatatatatatatatatatatatatatatatatatatatgtatatatatatactgaaattgctaacttgctaaattctggtagccattttgcagatccctcagtaattttatgtaaacaatcatgttatctgagaataatgttccttatcttgaaatctacttcctgatattaatataaccataccagcttccttatgcttatctttgtagattatatctttttctatcctgttttctcaacccatcatttttattgtatttaaagtgtgttctcttgaagacagcatatagttgggccctgctgtttaatccagtctgaaagtttctatctcttaaagtatggatttttgtccatttatatttaatgtaattactgatagggttggcttcaagtctaccttcttgctatctgtttcttagctgttccttttctatttttattactctattcttccttttctctcttcagtttggctaaccaaacaaatttaatattctttttagctacactctttgtggtattatttggtggtttctctaggctattcagcatgaatccttaacttatcactatctacttacttaatattgtaccattttctatatgatataaaaacctaaaacagtacaattccattctccctaacttttatactaggactgctgtatattttacatttacatgttcaacagaacccaccataccatattattatttttgttttaaacagttgtctttcaaagatgttaaaaacaaaaagtggccttttcacttatctaaatatttacgtgttctttattacttcatgtcgatttatgtttctagctagtgtaatttctcttttgcttgaaaatttttctttagtgtaatgcagatgtgccataataaattctctaagctttcttttatctgaaaatatactaaattcaccctcatttttagaggatattgtctctaggtagatttcaaggttgacgggtttttttcttttaaaactttgaatatgttgtgccattattttctgcttctattgtttctgttgagaagtcagttgttattcatcatcgttccgctgtaggtacgtgtcctttccctctggccacttttaagattttctcattatctttggttttcagcagtttagctacgatgtatatagatgggcttttctttatacgtatcttgcttggtgccgtgaacatctggatctgtaaatcagtatctgtcatcaaatttcaaaaatttttggccattatttcttcatatattttttctgctccattctttctcttctctatcattgggaattcaattaaatgtaggttaggctatttaatattgtcttacagcatgccaaaggtccattctttttcagatttcttgtgttcatcagtttggataatttctattgatttgccttcaagccccggctaggctcatttcagatattgtaacttttagttttaattttttatgtttaaaaatattggctgggcacggtggctcacacctgtaatcccagcactttgggaggccaaggcaggtggatcatctgaggtcaggaattcgagaccagcctggtcaacatggtgaaaccccatctctactaaaaatacaaaaattagccatgtatgatggcatgtgcccgtaatccaagctatttgggaggctgaggcagaagaatcacttgaatctgggaggcagaggtttcagtgagccaagattgtgccactgcactccagcctgggcaacagagcaagactccatctcaaaaaaaaaaattacaagttttcatttatctactgagatatcctgttgtttcactcattataaccattttttctttaaattagcagttggcaattttttttctgaaagggccagagagtaaatattttaggctacctggcgatgttactccactgcaactactcaactctgccattatagcagaaaagcagccatagacaaaatgtaaataaatgggtgtgtctttcttccaataaaactttatttataaaaataaaccactgaacacagtgtctcactcctgtaatcctagcactttgggaggccgaggcaggtggatcacctgaggtcaggagttcgagaccagcctggcaaacgtggtgaaacctcatctctactaaaaacacaaaaagtagccagacgtgttggcgcacacctataatcccagctacttgggaggctgaggcaggagaatcgcttgaacccggggggcagaggttgcagtgagtcaagattgcaccattgcactccagcctgggcaacaagagcgaaactctgtctcaaaaataaataaataaataaataaataaataaataaataaataaataaataaaataaatggcagcaaatctgcaggtcatagtttactgacctctgctttaagtcattgagtgtaattacaactgttttaaattccttttgtgctaattccaaaatctaggtcattttaggggtcttttttttttttttttgagacagactctcactcactctgtaacccaggctggggtgctcggctgactgcaacctccacctcccaggctcaagcaattctcctgcctcagcctcccaagtacctgggactacagacatgcgctgccacactcggctgatcttttgtatttttagtatagatgggatgtcaccatgctggccaggctggtctggaactcctgacctcagatgatccgcctgccttgtcgccccaaagtgctgggattacaggcatgagccaccacacccaattttacgggtctgtttctattgagcacttttttgagtaggtcaagtatgtcacattttcctgtttcttcacatgtctagattttcttttaatttgctggatattatgagctatacattataaagggtctagattatcttatggtcctttaaaaggtaatgcattttgctctgccaggcagttaaatgactagcgcatcctcttgtctattaggcttggttttaatctttgtaagggcaggtctattttggttttgaaattcatcctagggatgcctctttctctaaagcaggattggaaaactacaacccacagctcagacacctgtttttataaataaaacttagcataactcttcttctctcagccctcacaatggacaatcagggctaagtttcactgagttctgccctgttcaggttcagaccagctcttggctaagaacctgaggtggacccctatacataattttggggcgaccttcatgcagtgtcctctccagagccccaccccacaaatcccagtcatgtcacgtcaatgaaaccactctgcttgggttccacctgggtgctgccgggaaggaaagcaccccaggaaggaagccagggcaactgtgggcgcctctcacgtgtttccctcctccaaaatcatgtagccctgagctgcctgttgttcagcacctgaaagcacttgctgtatacatttggactggttttacagctgtttcagcagaaacgtaagttttggtcccagttactctgtgatggctggaagcagaagtcttcactggtttttctgattattatccatgtcttgctttagtaacagatttatcttctgatacttaaaatattggttggtgttgatccataataagtgccaacaaatggtaccagtgatatgagaagtacagagagacaaacttttgcaggagttaaaggttaaggtaaacttcagtccagtctctatctgaattaccattctcttcttctggacagtgagaaaaaggaaaggaacagaactaccatctattccatacctgttattttccaggctttcttcaagttaccttagtatattatttgctataatcattaaatcaataaaataataattattacagcacgaagctgagccttagagaagtaaaataataaaactatgtagcttgtaagctgctggagctagaagttagaaacccatctttctccttcccaccatgctgctgctcttgccttatcatgagattaccagcatttattgagcacttatgttgcctgttccactgtaatttctggcccatggagcccatttaaattgcttttgcttagtcccttgttggttagagatgggccaagctgtctgatttctccctatcttcgtttttttttttgagacagagtcttgctgggtttcccaggctggagtgcagtggcgtgatctcggcccactgcaacctctgcctcctgggttcaagtgattctcctgcctcagcctcccaagtaactgggaccacaggcacatgccaccacgcccggctaatttttttgtatttttagtagagactgtggttttcaccatgctggccaggctggttttgaactgctgacctcatgtgatctacccgccttggcctcccaaagtgctggaattacaggcatgagccattgcacccagcctccctaccttcagttcttaggggagacaggagagtcctgagccattggatggggatggtcttccggaggacaaggtgctgggcagagtctaagggcacagagaagcttcacttaacctgaatgaccaatacacaaccggccaacccacagccataagtacagccagcagccctgatcagcctccgtgtgggcttccattgacggagaggccacagactcctgctttcctgcctcttcctgtccctgtcatctccccgtccacttcctttatccagcatgtgatatttccccccaaaatctaatctcttagagcagagaacttgttgcaaagtaggcaatggaattatttttctgattagacctgtgccacttttccttttaatagtttgatgtttgaccactgcttctggtgcctttagtgagataccagagtccatttttcaggctgagggaggctaaggtcttcataatataagaaggtatttggtgaactcagaggtgggcaggtgggtgagaaatacacatttcctatttgccagacattgagtgaagcactttctgtatatttctcaaaaaatggcgcacagtcattaattatagaaagtctaacaactcgtatatccttaaaagtatcttgcacagacatattttgcccctcaattaaatgtacgtaactttgcttcttcctttcttcacattccttgaccctcctctctccatacttgcttgacatgaggcatattcggaataaaaccttgttaatttctactcatctagtttgaaatacattgtgctttggagaggagcttggttgtagttaatttttgagccagctctgatacaaagctttctaaagaacaatggtagcagccttagttgctttctcacaaaaagtagggcataccatcttttaaataaagtgaagaaatatgtgattaagtcattataggattaaatatgtgagtacttgcctggggcctcttgagttcctaataggcttcttttgctttgcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctggtaagtgtcccttctgtgactaccaagaacaaaagaactgcagcaaagagtgagacagagcccagcttttgttcactcagccctatagacacaaatgggccagtccagtctacaggataactaattttagtggttcctgaaaagtcattcactaaacacaattttttttttttttggagacagactctcactctgttgcctaggctggagtgcaatggcacgcgatctcggctcactgcaacttccgcctcctggcttcaagtgattctcctgcctcagcctcctgagtagctgggattacaggcaccctccaccatgcctggctaatttttgcatttttagtagagatggggtttcaccatgttggccaggctggtctcaaactcctgaccttgagtaatctgcccatctcagccacccaaaatgctgggattacaggcatgagtcacagtgcccggccacacaattttatttttatttttgagacagtctcgctctgttgcccaggctggggtgcggtggtacaatctcagatcactgcaacctccacctcctgggttcaagtgaatcttgtgccacagctgcccaagtagctgggactacaggtgtgcaccaccatgcctggctaatttttttatttttagcaaagatggggtttcgccatgttggccaggctggtctcgaactcctggcctcaagtgattctcctgcctgggccttataggcgcacaccaccatgcctggctaatattttgtattttttgttagtgatggggtttccccatgttgtccaggctggtcttaaactcctgggctcaagcagtcctcctgcctcagcctcccaatgtgctggaattataggtgtgagccaccacacctgacctagacaccctcttttatcctgagctggaatactgatcacccccctcactggggcactcagactcaactcctttgccaaactcttcacaatagagagggctgttctagaagtttccttgtcattgtgttaagatggcgtctctaacttcaagcattctgaacagccttagggagcaaaggatcagtgtgttgtggagtgagaccactcctgctgctgtcaaacaacacagagacaattgacagcaagcaaggagtcccttttggtgagagacacacacatgcacacataacatacatgacatacacagacacgtaacatacatggcatacacagacacgtaacatacatgacatgcacagacacgtatacacacgctcaaaaacatgtcgtgggcattgccatatgcacttgaatacccagaggccggtgctgggagggcatactctggtttcgtatttgtaagctcagcagccagacaccaccagacacatcgtgggccctggacaggtgtgcttctcaagtgaatgaatacatgaacagtgttttctatgaagcatttgtgaaattatctgcatcattccatctatattttctagccactcggaacacaacgaaacaagtgacacctcaacctgaagaacagaaagaaaggaaaaccacagaaatgcaaagtccaatgcagccagtggaccaagcgagccttccaggtgagagatgaatctgtcctccagctaactcctgctagcgcacccttctcctgcaggcagatgatgtgtacccaaaggaagaaggtctgccctgccttctataaacacatgcatgtggctccgtcctcccaagacatcattgcagacaagaattagtgcagagttgctcagaggctgtttgctcagcaactaaagccaatctgacggcagccaatccaggtctgggcttactccctggtttggtaactggccaaatagaattcaacccaaattcaactcaacttaaaagcgtctgttgggtctgtgtgccaggccctgctgatagaagacacaaacaagagtgtgacaacgatccctgccctcaaggaaacgctctgcgtcttccccttaagcacaagacaacgcaccgcaaaaaaattacttgcttcccagtatttcttccagggcaaggttgtaaaatgtgcatgccacacttgtgagtctcaaaagctccagatgcgtgtgtcctggccagcagtctgtgcatgagtgggcactgtggctgtcccttgtctgccctctgctttcccacgactgaattgggattcagttatggtgtcaagaaaatgggctgggcgcagtggctcacgcctgtaatcccagcactgtgggagtctgaggcaggcagatcacttgaggtcaggagttcgagaccagcctggccaacatggtgaaaccttgtctctacaatcatacaaaaattaagctgggcatggtggtggatgcctgtagtcccagctactcaggaggccaaggcatgagaattgcttgaaatcaggaggtggaggttgcagtgagcagagattgcatcactgcactccagcctgagtgacagaggaagactctgtcccccctcaaaaaaacaaaacaaaaaagaaaaaaaacccacagaacctgctaggaagaattgagctttctaaggtcaggctagccttaggagacttcagagccctttgctgattttacaaccttacaaagaactgtatcagataccatcccatttgagcctggctatacaatgagtcaggaccaggaagggttacttcaacttactgaagaaactgagatgcacaaaagataaaaagatttggttaagctcacatagtagggctggaatcagacctcaggtctcccagattagatgaggaaactttctgctgattacttattttaaaagagtttgaatttacttacagcttccattattttattttttaaaacagactaatctaggggcacagttgcaacatgatgctcttactccttccccttccgactttgtcctggaatggtgtttccaagcacatttgtttgttttgttctacttcccccatatcaccctgcacagttattggaaggcttcaaagaggccaatgcttgttgtcctttctcgaaggctggctctgcctgagggatgtttcaaagattgtctcagtttgggtgttttcattggaaagaagcaaacccaattcaaacatgttcagacagttacgaattgtactggctgtcaaacaaccttttatcctgagaccaaaacacaagttcagtcgtgatgttcaaggtgccacatggcaggagccagcctgggacagggccacccagcttcctgctggggaagaggctctggaggatatttacagaggctctgttgggtatgcagggttggggagagtctggaagttcagagcacgtgcgcagtttcacaggctggggttagagggcacatacaattccatatgtccaggttgggggctgtgggtggggaattcagagatttaatcagaacaagacatggtctcaggccacaggtccgtcaggcctgggatgtagttgggtgagtggaaagttctggggatgggaaattttgagacgtcttgaaagggcgcatgtgtgtcaaccttcaggtgtggcttgatcagagatggtgctccatttctctgaggttccctcagcccgtccctcctcctggctttggtgttgtccccaatccttccgacatcatcccaagatgcccagccgctgcccccaagaatgcacttcctcacttgtccagcagaaatccaaggtggtcttcatgctccattggcccaaataggcttgagcctacccttgtgtctcagctgagactgccccgcccactcctgtccactgtcaacacctgcactgtcttccaagaggcagttgtggcgttcctgtctcggggccgcaccaaccagaatgaatcgctcattcctctgtgttcccattgccaacgtctgctatccttcacatgcctttcttacccaatccactgtccaccccttgcaggagtgacagggtcttcgtgccttcctacagggcctagcaaacttccccacgctcagacgttctcaacatatattggttgaatgaaaggatgagcaagcagtcaagagagtaagaaccaaggtccagtccctagcaagaggcaacctggactcactcgcggtgctgtccccaacttgccttcagagcattccttccatcttccaggtcactgcagggaacctccaccatgggaaaatgaagccacagagagaatttatcatttcgtggtggggcagatggtttattatcagtgcgtccagggatacagggctctacacagaggtcctgctgagagcgtctgcaaaatgacccacgggaagacaaggtggacccagccccagctcatatgcacaggtgaaatggagaccagtcagtttccaggtagggtggctcccttctggggtccacaatgttgctttgctccatcaggctgaccagagtggaatccctgaccactcctgctggacaagagtggtccttggacaagacccttgatctccctgggcttccattttttctcattctgagaaaaaaaaaaaaatttaaatagaccagatcagatggactctaagggctccttcaatgaaggtccccctgtgccctgagtggggagaaaggttggagacagaagagaaggaaagccctctcctaagcaccctagatgctgcctcgtagttggtcctaagtccactacttctctaagccaccaaggcctcctctggctccaagggcaagtccagtttcccactcacacatttttcctcttactggtgatcgtgtaaatgcatgatctgaacagccctccacggtcagcatgttccttccccttgtgccattccccagctgagcttgtaaaaataaacataaaatgtgcagagtcgggacttactcagtgcacatgcgcgcacacacacacacacacacacatactcatgcaaatgctcagcccaccgatgtcgaggtctcctgctgtcttccttctgaaatcttattagtatcacgacaatcaaaagtgacttacatgcaggctgggcacagtggctcacacctgtaatcccagcactctgggaggccaaggcgggcagatcactttaggtcaggagttcgagaccagcctggccaacatggtgaaaccccgtctctactaaaaatacaaaaattatctgggcgtggtggtgggtgcctgtaatcccagctacttgggaggctgaggcaggagaatcacttgaacccaggaggtggagttgcagtgagctgagatcacaccactgcactccagcctgggcaacagcaagactccgtctcaaaaaaaaaaagtgacttacattcaaccacaagtattcctggttttcttgctcactgcacttctcatactccatgtccttctcttgggttccctagggaggctgttttgttcccttagctgcttccctgggccaccctgacagccagggaatgcttgctgcttccttggaagagggtgagaggcagggcagagccagggttgctgacccctcaggagaagtggagagcctggcacagaagcagctgtcccttagtgcatctctgctccatccagtggttcaatggcattcgtattattatgacctgtttccaagtcacagatggaaaccaggactggggagggaggctggggagaaagcattgctcagagttttggggacagctagggtcagagttagaattcagcctcgtctgctctgctgagaccacttcaccgcttcccagtgcccctgctgtggaaccatgaggggtggcatccctggcgaagtgcccacaccaggattcctgcctcctcgggcgtgtctggggccggctgcctggggcaggcggggtgggagtgaggccctgactcctgtgtttagctccaccagcatcacttactctctcccccaggtgaagagaagcctcaggcaagccccgaaggccgtcctgagagtgagacttcctgcctcgtcacaacaacaggtgcgggagaagacaaacgctggaccacagaggcctagtccaaaagggcagaggtgaccaggagccaggctcagggagataggcggaggtgacctgtaggggagaagcccacagcagcctcctctccctctgagcagggacagggcctcagcaacctgcaggccccaaagcaagtgtcagaaagagggaacccaggaccaggaccaagcacggtccccaggcagagatggaacaccttccctcaccaccaccacgtgtctcccaccagcctctgagcttctcattcacagagacaccctgacttcctttagcctcgtgctgtcctaaagtcacggtagcaggagtgtctctctttatctctttttcacagattttcaaatacagacagaaatggctgcaaccatggagacgtccatatttacaacagagtaccaggtagcaggtgagtggggcactggctttgtggacaaaatgtacaccaggctgagatatggacaggttgactggttagtaggttggttagttggttggctggtaggttggttagttggttgactggtaggttgataggtaggttggctagttgattggtaagttggttcgtaggttgggaggttagttggttagttggttggttgcttggttggcaggttggtttgtatgttggtaggttagttgattggttggtaggttggtagattggcaggttggtgggttagttggttagttggttggtaggttggttggcaagttgataggttggttggtgggttggttgataagttgataggttggttggtaagttgataggttggttggtgggttggttgataagttgataggttggttggtaggttggttgttagggtggtagattggcaggttggttggtagttttgttggtagtttggttggttagctggttggttggttagtgagttggttggtagatagattggtagattggttggttggttagtttgttggtaggttagtaggtttgttagttggttagttgattggtaggttggttggttgactgaaaggaccccttccttacactgcagaatgtgtgagtgaaagactaatccagatactgacgtaactcagaattcgcatgaaccagttacaggatgctgtgagcaaagtctcaagtcagccctatcagctcctctcaagctgatctggaagggctgtaccccgggcctctgccaggggtcaagagtgggaggaaggagccacgtagccagtcagagaggacaggcttccagaaacactgccattgtttcctggtaggagggaaaaacagactctgagtctgcatctgcctagaaagtaaacaaatgtcagcctccaaaacctcagcagagcagcatctggaaaacccgacctctttcaggagatgttaatgtgcttctcatcatcttcatatttcaacatttcttttaccaggcgctctcggtgtccttaaacgaggcctggcctctgagcctttctgaggggcttttgtgagagaagggtgcctcctgaggggaagctccctccaccctcaccctgtcctccctgccctgttcctcaagactcctaggaaatcccatggggagggacctacttcctgagacagggaagagaggctgcagcctccgccttgctctttggggatgtcctcagcctgccctgtggccctggctcctgctgcccccatgccaagcccagggccctttgctgaactccctctctctattgacagtggccggctgtgttttcctgctgatcagcgtcctcctcctgagtgggctcacctggcagcggagacagtaagtgtggcatcaccaaggcagcccttggtcagatcaaagtcctgtacccagccccaccctgcctcccccctaccccctccatgctctctctaatcacctgcagttcagggagtggcaaagggagaggccaatccatgcctcggaaagagtcagttaaaaagaattaaagcaccgccgggtgcagtggctcacgctggtaatcacaacactttgggaggccaaggctgagtggatcacctgaggtcaggagtttgagacaagcctggccaacatggcaaaaccccatctctactaaaaatacaaaaaatcagttgggcatggtggcaggtgcctgtaatcccagctacttgggcggctgaggcaggaagattgcttgaacctgggaggcggaggttgcagtgaacagaaatctcaccactgcactccagcctgggtgacagagcaagactctgtctcaaaaaaaaaaaaaaaaaaaaattaaacgaccagggaaatgggaaggcaaaggagcctcacattcattgagcacccactatacaccaggcttgatgcttgttttataaacattattgaaatctaccttctcagaaacctttggaatagctgtggcctagagagatgcaacagcttggagaagatggcacagcagaggccagcactgcaacatgaatctagagcccatgattttcccacccagcccctacctatagaggacccagggcagcatctatgctgagctttgcctatcctgtgctccccaccctcccgtccacagaagctcacaccggcatccccttgaccaggaatgtaaaccatgtgtggtctttttgcattaactcagattttcaaccctgcatgcatcttagaacatccaggagacagtcttctaaaataccagtgagtggcaagatatgagtaaattccacaggaaaaggaaggcagtccaaagggctgtgcttctcctgtggctcagtgttattcatagctgtgacatcttttaagagaggtttacaagagggaaatcctgtcaccaaaaccattgtgacccactttgaatttggggggaatcttcatttgcaacaatagaagaacaaatttgttgcaataggaaatatttttgtagcttatgtaggttgttcagccaaaacagcataataatttaaaaagttaaaagatagcccaggagttgtggctcatgcctgtaatcccagcactttgggaggctgaggcaggtggttacctgaggtcaggagttcaggaccaggctggacaacatgctgaaaccctgtttctactaaaaaatacaaaaataagccaggcgtggtggtgggtgcctgtaatcccagctacttgcgaggctgagacaggagaatcacttgaacccaggaggcggaggttgcagtgagccaagatcgcgccactacactccagcctgggcaacaagagtgaaactctgtctcaaaaaaaaaaaagaaaaaggtaaaagatatcaatgattgggctccagtcagaatgtctggggtgagcccaagacatcagtacgtatttttaattgagataaaattcatcatttaaccatcataaaatgtacagttcagtggtgtcttagcccattttgtgctactgtaacagaatgcctgagactgggtaacttataaagaacagagatttataaagaacagagatttataacttataaagaacagagatttcttaccattctggaggctgggaagtctgaggtcgaggggcccccatgtatcaagggcgtttgtgctacgtcatcctgtggcagaaggcagaagggcaagagagtgagagacagcaggaggggctgaactcagcttttatcacaaacccactcctgcaataacaacattaatccattcatgaggcagagccctcgcgacctgatcacctcttcaagatctcacctgtcaacattgctggattagggattaagtttccaacacctgagctctgggggatgtattcaaaccacagtaagtggtatttagtatgtttgcaatgttgtacagccatccccactgattccagaatacttccatcattcccaagagaagccccacactgccaagttccccattctccccagccccgggaaaccaccactctatgttccgtctctatggatttgcctattctggacatttcgtgtaaatggaatcacgtggccttttatgtctgggatagtcgtacgttttaaagcccctcagatgtatctaatacatatgcatccaggtttgacaaccctacacccggccattggttttcaaacttgaactagcaccagaatcatctgtaggaacataaagaaacgataaatgtttgagatgatggatatgctaaataccatgatctgatcactgtaccttgtaggtatcaaagcatccctacatacctcataaatatatataactattatgtgtcaacttaaaaacatttgttgaaagaatcatctggaggccttgttaaagcacagattgctgggtcccacctgtggagtttctgacgcagtcgtcttgcttaggtccaggaatctgtatttctatcaggttcccaggtgatactgacgctgccgttccagggagcagactctgaggatcaccgcactaggctaacagcattaagaatcagggaagctggccagactcacgcttgtaatcccagcactttgggaggccgaggcaggcggattacttgaggtcaggagtttgagaccagcctggccaacatggagaaaccctgtctcttctaaaaatacaaaaattagctggctgtcatggtgcgcacctataatcttagctactcgggaggctgatgcaggagaatcgcttgaacccaggaggcagaggctgcagtgagctgagatcgtaccactgcactccaccctgggtgacacagcaagactctgtttaaaaaaaaaaagaaagaaagaaaaaagaaaagaaagaaaaagaaaaagtaaactctagaaactccctctgtctctctcttgattatccagggcctccctgacccctgccagcatccactctggccaaccctgatacaaactccacagtaagaccctgagaaaatacagatccactcccccaaaaccaaagcccttagcccagccagagagaaaaataaaatatctcttcccttcttatatgggtcatcaggtccataacatactcctaattttcctcatgggaattaaaaagtataaattactgcagtgcaaatgataagccccctagggttattgtagcaggaatgattcatatacccggcagtctaccagtttctctaaggggttagctgactcctaaggtgtcattttaggcttccaggaggggaaggatgtgacgtggctgacatgttgtacgtgtactcagtacttgcatcctctccttcctcaggctgaacacctgacaagccttaacaccttgcaaggatttttttcatttgttagtttgaagatcaaaagccttcgggcccagaggacaaagctatttggaagtaggaatggttcagtgtttatgttgtgaaacaaataactgtgtgaacctatgtgagttcccacaaggtctcccagaactacaatctttggggagactcaaacatacatctagaaatgacccctctagtcagtttgtccaaaagccttcctagaatctgatatcaacccatggtgccctcttgtggcaacagaaatgctgcatttgaattaccgaaagatcactgtagcccagccagagagttttggttggggaaatattttttgtttgtttcgggcaatgaccaggagcccgtgatgtgctacagaaggctcacagtggcttgtgagagccagcggttaaattttcgggacttctgcaaactggtttttaagcatagccattatggaaaattaaagtatttaggctgggagcagtagctcctgcctgtaattcctgcacttcgggagactaaggtgagaggctcgcttgagaccagcctgggcaacaaagtgagaccttgtctctacaaaaacattttaaacttagctaggcgaggtggcacatacctgtagtcccagctactggtaagggcgaggtgggagaatcccttgagtccagcagttcaagattgcagtgagctgtgaccatgccactgcactgcagcctgggtgacagattgagacgctgtctcaaaaaaaaaaaaaaaaattaaaatatttaaatttacaatttaataaattatattaaaaacaaaggcaagaattacttacaactgatcacttcctaattatttgctaccttttactgttatctttgttcgctgggtggtttacatctattgtgtccgcatggtggaaataccgtttgacggtggctaccgcgcatctcttcccaaccgcgtgatcagtgatgtcacattgccagctggaagctgtgtgtggagggaggattgacaccagggaagacaggcaaccgtcatcagagagctgcttgttaaacatcaccagcacacctctgcttggagtcttgtgctatgggaactctgtgcaaagtagggagtaattagaaattcccatgagccaaataagaactgggaaaaggctaagaccgtattgtccaatacagtagccactagccacctgtggatacttaagtgtatttaaactcaaataaattaaatacaattaaaaattcagttcctcggttgcactagccacatttcaagcgttccctagccacaggtgtctgtgttatcggacagcacaactgcaaaagatttccatcatctcagaaagttctatagcacagtgctggctagaaaccaagtgctttactgcatgcacatcatttagcacagttagttgctgtttattattcctgttccacagctattgtctgccatataaaaacttaggccaggcacagtggctcacacctgtaatcccagcactttggaaggccgaggcaggcagatcacaaggtcaggagttcgagaccagcctggccaacatagcaaaaccccatctctactaaaaatacaaaaattagccaggcatggtggcgtgtgcactggtttagagtgaggaccacatttttttggtgccgtgttacacatatgaccgtgactttgttacaccactacaggaggaagagtagaagaacaatctagaaaaccaaaagaacaagaatttcttggtaagaagccgggaacagacaacagaagtcatgaagcccaagtgaaatcaaaggtgctaaatggtcgcccaggagacatccgttgtgcttgcctgcgttttggaagctctgaagtcacatcacaggacacggggcagtggcaaccttgtctctatgccagctcagtcccatcagagagcgagcgctacccacttctaaatagcaatttcgccgttgaagaggaagggcaaaaccactagaactctccatcttattttcatgtatatgtgttcattaaagcatgaatggtatggaactctctccaccctatatgtagtataaagaaaagtaggtttacattcatctcattccaacttcccagttcaggagtcccaaggaaagccccagcactaacgtaaatacacaacacacacactctaccctatacaactggacattgtctgcgtggttcctttctcagccgcttctgactgctgattctcccgttcacgttgcctaataaacatccttcaagaactctgggctgctacccagaaatcattttacccttggctcaatcctctaagctaacccccttctactgagccttcagtcttgaatttctaaaaaacagaggccatggcagaataatctttgggtaacttcaaaacggggcagccaaacccatgaggcaatgtcaggaacagaaggatgaatgaggtcccaggcagagaatcatacttagcaaagttttacctgtgcgttactaattggcctctttaagagttagtttctttgggattgctatgaatgataccctgaatttggcctgcactaatttgatgtttacaggtggacacacaaggtgcaaatcaatgcgtacgtttcctgagaagtgtctaaaaacaccaaaaagggatccgtacattcaatgtttatgcaaggaaggaaagaaagaaggaagtgaagagggagaagggatggaggtcacactggtagaacgtaaccacggaaaagagcgcatcaggcctggcacggtggctcaggcctataaccccagctccctaggagaccaaggcgggagcatctcttgaggccaggagtttgagaccagcctgggcagcatagcaagacacatccctacaaaaaattagaaattggctggatgtggtggcatacgcctgtagtcctagccactcaggaggctgaggcaggaggattgcttgagcccaggagttcgaggctgcagtcagtcatgatggcaccactgcactccagcctgggcaacagagcaagatcctgtctttaaggaaaaaaagacaagatgagcataccagcagtccttgaacattatcaaaaagttcagcatattagaatcaccgggaggccttgttaaaagagttcgctgggcccatcttcagagtctctgagttgttggtctggaatagagccaaatgttttgtgtgtctaacaattcccaggtgctgttgctgctgctactattccaggaacacactttgagaaccattgtgttattgctctgcacgcccacccactctcaactcccacgaaaaaaatcaacttccagagctaagatttcggtggaagtcctggttccatatctggtgcaagatctcccctcacgaatcagttgagtcaacattctagctcaacaacatcacacgattaacattaacgaaaattattcatttgggaaactatcagccagttttcacttctgaaggggcaggagagtgttatgagaaatcacggcagttttcagcagggtccagattcagattaaataactattttctgtcatttctgtgaccaaccacatacaaacagactcatctgtgcactctccccctcccccttcaggtatatgttttctgagtaaagttgaaaagaatctcagaccagaaaatatagatatatatttaaatcttacttgagtagaactgattacgacttttgggtgttgaggggtctataagatcaaaacttttccatgataatactaagatgttatcgaccatttatctgtccttctctcaaaagtgtatggtggaattttccagaagctatgtgatacgtgatgatgtcatcactctgctgttaacatataataaatttattgctattgtttataaaagaataaatgatattttttaaaaa

SEQ ID NO: 101 - DNA, 20582 bp, Homo sapiens
accttctatggcaggggcttttagcaccattctttaacgttagacacataaccacagcctaatcacttgaaccatttaatccttaccagcctctagcattatcctaaaaccctgaacctcttccagctttcttaaactttcagcttttcttgaaacgactttttctgattctaagattattttaactgtaagtaggagaagacatctgaaatttaactatgatcagaaattcagattacaaaaactttgtttgctgtgctgtttgtaataaaataattccaccagccccttttggaaaaaccttcaaacggatccatgaatacaagccacttaagacacgcttttacactcacaaagacatactaggtaagtgactttatcgttttcctttgttctaatgcttcatagccttatgtgtcattctttctgttacatagacttttatcagcttttttctcttcagagttgcttgtccctacagggatatttgaggagaatatgggttggaatacagcttctccacttacagttgtatgtattgggcagggtatttagcctctcaatctgtttccttatgtggaaataaatatactaatacctatcttacaggttgttatgagactttaatgaagtatttgtatctattataaatcctggcacataatagtaaatgtgagttcattttgcccttggccatacttgagcacctttcagtatgtgtaggagaggaaatattatctctaaataacaccctaattggatgggcacagtggctcacacctgtaatcccagcactttgggtggtcgaggtgggcagatcacttgaggccaagagttcaagaccagcctggccaacatggcgaaaccccgtctctactaaaaaaatttaagcaggcatggtggcatgcgcctgtaatcccagctactcgggaggctgaggtaagaaaattgcttgaacccaggaggtggaggttgcagtgagctgagatcgtgctactgcactctagcctgggtgacagagcgagactctgcctcaaaaaaaaaaaaaaaaaaaaaaaattttaaagtaccctaataaatgggtaaaagaaactatataacctttaaatagtagctggtagcataaaagtagatacatatagataacatgaggacgtttactgtacatacgtatgtatatataataagcaaatcaaattgtactataggtttccatctctcttttatccccgtaagagttttcagtctgaccttgagccttgtaggtattttcctaagaactctcacaatacttctctgatcctctcttcctttaaaatggtaaactaagggtgatttcatttcactcctgatatttgaaaatataagaagctggagagcagaggtgtttggaaaaaaaaactaaaatgtagggggagatcaaattggaatcatcttctaaaaacatcaattccaaaattgtttcttagcatttagtaagtgcttagtatgaatgattcattatgatctctaaagtgacttttcatacccaggacagtgtatctccattcttagatataccttaatgattgattccttatgccttatggaatatctaacccaaaccttaagtggataagttaaatctattgttagaaattaatcttttctattcagtgacctttgtcattgaactgttttaagttaaaaaagaaagaaagttgaaattgtctgttctttataagcattttgaaatgtccgtagaagagctagtgagtatttcataggacgatagttctcaatcctggcagtgcactatatagaactttgaaaaaaaatattaatacagatatccaaacacagacccactggatttaatactaatctaacacagagccactaaattaggacctctacggtcaggactaagcatgtgtattttttccttcacgtttaaataaccttttttatttcaagatagtttaagactcacaagttgcaaaatagatcagagttcccctgtacccttcatccagcttccattgatatcttacataatcctggcactttgtcaaagctggaacactggcattgaaacaatactattaactcaggtacagaccttatgtacacttttttcccccggcatagagttttatgaaatttatcatgtgtgtatattaatgtgccatcaccacaatcacaacatggagctgttccatcaccacaaaggaactccctcgtgttaccccttagctgtcactctcttctccccaaacttgaacccctgacaaccactaatctgttctctatcactataattttatcactgagaatgctatctaaagaatcatagattatgtaacccattgagattggctttcttcactcagcacaatgcccttgagattcatccaagttgtttatcaatagtttgttccttttacagtatgtgcatttttaaaaaaagctttgcagggatcctgttgtacaatcagggttgagaacaactaataaaaccaatgggatttaaacataaaagaggatagtgatagcctacacttgtatcacatttttatgaagttcaatacgttgatggtccatgcttagtcacattttgtcctagaaaatcttttctaattatttctacacaatgttgggcttttgcagtatgtgtccatctccaccgtaatatatgctgccctgtgtttttaagattcgctgatgaactagtaggagactctgtgccgccaaacatatacttttaattgctagtgacagaaacataactcagaatagactgcatgaaatggaatttcttgactcttttaacagagaaacccaagggaaatctggcatcaaggctttcaatctgtccatgcttacccttttagtgagttggcttaatggtttactgctgcagctagacttactccggcagctgggaaaggaggaatgtggatccagatagctctaagaatctattaccttcagcttagaaatcccagaggaagaccaggcatggtggctcacgcctgtaatcctagcactttgggaggccgaagtgggcagatcacttgaggtcaagagttcgagaccagcctgaccaacatggtgaaagcccgtttctactaaaaatacaaaaattagtcaggcatggtggtgggcgcctgtaattccagctactcgggaggctgaggcaggagaatcacttgaaacgggaggcggaggttgcagtgagccgaaatggcgacactgcactgcaggctgggctacaaagcaagactccctctcaaaaaaaaagagaaatcccagtggaaaaagacctggctgtctgatattgcgtggtcctctagcctctctagacttttattaccttgtctgggtagagaggatattattatgggaatgttattatttggaaatcaaattagatcattgacagaaaaatagtaaacttctaccccttagctcactccatactgaagcagttaaacccacaaagaaccacatgctaaagaaaggcatgtaatgtgaaggcattccacttcccttctcctgatgctagccctagcacccaaataggaacagggagagagagagctgtataatgtgctaagacctcttgaatattcactcatcattctactttgggtgtacaaaatatgtccctttcttcgggcatttatttcacctccccagttgtctgctgtgtggactgggtgtgatgaggggaatgaccaactctatccaggcctgacagtgctgtgaattccctcctaatcagagaaaatcttactctttcaatgggtatctttgaaatatatatactggcatctcctaaaaggacgtgtctcctaaatagccctcataaataactagataatggtggaaaggaaagccaggaagcagtcggtggaggtttgtgaccattgctcttcaaatacacagatattggggcaaatattctgaaaaaagaagagcagtttcaagaagatatactcagagaacacattgcgaaagcagaagctgaagtatgggctcaggtaaaagaagttacatgtcaacctaaagtccatctttaccgttctttcacattttggatttgtctgaaacaattgtatagtgtagtagtcagaactgactgaatcctggctagctgtgggacattgggcaagttctacaacctctgtagtcttggtttcttcattgtaaaaaagtaataatagtacccattctgtgggatagttgggagggttcagtgaaataatatgcctggcacacagtaggtgcttagtaagaagccggcatcatcaggagcttccttccttctcagctgccctctctgtagggaggactcctgctccctttattttgatttgattgaaaccaaaactaaaaagaaaaaaaaatgtctaagaaaactccttgttgatagttgtttcttatggcctaacatttaatatatagaccatccatttgtggagcatgtaacactcctgtttcctcaaatgcttcattatggcctactccccttttcctcccctctctcccaaatccttgatacctcgtcgatatgactgctgagcactataagggcaatttgaatattggggctcacagtgggatccaaggcatcaaactgaagcaaagcctcagtcctgtagccctacttcttccaatcatagaatgacatcaataacttcccgtaaaagaattacagctccttgagagcagaaccacagtgcttagaaaaatgtttgtcagtttctttataaaatagacattatagcaaatagtattagcattgctcagtattcatgccagcaaaagcttgctatgaaaatattttgaacatacataatgctccagttctttatgaatactccagttctgtataccccagattttgatttatctcaaaatctttgtagtcatctatttttattagtggtaaaattcaaactgattgtgaaccatcaattatacaccctaatacaaggtgatgcgtttgtaaatagtctacaatttgaatgtaagttggtctaatgttctgtgtattcttttcaaatagagttaaagttctttctgaagactgaatgtgggggacctggatggtactctgcctctttactcagctccttctagctttgtgcgtcttttcatttcactgtgttttccagattttccacaatgcacatatgttactttgagagtcaatcaagcaagaaataaagtgccaaagagaaaaggcaacccagcagcctacatacagtaaagctgccttgcctttagcgattccaaaaacagcaaggctagctctggattgggatgcattagagcatctctggctaaggcagacagtttgctatgggaggtttgagatgggaatggggcaagaaattagggactccatggttgttgctaattttcagtaaacttgaaaacctgatttaccaacatcctaaataagccaagtttgcttgtgcttattctgatacattaatagataaatggactctttctttcaaaggctaatgaacgtcaaaaacaagcagtggagaaagcacttgaagaagcaaatgacagacacaaaattgaaattcagattttgaaagaggaacatcagaaagatttacaggtttttatagtggcttatttgttgtcttttaaaagtaattacattagtaaaaagaaaagttggcaagggaatgagaaaaaaataataaggaaatctagactggtgtttcatggccattagctgggatcccctgggaggttctcagaagagatgctgagctctctagagcagtgatgaataagtgaagaagaaccccatagcttacttcccaagggaagctttgcctgaccaaccttgccttgccacccacacactgtccatgacaccctgatctttttcatagcagtcttcaccattgtaattaaataaatgattgtgtggttagttgttgagtgtctgactcccccacatgactgcagctttcagcaggggtgtctgtctcatcactggactagccctggtgcccagcacaattccctgacttagtaggtgctcaaatagttgaacaagtgaagcaggctgttctcctccttctctgattgcatccttttttctaaattttgcatttactgtactgctaagagggacatctgagctgtccctcaataatttaatgcagggccagatgtcacagatgaaggttactaacctgtagcctgttcaagtacatgactctaggtaacttacaaactttcaggtggagaccctaggattcattgttagttcagtacctcgattacaaaatctgctcaaaggaaaatgttacagaactattttcacattttggtcaagggagggacaggacaggataaggtacaggtatgacaatacacgggcagaagctggaggaaagtgacagaggtccggacccaggtttggtctaacttaggaacagtaatgagcagttcagggactgcaggccaatttattcgttgttgcaacaatgagcacctaccgtatattagatctgtaccgggtgagataaaatcaactgtctttacccagagaggacttgctgtcaggaaggggagctcctccccatgagtcctgaaggctagtgggatgctccctgcttcgctccagtggcctacctcagccagggttggtatggtgtctgaggggttggctgtggtggcccattgcccattccccatttcagttcaaaatgtgaagagcatttatagcatgtcttaggcaggcctgctcttcagctgctatgtacaagtatggccatactggcaattaaagtattaaagtacttctctatcagttgataaatagttacccgctaagccctctatcaccttggtcaccctggttgcttccccagcagactcctggacctctcccaatccagcaatttaaaaggataactcatggcttggcaaggggctctagttccctgctataatgctgcagccagaggccattcagataggtgggccctactgtgctggttgatacacattttgaatgtccttcctggcattaggttgtaaagacataaggaagatgtgattcctgtttcaaggttcacatgctagtctttctttaaataatgttattgtaccccacgcagcctttgagtggagttgaggtacttagtgcatcagtagaaagaagccctatttaaaggtaaatagttaaagggggatcgaccttcctgaaatatttgtccgggggttgagaatttacatttataccaccatttcagatattttttacttatgaaggaatgatttgtctaagagtagtgtggggttatttcaacctgttatatctgtaggataccaagatacagacatcagtactacttctcagggcttgtcggtgaaccacttgcatcagaatctattcacttggggtcctgacatacagattcctgggcctcattctgacctacagactccatcagcatcccaagtgattctcacacatattaaagtttgagattaccaatgtatagcagaaaaccaagttcctctagaaccaaatattaaattttgatgtgtcaagaccaccaggtattactcttacgtgatgttaagagtttggtgtgtctcaaatgcatgctgttagataaaatttctagatcttgtttgatggataggtaatcttttgaaaaggtgtttatattattgaaagacaataatatcaaaaagtaaatgagaagatgaaagctaaaggaaaaataaatgaaaaactacagtagaaaatatagtaaagtcataggtaaatttaaaacttaaaaatgtatatatgccatgatgtcctgtgcaattatcactgattgggccttgagctttctggcagccaatgcaaagagagaaatgttgtgactcaccatgcccataaggtacaggcaaattaggcacttgagaggctcagatattcctagttatgaaacctcagagcaatatctcctgagggggacattatgtaaaaatgcctgtcaaacatctgtacagttaacatgatggagtccatgaatctatttcttacaatatctcaaaacgtggggtgactcactcaagatgcatttcagtaaaagcaatttatttcaatgtaaggtctccttacattaaataagaacattgacaaacagcaggttacttaataatttttggagctttaaatatgtattccacatgctatgtgaggcagtaaatgaattttggttttattaaatcattacataaaagagggactgagttcaattatctgaattcctagttactaattaggaatcagataatttctaattatctgaatacctacttcacaacccagccaaaataaagggctggaatgtcatttttaaattctatgattcaataatttattgtacatttaaaaatgactgaaagagtgtaattggattgtttgtaacacaaagaaaggataaattcttgaggtgagggatattccatttacccttgtgtgattattacacattgtatgcctatatcaaaatacctcatacaccacaaaaattgaaaattaaaaaaaaaaaacaaacacaatcactttgtgccaaaaaaattcaggcatacaacggtcttacaccaccctattgacactggctttttttccttcttcaatagatgtttgcaagagttccattaaatacatttcattctgaaaaaaaatattgattcatataggaatatattatggtagtacttcacctgtcttaaactcaaccaccacccagcagtctgaattactgagaatgtacttgaaaacccagaagtaagttaaaatatccccctaaggagttaaataaaggcctctgactacaagagaataactcaggcttattacacacagcagaacctcttcacccccactcagatgtcattatgcttatttggcaacctaaacccaacagacttagatgcttgatttttattttgttttcttttcttttgaaatggagtctctctgtagcccacgcaggagtgcagtggtgtgatcttggctcattgcaacctctgcctcctgagttcaagtgattctcctgcctcagcctcccaagtagctgggattacaagtgtgcaccaccacacccagttaattttgtatttttaatagagacagggttttgccatgttggcctggcagccaggctggtctcgaactcctggcctccaatcgtctgccctcctcaacctcccaaagtgctgggattataggcatgagccaccacacccagcagggttgcttgatttttcaatttggaaatagattaaatattggaaagtaaaaataacaaaaaggggctcactgatagaagctacagcagcatcctcagcctgatggcaagtaattttcttgttctttgaagaaaagaaaaaatttgatttgatacctacaaagagcaaagattaaatttcaaaaagcaaagtaatctggagtcatttatgacagatacaaggggctccatgaacttcaacaattattaaatgccacatgaagtttttggtccagtacaatcattcatctttgtctaccaagcctggatcattaagaaagtgttagattgtttcaaaatgttctttttatggtgttaaagacatttagaaacatttccattcaaaatattcttttgtcaaaaaaattttagtgatttaagagacaaagccttctgcagtgtaggaaacccagctagcatttctaaatggccaatgttttcctaaaaagattttctaaatacatgaactgaggccacttggagagattcttaaagttgatttctagtgtctgtttcattttttaacttttcacccttgaagtagccaaagtgagaagttgagaactttttctcatgaaaaagctgaaaggtttgtcttaacaaatattttaattgttgaaataatcttctaagaagctgaagcaatttcagtttcccttataatttagagttctcttgactttctctcagcttcagctgaggattctctctggacgctgtaaacagagctggctctctcaggggctcccatagaaatggtgctaaagggagttgagcaatcttcagccaggagaactcttactggttttattcctttctattctgggtaagatttcatttaaagaagggattctgcagctattgaaaaagaaagaaaacccagtgtactatatcttacaagactgtacaattgatgaatctcttgaaagactccagcatcacagccaggaatgaagtgagaaactggcagtcagcaatcctggcttctatccctagttcttccattgatgtgctatatgaaataacttaatttctctatgttcttttgatgtcttcccaaatagagataaacatttacctttgggctgggcacggtggctcatgcctgtaattccagcactttgggaggtcaagatgggcagatcacttgagcccagaaattgaagacaagcctgggcaacatggtgaaaccctattttgacaaaaaatacaaaaattagccaggcatggtggcaagtgtctgtcgtctcagctacatgggaggctgaggtgggaggactgcctgagcctgggaggtggaggctgaagtgagctgtgattgtgccattgccccccagcctgggcaacagaatgagaacctgtctcaaaaaaaaacaattacctttaaatgaaagttttaaaatacctggacagaatgaattgctcctcctctttataatgttatatttctacatattgttatatttctgtaactgtattgcacagttacgttgttggcctccttcactagacagtgaatcccttgaggactaagatccccaccttcttgtatatgtagcttctgggcctcggactgccaggcacactgtggatttccaaaatggtgacagggttttccttgagcacaatttgtggctctgttttccacaggtcttggtttgactagtggttcctctccttagttccctcctacccaggagacacgaggcatagtaattatttctgccattttccaggactggcttactaaagcagaattgcattatgtaattatgtataatgataatatgatactagaatatttagacaatcaagaaaaaagacctttaaccctacccctctaacccaactattttcttttttccatattccctttcaatattatctacgtagatatttatgctacatagtttgtacatttttggttcacctaacatcatataaataaaagttttccatatcatacacactcttcttttaaatcatcagtgttaacaggtacacttgctagcagatagataaaactatggtttaaatagcctcctaatgtgcagttttaaacattaagtctgtaatagctaaacctagttttgccattgcttcaggaagtgacagctaaaactaagacagagatgtatcaaaacatggatgacgaaatgaagagagagcacttggctgcagaacagcgcatggtccacagaatccaaaggattatgatggaatgccacagagagaaggtcgaagctgtggagaaagccagggctgaagaaagacacatcgcccaggaagcaatccaggcccagaaaaggtattccagagaactcatttacaaattagtaacttcctttatcaaaatcaacctggagaaacagataaggttacagtacataggtagatattgcccagtttttgtgtttttacatttttattatggaaaataccaaacatagggaacaatttatattgtagagtatgtgtgtggtttaaagaaaaataataacataaatactcaaaaacctaccacccagcttaagggattgaaaattgctgttttctaaagctctcgtgtgttcttcctcaatcatatcttcttcttgtccctgcttgaaagatagctactctctaaatatggtatttttcattctgtatcaccagttttaagaagccaaggacaggaatcaagaaacagtttcccataaacacatcattaaaatcaatcttcacattctctagcctagatcatacactattgtgtttgtgttactttttggtctttttcttattatgcaagtaatatatgttgcaaaagaagttgacattatggaaatatatagagcaaaaattgcaagtcctgatgcattgcttcccctacaccctccctgcctcccagagacagttattttaaacaatagagtctatatccttccatgcccttttgatgtgtttacagccatatgtatgtgcataatcacagatcagatcatacatatatatattttaagaaaaccacggtaactatttctatatatgtaatgattctttgctggaacaggacagcagttaggagctcagggattgtcaggtgcaagagaaaaaccataatttccagatttttttaccaggtcatttacctgcccatgatcactgatttgtagcagcagagctgagactgagacctccctatttggcctcctagtctgtgactggtcccttttgctttgctgcttgagttaacaaacagatacatttctatataattaatgggtaaaatctttttcattagaactctttagaacagggacacaggtaagatcctggaggaggtacagataaatgagaatgagagctgcagctgtgacagtttaactggtacctctcttcctgcatagactgcaggtcattgtggaggtagaagaggaagatgagaggggataccaggagggggttagggaatgagtcatggcccaatgcactggaaggtggatcctcttttcttttctctcctgccagccatctgcaggagctctgtctcacctgtgggagcctctgggtcccctcctcacacacacttgcggtctcctccctctcttgctagattgtttttgcgccccctccagccctttcctctgtgaggtttgatggaaggttttcaatgtctgccttttattgaatctgtagactaggattaaggaactgccatgtgtactgttaaaatatatccagctagaatgcccattttgtttattgatgtttcccaagtgcctggaagaaagtctggcacatggtaggcattcttgaaatatttattgaacaaatggtttaaatttcttccaattagtcgaagccactcttcagcacaccagatcttatttctagaaagtactagattcctctgttctttagagaatttgcagaaactaatatatggagagagaccactgttgagaattctatgcagattttttattttactataaactttcatcaagacttaaggattcagaacatttatatatcatgagaaatttgttaactatacagaaaaccgttttgtggattgaggtgattagattctaaacagattgcccaggagacactggactctttctcttaaagttaaaaaaaaaaaagtccaggggcggtggttcacgcctgtaatcccagcattttgggaggctaaggcaggcggatcacgaggtcaggagatcgagaccatcctgtctaacaaggtgaaaccccgtctctactaaaaatacaaaaaattagccaggcatggtggcgggcgcctgcagtctcagctactcgggagactgaggcagaagaatggcgtgaacctgggaggcggagcttgcagtgagccgagatcacgccactgcactccagcctgggcgacagagcgagacttgtctcaaaaaaaaaaaaaatctgtttgtaaaggttctaattgttttctagcccaaggcaaggcatgaatgaagtgaccactcaggattttttgtggtcatggctgtaattcctactgacagcttcccttattcaattcccagcacatgcaaggccttttgtatactccctgcatctgggtgtcccttcctaggagattgtatcatcctacatatcttcaggcaaagaccctggagggttaaggccttaaagggaaactaagcaaactgccaaaggtcacagaggaaagaggtgacagggcctgatttgaaccctggcctttatgatgccaaagcttatgaccttccattatgctacctgctttacaggtagagaagctatgtgagttttctagagggtttgttcacttcaccagagctcatcaagtaccttctgtggatgtggcacaaattaagagcccttcctcaacattgtgtaaaatcactagagcatggctgcccccaacaagcaaggctggatggactggtacaaatagcacataggtgctgcaagagttcaaagtcctggaaagatcaagcagtatgggtggggtatgtagtgaggtaggttttttggaggaagttagtcgtgggttgggccttagagacaaggtaagaggtcccacttgtgagagaggcaaacgaatgagaaccgaatgcgcaaagccatggaaggagaaagtatgatgtataatgaggcagagccaaggggaggttcaagagtgttaacaacccggggatagaaatgcactgctgaatgctggcatctggagatgtccctcacctgcgtaacttctgaaatgcctgcagtctcctgccagaccagagagccaggggttccccatgtcccaggtggaaaatcagaacataggttactggtaaacacagtggttgtacctgattgaaatagtactaacagtcctatagttctaatgaaaagtagattaatagcttatttacagactaaccaggcaaaggatcaattgctactatggactttccgtagtttattttttccctattagttaagattgagttgttagatatcagattatgtttttatttagtaagttgttttcattctccaagagtctgttttataaaatatcagactgaatcctataaatttggacacacactacaactattttgaaaatagttacttttctggccagtgccaccctgaaatacggtgtgtatttcaaaattacaagtgtacagcctcataaagatagagatgccagaagaacctcactgctcacagaaagcatagacattcacttcacatcagaatgggcattgggggttatggagctggacgtgccattccttctgccagatgccagccagtcatcggtgagcctccttgatgtcactggttgaggtggttggtccaaatgctgaacaacctctacttgtcatgttcttcctaatgtggatccaaaaactctgggccttacctttacccttggcttctggccctgctcctcctctgtgcgtggtgatccttcaaatgtttgaggagagagattatgtccaagatttaatttgaagaagggaaggaaaaaccaaaaagtactaatacctagttctttcacagttctttctcatatgataagctttctaggccctctttcgataaaaaaaatacaggtagactaatttatgtacattgaaaaacattttacacatatcccaagaattggctattttcctatggcaaatatttcgcttatgttaagaatcctttttaagcatgaattttttttttttttttttgagagagtcttgctttgttgcctaggctggagtgcagtgatgcgatttctgctcactgcagcctccaccttccaggttcaagcaattttcctgcctcagcctcccaggtagctgggattgcaggtactcactcaccaccatgcccagctaatttttgtatttttagtagagatggggcttctccatgttggccaagctggtcttgaactcctgacttcaagtgatccacttgcttctgcctcccaaagtgctgggattacaggcgtgagccaccatgcccagcctcattaattcttttaagcttttgtaatgttccaatatagctgctttaaacttgtagtgttattcagcacaacatgtattagagagagtttcgtctgtattacccacttattcattcatacatttattgattgcctgttgtatacacaacgggcaccacactaggcaggggagatacaaagataaatggtcattgcaggtcacaccctcgacgcactgcaccccaccccactcctggcttcaattccacaacttcagggaactcatcagaatgaaaggatcaaatattcaagcactaaggcaggctgggaaaagtggggctaggcgcagtggctcatgcttgtaatcccagcactttgggaggctgaggtaggaggatcacttgagtccagcctggccaacatggcaaaaccctgtctctacaaaaaatacaaaaattagctgggcatggtcgcacatgcctgtagtctcagctattccggaggctgaggtgggaggattgcttgagcccaggaggcagagtttgcatgagccaagatggtgctgctgcactccagcctgggcaacagagtgggaccctgtttaaaaccaaaaaaaaaagaagaaagaaaagttggaaagattttttaaagtaccagattctgttagcagtaagagattttgatatcagggagtctgaaagggactgtcattgagggtgggagctggcgtcatccaagatatacattattggatcacttttgcctgactcaattctggtagagccttccagttagcccataaatgaaacctcccatttgggtgagaggaaagtcagccccacctggcaggaaactcatgcctgcttatgtcagaggacacagggagcacagcttcctccttggagattggtccctggtcatcaccctgacaatctcatcaacagcctgaggatgttatcagacatcagactaaatccttagaatgtgtgtcgatgcacactgcccactctatacacagcatcacttctattaatggaacctccattctcctgtgacccgggttgaaaatcagcaagttggttttgattcctctttttcccacttctcccatatgcttgcagtcacagattctggcagctatgactttttaatatttcctaggcttaacccattctctccctcttcccaaccctctcttttgtcattagttcagaccctcatcattgcacctcaaggatattatgaaatgatacaattggtctctctagctcaccccactaagattcagttcactcactgttacctgaataacaagtctaaaatgttatttttactgtgctaccctcctgacgaaaaatgtatagtgcccactcatgagcttgaagcaggtaatgattaagggcaggaactccccagcgtgctcagttgtgtgacattgaacaacaactcactcttctctaagcctccatttctcacctgttacaagggaatagtcacaggttataagtaaaaataggtcaggcacggtggctcacacctgtaatcccagcaatttgggagaccaaggcgggtggatcacttaacgttaggagttcaagaccagcctggccaacatagtgaaaccctgcctctactaaaaatacaaaaattagccatgtgtgggggtgcacacttgtaatcccagatacttgggaggctgaggtagaaggatcacttgaacctgggaggcggaggttgcagtgagccaagatggtgccactgcactccagcctggacaacagagcaagattcatctgtaaataagtaaataaagtatcagcttcaatgggttattgtgaaaattaaatgagatatcgtgcatgtaaaatgctcaccacagttcctgcaatacagtaagtactcaataatcattacccctgttattaatattggaaatagcttagttggtgggaaaaggaagaagagaaatagtatagtggctacggaggctaaagaaagatgtgatttacttcaagactagggaagtctgtcaggtttgaaagtcaagtggaaagactcagagaagatgagagaattgcatcttggaggatggaatttaggagatagggccagtggtaaatcttggaaagcctgtattagactgggaggcagagggggaggatttttattaacagccatacatttgagatcttaaaacctcaaatctttgaggttctgctcaaactatgttaactgcagaaatccactggaaatgtatcacagtggctaagagcttttgccctggtctcagactgcctgagttgtgttgcagattttgcctctttaacttattaaacaaacttagtccaattacttaacctccctgagctcaatgtcttcttcataaaaagagcacagtaatggaaccacactacagaattgtttttgaggattcattgaattaatgtatgcatagaatgctcattaacctgcttggacatggtaagaggtcaacatggttggctgctatgaattttatataataccctacattatagccagaagtatattaatcatttagcagtgcttctgaatatgtggtccagagacccttcaaggtccctgagactctttaaagaggcagtccatgacattaaaactattttctttttttttttccaaattttttaaaaaattattattatacttaaagttttagggtacatgtgcacaatgtgcaggtttgttacatatgtatacatgtgccatgctggtgtgctgcacccattaactcgtcatttagcattaggtatatctcctaaagctatccctccccgctccccccaccccacaacagtccccagagtgtgatgttccccttcctgtgtccatgtgttctcattgttcagttcctacctatgagtgagaatatgcagtgtttggttttttgttcttgcaatagtttactgagaatgatgatttgcaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcataacactaagactttatttgcctttttcactcttagtctcctatgaatataaaatggtgttctccaggggttttgtgatgtgtgatatcacaataaattgaaacagtatgaaaattcagctttttgctaataagccagagattaaagagttgtgcaaaaaaaaaattaggctgggtacagtggcttatacctgtaatcccagcactttgggaggccagggcgggtggatcacttgaggtcaggagtttgagatcagcttggccaacatggtaaaatcccatctctactaaaaaatacaaaaattagctgggtgtagtcgtgcacacctgtaatcccagctactctggaggctgaggcatgtgaatcacttgaacctgggagctggaggttgcagtaagccagggccaggccattgcactctagcctgggtgacggcaagacactgtctcaaaaaaaaagttaaattataccattcttctcatgaaatatttcattgtttgggaaaatgtttttcataagagatttttaatattttaaaaatgtctcccttttagtttatataactgttaatgtcaatgcctataactcatataaacaaaagctctttggcttcctcgataattttgagactgtaaagagctcccgagaccaaaaagcttgaggtgactgtcatagagtattgctcagataaaatcaagattaaagctaaatctatcctgtgagtataaggatttttcatctctggctaaaggtcagcagctggattaatataaagaaatactttctctacagagtttggaactctgacccttatctcctcatttttaagcacaatgcatgtatattttcctgaaaaaggtgatctcaggttcctaaagttgccgttagaagttagactagtggcctcaccctagcccacagcagggaagtacataggaagcctccctgctctgaaaatgtgttttgtttgataacagctaatgcaatccaaaagctcatccgtatcagcctgtctcaggctggtggctcatctcaacaattgctcattcatctgcgtttaaagatgaaattattttgtttttagtggccaatccatctaaattataaatccatattatcttttgtagcaaagccgtggaggaaattgtgaatactggtgtcacagttattaaggatgagaagaccagtgtggcccgactgatgagggaaaaagaacatgaaatgagcatcctctatggcatagctcagaggcagaggcaagaagaggtacaggaagtgcttcaagaagcagagaaaacacatcaggccactcttggcaatatgatggataaactggctaacacccagggggagctgctgtctatagcaaaacaactgggaatcatgacaaattggaaagatttcctagaggaggaattacaggaaaccaggatggcatttcaaaaatacatcaattatacctttcctaagctttcaccaggacatgcagattttattctgccagaaagaaagaaaacaccttctaatcttgttattaaggagaacaaaacaactcttgattagaagtcttcagttgaaattccactacaaaagacatcattccagactaaataaatttactcaaaaacca

SEQ ID NO: 102 - DNA, 216026 bp, Homo sapiens
tttactagggagcagtttccccgcgcgacagttcgggagcgcgcaggcagtcgcgcgcacacacgcacgcaggcacacacacacacacacacacacacacacacacactttcgcacacacaaacacgctaggacgctcgtcttcgctactgcatccccgaaccagcagagcgaagctactgcgggttctgttaacctcagcatcgtggggcgaagcagagccattgtgcatcaaggagaggccggtgcctgcgctgccgtctctggcacctaacccagcagaccgctcaccccatcgggtaagccagtctctctccttgtaacctgttctgcagacctgaggaagagggtgggaggctgctggtgcgccaagtgggggcagacccggagttgacatttcaggggcttgcagcccatgcagcctctgcccgtgtcgtctaacgggagcagccactactcaggttacttatgctgccagccctggagtcgctccccctttcttccctccccctgagcccaatatgtactgtgctccttggttgccaaggagacttgcttaaacatcagccgtgggacatctattgaaagaactggtttcttaaatgatgccgttatttattttgatatttaaaataaaatatacactgaggacctttcgtaatttggcatttgttaatctgtattcaggtggcggtttcattcaacttcaagaaaagccgtaattgcactatatggtatgctttaaaaaggattcgtcagatgaatttttcaacggattgtgtcttgaatcataatttactcccattttggtgatcttataaagaaagatgactgcagtttagatcccttcttcccctctatttccagttttattttgcagttcacttagtcgtgattattttaaattaaaagcagatgatttaattgtgtttccccacacaagaatgagcttctattgtaaattgaccagaacaggaatacgtttgtgaattcgtaacgtaagaaggtagcattcatgacatacatctttgctagcatttttatatcccctgcatcagtattgaagcgcagttttttgcacctctgctcatttctgagaagattctgttttttaaaaaatctcttattgattatttttagatctatctctatacacagatagagatagatataaaatgtgtgccatggcttactagagcttatatgaaagtgcagtggtttttgctttttgttttttttctgatgggactgggtcctctactggaacactgataggccaatggaacaggtcagcctaatacctgggctgtcagttttgttttattttgaggtctcgggtgtctattgggtgaacttgtaacacagtacttgaaggcatcagcaatccagtaattacactttgcacgaatttcatgcctccatcacaaacaaatggcccagtaaagatccactggcattcaagaattaattttgttttccttggatatttgttcatcttttctacttcttgttaaatgacccaaggaaataagtcaaattcttctaatttagattttaaactctgtcatagagagtgtaataaataatgtgaggagcaagtaagccaaataatgacagaggtagatagaggggatttatgcaattcacagagctttgggagatgaatgatgacaaacattttacattacagtgtagaaagcacttttcatatacttcttttttaatcctcacaacaaccctttgaggccaataaattaccttccatttaaagctgaggaacccaagactcaaaccttgctgaaggtcacagctagtgaatggggaagccctttctggatccagtctccttgcctttaaaaaaaagttgtgtgtgcgtttcagatgtgtgcagggatctgacaagtgagataaaggagtggagcaggcctagacaagacacgtgggagagagggtagggagtggagtgtgaactgtggcctctggaacttgcaaaccactgtaaaggaggcagctcccactccactgtagccgattgttactgtccaggctctaaaacatgacagttttttaaggaaaacagaagcttctggattttttttatgaggtatccttaattttaaaaactgtaaggaccacattaaaaattgtatctgggtcatatctagcctgtggcctgctagttagcaacccataattactgatgtctcactcaattataagttagtattctctaacaaaatactgatgtgaaaaaatacatccatcattgtgagtgatcagttttttatttcaatattaaagtctaataaatgctctacctttgtttttcaataaacaggttcaaaaattttttgaggttttctagatctctgtcttatatctcagaaaataaaagaccatgaagtgctctaaaataggaatttttgaatctggtgaaacaaaagcatatatagtttagaacttatgttcctggcttaatgttttttttcttgccataaggccaagaagtggagaaaaactcagttgagtgcttgttataggaagacgtaggattggtcagcaaatggagcatcctgagcctttaatgaaaatgtctgattaaagtgttagataattaggtaaaacccaccactgaatactgcaagatgccaaaggaatgaaaacataagtgggaactcagagacattaaatcccagcaccctggtatacaaaatgtttactcctttaataactatcttgtagtgaggtaaatacgtcttgagaagctgccattttctcgtgtttctcctagagctacagagatgctagtggacttcactgaagtaggtaagtagtcagagaggagtgtcattttatttacattgtctctttggtggatccagagaggtgtagttaaaaggaaaagccaaaagatttgaacagcgacttctcatggttctcttattccaaaatccccctctggaaagatgccttaacagtaaataaagccatttcagttttcctttcatggaaatatgttgcacctctagtaaggagctatgcaggtgtgtgttagtaatgttctaacaaagtcctggctgagtgcatggagataccgtctctgccctcaatgattcagagcaaacacactgctcctggcagcgtccacttttcgagctcttctgtgagcaagctacttccatatcggcttcacaatgactctataaagtgggcatcttatttccattttacagatggaggatctaagactgtgaagtccaattggagcaatgaaagaaatcttgcaacttcagctgctcttctcttttcacattccttcttctcaactgttacctaatgcaggttatagacatgtacataattgtgattttgagggagttatgtgttaaatgttacaatggaaatataagattccatagaagctcagacacagggaaaaaattttaaatgttctgattgtggagatcaggtcagtccctaggtagtagggggattagtgctggaacttgatggctgggtatgattatattaaatgaaaatccttatagctattgaaagatgggagtctccaccagacagtctgttggaaatgtgggttaagaggatgatgctagtgatacctaatattgatgagcttactgtagctgagcgagtgatgaaagctgtggaagaactatggtctggaagatggagtgcagcagaggatgcaactgcggatgggtgggaggggatggaggaagacaaatttgggaaggagactaggagaggagttgtagccatagaggagaatctggagaatgtagtactgattcttctaaagactgaacataaagtcaagggacaaaccaagtattatattctctatacagagactggcacacaataaatacccataaaccatgatgatgtgtctacatttttaatgtctgatggctggtatataatttcctctcatgatatcacttttctatagaaaaagcatacacgttttatatgaattcatttggagtgggtaaatatatggattttcaaaaatgggaaaagattctggcaaattagatgataaaagatgtaatcgtttttttctagtagagtcatagacttggaggctaaggaggctcttacagatacagattttaaggttgcatatacttttgatgaagtcttatatgtttgggacaagtaaaggaaaaatgtgggctgtaaaccatttgaaaagctgtactcaaatctagacagaaggctttggtgacagataaatgtactataatcttgatcctggttgggtcaatgtttttatttattacatcagtagagatatgaaagaaatgtgacaagcaagtgggagttagacttgcatttaactactagatcttcagtgactgggtgggagagctacctgttagaatgttcagcacaaggtaacaggatgaaataaaatagaaggcgtcatagctagagtctagcactggggatatttgtcatgacaggaatttactttaaagttggagggattttaattcctatcaagtacaatataagccaatatgatgatttgctcttcacagatatatttggcaagtaatggaaaatattatgaaaaaatgatactgtaaggagcccatctttcttaataagcaaggggctttttggtgacagcagagatagatgtggctatgtctctgtgccaggcagtgtcttacttcccttctctgcctataagactgcttattatttcagaattgttttccaatttgtagagcagaacttaagaatttatcctagaacattttactttctctgttgttgagaattagtaaatagaattcattttgttcacctttttcctggcatttctaatcagaaccttcattcccaggcccttcttgtcaagatctttacctaagaggagctgagcaatgtgaaatgctcaactttcttcatatttcttttgttctttccctatttcgtatacacattgcaatgcattaatgtatttaatttaacttgattttgacatatggcactataagttttggtgagatttttaaacgaactatgtaggaaaaaaaacagttttgcagacttgacttggagtcagattagttccacatatggcagaaagcattgaaagctgtaaatttgtctaaaatagcttcttcccttgcaaggttggagtcaccaacctgataagataatttttaaatgaagaagaaatgtctttggcagttttcatggactcttgacaacattttcctacatgtttatttgaggcataatgtattctactttccatgccagataagccagtaccagttacttagaagcaggctaccccctcccttccccacccagatgatacaacccgtttgttatacaagatattgatggaaaaagaagtcccatcctagctgattgcttcagtgagaacatatttgatgctaatggcacagacaatagagcagtggaggaggcattttgcaattttttatgacacaaattctgatacctcatttaaaatcattacttagaaaccttattatttatgatttttagttctacaattgaaagtgcaaggtagcatggcacaaccagaagaacctgagccttggagcctggatttgaatactaaatctgatacttcttggttctgtgactcacagtccagttacatatcccctctaactctcattttcctcatctgtaaaatgggaattatgttacctagattatggagttgttttaagattaaataagaaatgcatagaaacatctagtacattgttggtgtgtaataaaatctcagtacttattaattccttccctctgcctcccctttccccactcctttgccttcctcaaaatgatggtggaattcatttaaatttcctgagccatataaaatgttttaatctggtgtgccgaccttggagcagagctaccctcattatgctatggagcttttagtgatgcagtacgctgcttagatgggctctcccagggagagggatgcatagcttggactcaatgatgtcttttctctctgacaagccactgttccctcttttatgcagctcctggagcatcggcctggtcacaaggaaaaggagggagggtcagtcagtttcctcctacccaggcagctctctgggctctatcataggatctcttcaggggtccacatctgcaaaaagcacagagctgccccttgtgttctctgtagaattaatagtggcagcatcaagtacctggcgggtacagacctcctagcctttctgcaaggtcaatttctagagcccacatctttcttgacaactagaagtttcccttcatgctgaattatgtaaattttatgaaaaggtcaaaagctcaccaggataaaaaacaaacaaacaaacaaaaaacactcctcaaattctctttcaagtcagataggattaaaatcttcccgaacagaatactttctagttaaatctatgtttttttctttttctctgcaccacgacctcactcattccctgttcccaccagcaactccttcttctgtgttgaaatatcatgtggatttctgatgacccaggagtgcacatgagattagtatggcctgactcttttcaaagtcaccccccggctcatgggcttaagaagaacctagacagcagcaggaactgctagcagcctaccacataggaagttagcctgagcagtatattgtaggatcccatagactgagctaagctttgttttcatcatacaatggattataaagcctgtccttaaataaaatactttttcttgtgctaaatgtgttctgcttatacctggtatggatgtatgcatatgtttatatatttcaatatttctaaagatatagtgcaatttcataattcagatgcatttttactagttggtaacattacttgagatacctaaaataagaaagacaagtttagtgattgttaaagacagaaaatcctttactcatttctttatagctccagaaaagaatatggtaaaaaatgttttgtaatggagattgattatagtgagatgtagattctcagctgaaaaatatggtagccgagatgacatcagtgccaagtcttttgtctgcatcacattcacagaccagcaaagttacaaaatcattatgaaaaaaaagcctactctaaatgtgaagataccagtttattctaaactactccccaagcaatagttatggttattattttggaaatttaggttcataattaatatggatatctgagtggaggagatttattttgatagagtctctcgttcacttgtttcctcatctactctgcttgacattttctgaaaggagactttctcttaaaaaaaatactgttttgtgataggcagtggtgtagatgtaatcagatgcccctttggctgcataaagattcactagtctttcctagcctgatgtccttgagctgatagaactgactgggttattttttttttttttttgagatttcaaagcctaaagaaatatggaatcaatgttttttttttccatgaaaacattaattacctacaatctgatttaattttgccatagcttatcttctttagctttgggccaaagctatttatcatttcttggaggtattcaagatcacctacagatggggcctcctaatagagcaaaagtcatttaagaaactcatgcacagcccttaggcctttctatatagcatttaacttgacttttttctgaaatccctaagatttgtgagtcttagtgtcatttgtagggttttctgatgtttcccttctctcaccttgtactgtttcacaaagttgtcaatttccccccccccctttttttttttgagacagattctcgctctgtcacccaggctggagtgcagtggtatagtcagctcattgcagacttaatctcccgggctcaagcaatcctaccacctcagtctcccatgtagttggaactataggtgtgtatcaccacacccagctaatttttaaaaatttttttgtagagatgggtgtctcactatgtttccctggctggtctcgagctcctgggctcaagcaattcttccaccttgggcttccaaagtgctggaattagagatctgagccactgtaccttaccaagttgccaatttttgatttctgtgtttcatgctgtttttatcaatgttagccatcagaagcctgcaattaattattgtcattacattttgttaattgctttaacatcaaatattaatatattctgtatatgtaactgccaaggggtttgcagatgtgggtggaattctttgaccagcacatcattttcctagtggttaagggtttagtggttaaggatttcactagcatggaattaggacaggatgaattagttacatggtttatctgtgcaggagcatcaccccaacataacgcctttgaaaacaacgacatattttactcctggacccagtaagggatgaaattcccttacccctcaaaacacgtgccttgattactgaatttttccttttgggcactgtattcttggaattctgcttcctctacttggacctcttttgggagatttatatcctgtgattgcttcagaattccgttgccatccattctttgttcatgtggaaacttagagtgcctcagtcagcagctattggtgtaagactcctttgttggatgcagggacaaggcaaggttggaagaagacttcttgcctctcaacattaagtgagcccttcacatcagtggccaactgttgaccaagatgtttaagaaacacaggttatcattgctctcaagaacttccttagttcttagatgtgattcatttcccctttgtatctggagcctcatggttgacctcagggatggaagcatattgacagtttcaggagagagtctttctatgtggtggaatagcacccaccagtatctcagctgggacagagggtcatctcccaggagccagccacatgtccctccttggccagttttgagacctcctaaggacagtgccagggttaataaggccttttctttaggcagcagtcactcatggtggcttgagtcacagatcagtactgaaaatctctcactgttattgcttctgtggattacagttaggctaggggttgacacagtaagtggattgggagagcaaaagcaggtggaatcagtttccttgagttttcactctgtaaggagtgaccttgacttcagaactctgtgcctaagtctcctgtataaattgggataacacagataatctcacttttctcacattgtcatccatgacataaaattagatatgttaagtgctttgtttgtattaagagtgctctgatactgcttttgactgggcattgtaggaccttgcgtcagaaaatcatatatttaccactgtcctgcaaatacgtgcactctagaggtttgcaacaaggctggtcctcagaatgacctgaggttgtttcgaaaatatagattactggatcttctatacttactgtgtgagaatctgcattagtattgagtcatttgtgtattaagaaactcccattgagtaattatggtgataggtctactttgggagatgtggtctagagtgcagtgagctgctcacactctgcttcttattcctaccttccgaggaccagccaggccatctggatctgggcctcagctttcttgtcattgacacttaacaacaacaacaaaaaaatagcaagttaaatcagttctgatgtcagtgctctccagatactcagtggacatttaaacaacacaaacaattctctaccaaccaggtgccctgtctgggtagaagtcttgatgtgtgattaacatctttactactgaaacagaggttatcattttctactaaaatttgtgtataactaattaggcggattgctgcagagagcagctaatatcctcatagttgtccatatggtagctcggttgattaataacatacatttctgcataagataaaactaaatactttttaattttatactttttagatttagagcattgatagtgattacatggctttatgtaagccaactggagaatgccatttccactgtggatataatcttatgggtcattgattaacaggttagtagtgaactgctgcaggatagtatggatatagcacgatatgaggagcagagagactacagtttcaaattgtagcttgatctttatttttgcgagagttcaaaatgtgcttttgaatattaggcattttgaagagatatgcaattgttaagcaccagtatacagataagaagaaaaagaaaccttgccattagacaacttggaaggcataaatgaattgccgacatctacaaaaatgatcaaggttatgcatggcaggatgttgcttaattgtaattttaagagaattcattttgtggtgtgtgactagctgagagaaaggcagacatcatacttaggtttgcctgtctatggtaatttaattattattgactattgtgatggcttccctgatgttgagttaggtacaaacctgctcaattcctattgcaggaaactttttaatacttaataatattttgacttgaagaaaaagtcttttgacctgaagaatgaccatttcaggactagaattgttttattgagttaccttttccccccataaagtaaggtaaatgctgtctgtggaacttcggcaaattagattttggttggactcttctgccttttttgtgaaggaaaagaggaggggtctgggagaaaagagggaacactaactgtgaaaccgcgtctatcatcaattgattttgaacttgcagcctcattaggtggttagtattgggccatccagccaaaattatctttttggccatctgtgccaaattatagggagtaatagccttgggcacagctgctgagtctaatgtgtatttctaacttgtgtattaatgataatgactgcatagagaagtccagtgaccaaatgtgcagaataaataagaaggaacaaaatatatgtaaatttagaattaaaagaaaggaaaatctctgttttacatcaggaaatgacagtacatatttatttaaatctctatgcaataatatgacctttttctactccatctcttcacagtttctcctaaggagaaataaatcttaagagagattggctttgaattttggtccttctatgtggtgcttcttgaatttgctctgtgataggacacgggttttattactgtatcccaacattgattgggccttttctcagctcagcctgtccctttaagagaatcactcaggagtgactgactgcctttggtgtcactgtactttttgttggtcagctggggccagcagtaggacctttataggcaggctaagtctaatgtcactagaaatataattaagaaattataagaaaatgagatattccataatccaatgactaaggataaagaatgctaagaatcaggattttaaatagacatgtctacattttgcatggccgttcatttctctaaagtatcttaactaatgaatatattggaaggaaacctaccttatagtgaaggaagccttttaaaaactcacccaaagaaagtgaaatgatttggcacatagaacatagtagcatagttccctatacatgctttacaattttttttccttcaagcctacctcatccagagcctctccatttttggttgttcagcacccaaaccttggaaacatccttagcttcttcctctcacaacttacatccaaacagtcaggaaattctgttggctctaccttcaaagtatacccagaatctgaccatatgtcacaacttcccactaccattcttgtcccagtcaacattacctgttgcttaaatcattgcagcagatccccagaaggtcttctttgcctcctatagactcttctccacacagcagccaaaaattttgttttaaaacctgaatgaggctatatttctttgcctaaaactgcagcagcttccatcccaagaaccagaccctgtataccatctatccctctcttatctcccattgccttgcccattcctgccttagaactggtgtctcacagttggtaataccctcggcctggaatgccctgcctcctgcctacccgcaggcccactgtcttacctccttcgggtctttgctcaaatgtcactttctcaatgaagtccattgtgatcactgtgcttaaaattacaacctgcccaccaccccaaccccttcactctcaattcatcttaccctgtatttttttccccacagctcttatcgattaaaaaaaaaaagttttactgagggaaaacttacatatcattaaagttcacccattgtaactgtgtacagttcagtagtttgtagcaaatgtatagcgttctgtagccaccaacacaatccagttttagaacatttctgtcaccgcaaaatgttccctcatgcccatttgcagttattcgccaccccctctccatcataggtaacctctgctgtgcttctacatctgtacatttgcctgttctagacattggcatatttgtcttatttgcttagtgcttagcatgtgtggttcaaaagatgaaggagctgcatatttgttaaatttggatattaccatatttcttgtgtgtgtgtgaacttatttgcagataactagcgtcaggacatggggaaattggacagaaatggaagagagatgtaggggtgcctgtactccatccatgtgtgtctgtcgggcaacaatcctgaggttctctgggtgtgcctccactgccctgtccccctcagggagatgagctgactcctcacacgttttctattaatgaatgattccatgatttcttcattcagttgtggaggagagcatggaatcaatgtgtactcctgcctcaatattcagtcatcaggggctctcagcctctccttccacttcctcccgtgtccccctctaccctccatcctcacagctgcccttctgccttcagcttccttacagcttctctgtgccactttctttatccttccatcccttcctagggactgttgtcactaatatctttagagatgtggcttccatcatgtcactcttctttctaaaaacttctggcaacccttgaatacccatagcttgattggtctcaaaaagcatttctccacctgccttctaattcttccccaatgtgaaccgtgtctccttctcagactctgtaaataaacacactctcaggaaatactgattccttgacaacctttagtgttatgtatttctgattcctaagcctctttgtcaagtaatgaataatttaaaacaaacaaacagaaaaacccttaaagcccctaggagttgactatttgaagaaatccagtaacttatctgtatatgttttcctaagtctgtcattctcaaagcatcacagctccaaatttgctgtatatttaccaagggtgtctctggccaccagagtagtgaagttatagttacaagataattccatagtggaaaaaaaaacaaatgtgtggttcaggctcaccagcatcaggatcagacttcagttccactaggttccctattgttccctgccagagggtcctggggtccctggccaggtggtactggggcagggctgggccccacagtggacaccttctcttctgggctccaccttccggcatgcttctcgtgtcctgcagatacctcatcagcattctctgtgctgctgttgctgcttctgactgctctggtcctccctgatgaccagtggtattaaggctgcctgtggaccacactgttcaccagccactggcctcctccacagccagtgggctttggctgcttgtagcttcctttctctcttcctgcagcagcagcagcagcagcaggggatacatagatggaatggatttggaaatagacgggcctaagcttgaatcctggttctttcatatacaagttatttggtcttgggaaagttacttatttctttgaaccccagtattgtgctctggggacagttacacccaccctgcagtataatcatgtgacccacatgcagtgatgtatgtaagtttcattgtctagtgcctgacacagactcagcacccagtacgtttttgttgttgactgttatgatattctaaagtgaactgcaggggcccaggaagctaatggctgctcccctttcactgaggacagcaggcctttcttcccaggattactgctctatggatgtagggtaatgtgaatgtaggcagtcttttttgaccaccatctacattttccattactcagtctctaaagctagcaaacaactatgagacatgggccacaccttattggcttgcatggcccgcctctcccctcttcctgccattctgtcattgcaggatgaaagttagaaaatactgatgtattctgtgttgttattgcttcttaaagctgccattggtgtttttgcttataaaaacattgccagttttctcagtaatactgttttactctgtaaagaatgcttatttggcacacagttactgggcatctgtcaagtgtcaggcattatgccaaaggctgatgagtcagtggtgaggaagatagtcaggaacttgtcatctctgagctgacactctagtggaagcatttatcacacgatctcacaattaagagtgagattacaatacaaataaatgctgaggaggagaggttcatggcattgttaaaagtataaagtgggaagctttgacctgctctggaggttgatgaggaagccttccctaagggggtttgaaggacatgaggcatcagtgaggcaaaatggagagattggagagtgtttcaagtaatgggaaaaaattctaggaggaaacacagtgtcaacacagtggggtgcagagagccaagggcagtgaagggggaaatgtgctggaggacgggtagagaaggactgcacacaggcctataaagataggtatctttatcagaaatgccgagaagccattgaggaatgattgtaatgatgaagtggcaggaactggaaggctaagatgagatctgattacaggggaacagtaatcagaataggagggcactggagtccattgatctggttcagatcaaaggtcatagaagtagcttagcctagggaggtgggaatagagaaggagagaaattgcctaaggacaactcaggaggtaaaattttcagggcctggtgctggattgaatattgagggtgagggaagagaaacctgatgactcctacatgggcgtaggtggaggtgtcattctatacaactgcaagtgcgaaggtaacattccatacaactgcattaatgttggtgccatttatatgggttatagtactaatccatacaactgtgtgattatggcaatattaaatttgagctgtctttaggacgttgagatgaagatatcaaataggttattgtgtgtttggaggtcatagaaaacattggacccataatatgatttttgattgagattgaaattgcctagggatagaatagatcaattaaatctcaaggaactgtagctcttaatgattaggtagagagggataagcaaaaaggagaaaaaaataagtgtagccagagaggaaggaagaaaaccaggagagactggaatcctagaagccaatgcagtggtgtgattcaaggagagagcatttactgatgcagaatgctgctgatatccaaaatgtagaggagtgaaagtggcaactgaatttgatgttggtcaagataaagcatgcatggtgactcagagaccaaaggcagactgcagcccagacctcattactatgccactgcattaaatcccagaaccatactatagccctgcttaagcagccccaagaaggcagagcttcccaactggtagaacagataataagctgagttacagaaaacaggcaaatgaacagtttcttgcacaccagactttgtagtaagattcgtacttactctctaaatgctgtatagtcattcatttagcagacgttattggatgctgtatatagaaatgaggtgagaggcgctccatgccctgaatacattcatagaacagccgagagaaaagatataacaataatacacccataattgtgatgtaggcataaggtaagcatcactaacacaggcacaaattgttggaattcagagaatggaaagcgtaatagatgatgtgaaatgtacaaatcaaaaatagaaacgtgaagtgcatagtcctggaaatcagataattaacaccttaggatttactgtagagtggcactgatagctcattagcctttcttagccattatttcttcctttgtacttttgtaaataatttttcaagtcttttcaagggtttgtttacaaggttgaaattttaaaaaataaattttgcttgaaaatgctttaaaaggtacaacttctatgattcgcctgttcaagtcagcactactttaataaagatagtgaaaaaggtatattttgttctttccacctgggttgacactggtttcaaaaatattaactttgagaaatattcttaccaaatactaaggcttctctctaggaagtggtgaaacaaacatgcattttgatatttaatttaagagatatcatgattcttacttatcatgtattttctgaaaaacctgttgttattcccattaagaattagccatacttaatctgatttaattcttaaataagttttctgagtgacttacattttagtcaaatgaaatgatagctctgagaagcattgatattattaagcagaagaggtttgatatgatgtgatgaccaaaaaacaatcaaggtaagactagatgttgtagtcaacttcacgtaatccacgaaagcccctcttatgctatctcttgaataagtgagcctgagaaagtatcctctcaggagcctctgtggggttccctgctgcacaaggatcacctgggttggtgtcacatagctgccttttttctctgatttgtcctttactgatctcttccatctaagcaatgagaagacccccaagaacaatttggaacactttcctctgacctcttactttttctctgttgtgtgtaattgggatgaggggtcaggtgcaggaagtggttgtcccataactttttgagaatcaaataaatggtccagatccttattcctatgcaaaatgcatgtatgaatatggtctcagagaaagaatgcagaaaaagactggcatatgtactgtatatatagtaacttaggtaaggtctgtttatggaacccctttagaaacctctgttcttaactatcttgggccatgatctgaaagagttccctgaagcacatgtgttgctctaacattctcctgctttacagccagcggttaccccacagtcactgtttgttagcttaggcttcactgccttttgcagcccaagatctgctggccccacttgtctgggtcagtccagactggtgctgcccctgtactactgctgtccccctcaccatcctttccagctactgctgccacctcgcacctgccagatgcccaacatgcttcttcacctcaatctcagtccaaaatctgtgcatcaagccatctgtgctcaatacccatttcctccatgaaaccattcctgattagctctaccatgcaataatttcccttgttctagacatcttcatctaatctgccatttagctgtggagagttgccttttgttgttctctggttatcttatgtgtgttttcttaatttgaaagtatatgaatgatagaagctatgtcttgaagtgttaaggctggaaaggacattagcattgaaatcctcaatcttttatcccacttcaggaaatcagtaacagtgacttgctacagctgtggggtgtgtgtgtgtgtgtgtgtgtgtgtgtgtgtgtgtgattcagaatatcccttcagggtcatatttgattctcaaggaagaagagagaggggagaaagcatagagagattgaaaaagactttccccaggttattctgatgccaccacctccctttctacctccatctctagttttttattgtcctcattctgcagagaatcactccttacggcagaatggctttcgatcaagcctgagtaatgtgtagcaacctgttcacctctctcttgcccacatgccacagttaaaaattaaattaagcattcagggctagagatttagaggagggactgtaggctaaaagagaaaagagaaatgagatgtattgttcatgctccctctacacacacacacacacacacacacacacacacactctgtacatacacacacatatatgcacatacatatacacatatacacataccagcatatagacacatatgcacacacatatatacacatacatacacacacatgcctatacatacacacatacattctaaccacctatcctggggtaaaggactgtgatagggccattattcttttcctcaaaatggatttggcttatggtaaatgcagagttcatattcctctagaaccagctcttaaagggttggtctcttggtgtcattcacacaagacctgtgcggtaatatgatatttacttctatttccaagaagaagtaaaaaaaaaaaaaaaaccttatactgttctaccaaggagatttctcacccacacacaggctgacacctgttttacttattactgctgacccccaatgttggataacttcacatcagctgtaaatcccacaaactgatttaattggattcctccacattttgtatgagaaagcagaagcccagggaaacaaactggcttggccagtgaaacccttagtagcagagccgggaccaggacccaggtctccgaggtcttgtctttactggttgctcttctttggctttgcggcccctgtagtgcctcgcacaaacacatttcataagccttcactgcttccttttccagttaaacacttcgagcttcctgcttttttcttttgccatatgcacagacacttgccccagccatctggggaagggaaaagtcatatctggcaggggaacgagtgtgcagatgcattctttttataattactgaaaagaaggttgttggaggtatgatttatttagccagcttcttcagatctagattcaaaagctgttctcatgttcagaaaatattttattttgtacaaaactctcaggacattaattccttctcaacctgtggtctcatttttcagcatgtgcctctcactgaaagctagttcaccaccagcattaatttgacccccagctgtattcgttccctgtcagttcttgtcctccaggctgttgctcatcgttatatcaaagatgggagcaactggaattagatgcctgtgattattaagacggtaattactgatcatgctgacaccagtaatattaactggtgtttaaataatttaaaatgttacctatgaggcatgcatgaattcaaggtatcagaataaaaggcactatctaaaagagcctaggcaagaataaaatatttgttcttgttttattcagatattctggcttaaaatgctatgcaaggatgatggacttcctctagtttaaacagttgtttttaagtttctttacaatagacctacataatatggttctaaggaatgctgtttgtggggaacaaattagttttattagatttctcaagtcattaacataacttaataacttaatattctactacaatggccccatctgccatatgggttttatgagtttgatgatgctatatattcatattgtacttcatagttcaggaagtacttgccaactcatcatgtcatttagtcttaaaagtattgtgggggatgtaggtttacctctgtcttaatggagaaataaatgttggctcagaaaggctatattacttgttcaagttgcatgagtaataagttgtgaggttagaagacgagatttgttggtgacttcacaacactttccaaatctgtgaagtgacagtaaactgtacaccatagccttgctgtacttgggaaaataaaagaaatactgtcttctttggtggaatcttctgaatctattcttcatcgaagaataaacagtcttaggaaggaaaagagcttttcatggacttacaagagcttttctttattggaagaatgatcgtctttactcttaaatttataattctaagaatataacatgacgttgacaactctttatttttatagatgattaaagtgtatgagttctgccatttatgagataattccaatgtgctgtgctgaatttctaggtctcttgttataaactacttaaaatatttttgttttaatttgggaagcatttccttgagaggttggatgcagcttccattacttaatttttatttattgttgtttttaaacatcatcatttaatcctagcacatggctgtgccagccctttatgctaattgtggatagtgcatggcagggataatgctaacactgtctgttgcttaccatgatgccacataactcaaaaccatgcttcttttgaagagttgcaaaaccacatccaactcccttagagcagaaatcccagcctgtaccctaagactggggcatgcctgtggggcaggccctttcagagatcacagaccttgtggagagaataaaggtgcacacacttagttctagcccagtgggccagcgtcagagcaaaagtttaatttccaagtgcagcacagtgcctaccactcaattgtcccttcacccaagcctactcagactcaagaccaagtcctagaaagagaggggtgctttaaaaagggtaggaaaaaaaattttaagcattgttttactgaaacccctatgggatcctgagtgcacaacattggtgacttgggcagcactggcacttaaaattttggtcattgtaggaaatggcattcttgggcagtgtcttcttcagagaagtgggtggtagcttcccgggggagtcacaggctttagagccatgttcagtgcttttggcatgaacctgggccccgttggtgtctacatcagtagattcagaggctggcattgttgtacagtgtggaataatgagaatgtggaggctgacagggtgattatggttttgagagttagtgagacaaaccctggaactgaggagctggtcttcattgtgtagttaaagtttctgcagttatgggtgtggggtataaggccagacaaggatggtttttaactttttctggggtcttagcttttacttaaatggctgggatataagggtttacatgaatgataagatgagattcatcttgtttcatggaaaaatattcactttaccaaagaagtatcaacaggattagtaagcttttagatattcaaaatatgagtttatttaggaaaaaaatattttaaatattttgttttaagtgatatctccttttagaccaatctaaccattaagaatagatatataatatctattttcagtttctggtaaaagaattttttaacgtgaatccttcatctggatcccatttgtggtgctcagttttttaaagcacttattatctcgtggcacaccatatcacttacttatttgccatgtttattgtttgtctgtcttcttgtgtagacagttagctccacagggcaggcattttgtctgttctgttcactgatatgtcccaagaacctagaagtgcctggatatggtgaccactaaataattacttgttgattcttaagtcaagaatctgtcacttcactgctatgagctaggaattattgtaattgttttgtgagaaataggtagtgaggaacaagggcctggataattattttataatattgataattggacaagtatgggagaaagcacggtagtggcaggccacttctgaatttgtaattttcatcttatgtttttgccatttttgccaatcctgctccaactagacctaaggtagatcctaatgagataacagctcttatattcccatctttccctttactattcctctggattggctgattgttttatactctggttacttagggggaaaaaagtgtaagggttaacaaatgagaaatgatggtaaaagaaaaacaaagggaacggccataaaatgagctgtgaattgtagaaaaatattgggttctatatacttattaacagtgggcacatatttaattctaaacttccttagtagtcattgtgaaaaaagcagcttgattactttcttgatttaaagcatttgtaaatgttaaaagaaatttatctgggaggccattaggctgagacggctccagcaccttgggttcctacctaagtaaatgaaaccagtgttaatagtaaaatgaaacaaacataaccagctgaaatcatcaactaaccactaactggggactttccaccaatcatatccaaataaggcaaacacctaactgtagccaatcaagtaatttcttagttttgcttctgcattcaacctgtgtaagcctgaagctcacgctgcacagctgagttctctgaacctcctctggttccaagtgatgcccaattcatgaattgttcattgctcaaataaactgttatatttaatttgtctaaagtttttattttaacataaataagacacaaccacatgttaggaacatcgatacaatttatttctttatactaagaccaaaaataaatccctctcaaggattctcatgaaaaggacactgtgtgattaatgtcatgagcaatgtcttacaagcatctttacagggttatcacatctcttctctgatgcttttattaatggcatacctcaatatatacagagatggtaatttgggagtacagatgggaaggtatattgccttttgtactctggcataataatgattaaaactaacactttcacggattttatgctctttgcattgttcttagtaattatattgactcattaaactcttataaacatgctgtgaggtaagtagtattatattaatcatattttatagaatgaagaaactgaggcagagaggaattaagtacttgtccagagtcacactggtagtggctggggatttaaacctaggcagtttgattacaaagtttgcacccttatcttatgtcaaaaggatactacacagtgtccttttcagagaatccttgagagggacttctttctggtcttggcataaagaaatgaattgtatgatgctcctaaatgtttggtttggctagatgcctttctggaatccaaggctagattttagaggatccagaagagaaatgaacatttttcagaaaattgtctattgtaggttacttagaagttactgggcaattgtgagagtttttgctctctggaaaatccctgaagtctagctattccgtgttactaatgctagacgcagcacaatgtacaatgagcggtgtgaattttagtcagacttacctggattctaatcctggttctaccacttattagattggtgatcttgggaaagttatttcaccttgtacgtcaaacttgaggttggttcatatcctctgcttggtagatcatcatagttggtattcctagacatttctccagagagaccaaatatttttgtttttaataatgtggagaaaaaaaattcaaccaagacatcagatgattcctgagacctacagaaaaattttgtgatgtaggtgtgtccttatgtgggcaagtctctttttttgtgtgtgatacataattattgaaatcataggatatactttgggtctgtttcttcatgaaataaacatgatggttttattttcactaatagtatttagcagttttaagtacaggatatcacaaagggtaataatatcttggttagagaatacacttttttaaaaaacaacattatgtgatcatagattttgtgcattaggaaaattaggattgatgaaggagggatttaacttcagtcactgtgatggatttgacagcctttttcccctccacctccccaatgcaattctctctcagatttatcctcccacttgtcgagctcacccaagcctattgactgagccaagaaaacatactccactctcctcctctttttctgactcatgcgaaaaagtcatgtagcaattcaaacatttctgaaattacaaaacataatgtagaaaactttcttatctccgactttagaatcttttttattattttgatatttgcataagtaagattttagattaatttcatttcttcagaggctttccctgacaacacagtaaacacctgttgactcaatcacatcacgatgttttgtgcattttagcagccattgttatccagtgttttcttgtttgtctatttactgtttattcttcttagaatgtaagttctgtgaaaatagggacattgcatgtcttgttttaaactgtgtcttctaaaggtaatggcacatagtaggaattaataacttttcaaatggatgagtctttctaaaatcctcatgcattttacttcatttaaattgagtctccatagctccagctctgatattctagttagtcagttttctcttcatgcaattctttttgccatccttcacatttgttcacacttgttatcattgttcatttacccagatccagtgtctctgggttcatttctaatgttgccaccatctaccccgaccagcctttctttccacagatgtagacttgccaccatctttttgtgtaatgttgactgagttagtatttgataatctcatttttatttttgtaaaaattgtgaatattttccatttgactgactcacagtggtgagtccatttgactgactcacattaataatacagattattaatgacatctctcatttactttcataagatcatatcttcagagttccctggtgagattaatgattttgcattgtttaaatattcatagtgtaattggtactgtgattccgaaagcagaacttttctctctttttttcccctcctaaattttaatatttcacaaaggtatttagtagtagtaaaactaaggaagggaaattcagtaggtaaatggtttgccactaataactggaattaaatttactgacttaaaaattttttacttaaatcaatattgttttttcttttttaatagtaaaattatggctagtgttttgagtgctcattatattttcaaagtgccttatcttgctgttcagttactctgtaaaaagcaggacaatgtaatattgtcttaaaacagagccacagtgtatttttcaaagccaagattttaaagtgatattaatttaaaaattaaaatgaaattttgatttcttttgagttttgatatctcaaagttgttaaaattatgtgcatattctgtaaaagacttagaagcacatttttaatgacagaggcaagtgtttttggaggtgtctgaaatttctacatttgtgttaaaaaaaaaaaccattagctctctaaacaagaacaatgtctaaacaatacatttattagtaagtgttctaggaacatagctcattctagcaaagagaagagtgggatgtgatccctgcccctataattcatagttaagatgtcagttaacatgaagctcaacccagctgaaggaacttcacctcatgcccacgttctttcttctaccttacatctctttttaaaaaggaaaattatgctctaagtgatagcttttatcagttgtcacgttaaaaaaaaaaaacccagacactttgctttacaaaatcattttaatcttactcctttacatgcattcctggtgtatggtaagtgctatttaaatattgaatgagttgagtgagtgagtgaatgagtgaatgagtgaatggttagtgaacgactagttacagtaaattctttgttattcaacctggccagatgtattttcatggaaaaccaaatattttatctgagagaattagcatgttcgtcacaccaattaacataaccagttgaatagctgagggttgtcctctttgccatagacattgatattagtaacaagacaagggcatttcacatatgactcttgttctactttgattccacaacagaagacattcttatatctgagagcccatgagatgatagtgagaaaatgcaattttgggggtagacatgtgcatatagctgtcattgatttcttaaactcaagaaagccttgtaatacaaattactcagtttgaacaaaaaaaaagtacttctcacaaaacgtgtaattctgaatgttttgtaagttaggttagaactgtgacctgatctaaacataaagtggttaaatagaaatttaaaacatgatatttaaaattttattattaataatggaaaaatatacatgggtcagactcacatggtctcggtttgatgataagggagacttcaacaggctgagtaggacagggaagaagccaggaccagcttgggttcaggcaaaggaaacaaactgagctgtttgcatgagaggagatgtcaacagccctatacaccttgttcctggagtattatgaatttgggctgcatttacctagtgtctgtggctagaagttgggtactataaggggacagcagcaggaggaaagtttgcgactaatactcagagtcaggtgagcagtatgttgtttctaggtctattttaaatagtttccaaagagggctgggccatgtggggcatgttggacagtgcgccaccccacaccctgtaccttaaccatcgctggtaaggtagttactgataccttagagtttgccatcactaccatcatcttaccatcatcatcaagacaatattaattgctcactattaatattgagcaatatgcataccaaaactggtatgtactttggattgtctcatttaattgtctgtctcataaatcgcattagttataatttagctaattaagttgtataccttgtgagataagttttatatattttttaaatttagcttttatttttaccagtgttatataaagagtcaaataatccacaaggcttgttatgtggaagtatagaagaggcaactgctttcaattattttagctgtttctttagatagcagcaggtcctggagtagcgttgttttgttcaatgccatttcattacaaggtcaatcagagaaaaaaattgattcccagctgggaccactgtctgtgtgaagtttgcacattctccccatgtctgcatgggttttttccaggtactttggattccccccacatcctaaaaatgtgcacattcggttcactggtgtgtctacattgtcccagagtgagtgagtgtgagtgtgtgtgagtgcaccctgtgatgggatggcatcctgtccaggatgggttcccgccttttgccctgagctgctaggatgggcttcagccacccaagaccttgaactggaataattgggtaaataattatcttacttgtttttattaatgtttcttaaatgtatgtatagctcatattaatttcattgtttaatattagaagtgttttgggcattttttaaaagaagtttggtgactttttgtgaccagaaatatgccataggaacttaactcttgtttttatgaattagcctatggtaaaattgaaactgcctttgtaaagaatatgacagcaagagaaatttgtgatggctgactccatcttgcttctagcctcacaggctggctggactcacttattcctaggtgtaggcccagctaaccatgggaggaatttagctaaagtctaactttgaagcaagaatcataatagctactccctaaaactgacgcttccttgttcagggactgaaactaccttttgtaagactaatgaaaggccacaagattaggattgtgagaggggcctgaattctgtaaagaggtgagcatagcttgcctttctataatcatttactgcactgtagtaaatgtatcatcacaaggtgatcacaagatttgtgacttccccagttgttcccatagataacatcactattgtagaacctaaggttggtcttttgagatgtttttcagacctttgtattctggtgaccaattgactccaccaggacccatgacttatgactcagccaggcctatggcccccacccagaggctgtcccagcacataaggattgtttaccacaaccctgtgagttcatccccaatcaatcagcagcacccattccctggtcccctgcctgctaacttaccataaaaaccctagcctctgagttcctggggaggctgatttgagtaataaactcctgtcctctcacttggctagctctacattaattaaactctttctctaccacaagactgctgtcttggtgaattagttttgtctgtgcagcaggcaagaagaccccatcagatgattacaaatttgattcattatacattgtttccaagaatctatcaataatgtatgtgagaacttactttatttacgtccatatttctcagtaacatgcttatgttgccagtcttggtttttgatgtttgagttgattggtttcccatgaaaaaagatgaaaatttaggtttcttgccaagcttgttggctcatgcctgtaataccagcactttggtaggctaaggcaggaggatcacttgaggcctggagttcaagaccagcttgaccaacatggcgaaaccctgtttgtactaaaaatacaaaaattagccgggtgtggtggcacataactgtaatccaagctactcaggaggctgaggcaggagaattgcttgaacctgggaggtggaggttgcagtgagccgagattgtaccactgtactccagcctgggtgacagagtgagactccatctcaaaaaaaaaaaagaaaatttagctttcttcattcattccctaaaatcacgccatcatacatacaggcttcccatccctccattctctcaattagttacactgatactttggttggatcattatttcatttttatatggttatgacaatctaaatgttatttatataatcaaaccatgattacttttcctttcctgcactacttttgtttttcattaatagttgtctttttttttttttgcttatgtttttatattgttatcaacaattcaatcctcaaactctcctctagctgtaaattgatagaaaccacattaggttttctgtttcaccttctggtcaaagtctctctggatctttctgaactcctctagtttgcctgtttttaataattgtagtttgggaacttccttcactatcacctgagaattcctatcatctctttcttgtgttgaatccttggtctcctgaatcacatgtcttccttttctcaatatgtactcccttgtttaggtggaaaacatcctctaataacttcctgggaaacaatgcctgggagataattgcttgtaatttgcaagtctggaaacatctttattctatttttagactttaaaaaaatgataatttgtttggatatggaagactacagtggaaaaaattgttttagttttctttccttcaatttttttttttttttttttttgcttagataattctcttttcttttcaaaattttggtgatgcttagatattcactcatattaaagagaaaaaaaactggctggaagctctgagcacatgggcaggcttgttatgcagcgattaccccataaagtgatctggttgagccatttatttgggaaacctatgatgtcagacttcttaggtttggtgttggcttagttatattccccagagagtaatcttctaatttccctggattatataaacctagctgctggcattctggaagttgaatggaacatgaaagcttaggggctccacattttctgtgtaaactttccctctctttgtttttcagatggcacctctaccctctactgaacgtggcattccccagtctagagatacttttattttctccagagagcaaatatccattctgtcactgggatgagacggacagtaaccatgtagtgcagattaggggaagggacctaagagttcaaactgctttttaaatagatttttttctcctagtttctctattgtcaactgtcttagccagcttgggctgttataacaataacaaactaccatagactgggtagcttaaacaacaagtatatttctcacaattctgaagcctggaaagtcaaagatcaagatgctgccagattcaatgtctggggaagacctgcttcctagtttacagatgaccatcacattgtggagaaacgagagaggaagcaagctctgttttgtctcttcttataatagcattgatcccatcatgagtgcgccactgtcattacccaattacctcccaaaggctccacctcccagtaccatcacattggatataagagtttgaacacttgaattttgggggagacacattcagtccacagcatgaacctcatactcataccattggttcctgagtcttttggatatatattccttgatgcaaattgagttttttctttgaattgcccattgccaggttggaatttgcctttcttgtctcctgctgagtcagttattatgcatccaactgttctgttctctatcttcaataagttttatgtttttaatttcttctcttgttctctttgatcttgggggtttattgttgttttttcatctctttactatagtttcagtgaggttatttcctcaagagaaagatgaaaaaaatattttaaattaatgtttccttaaatcagggtgtgagttgcattcagtgcaaacatttgaatggatatgtgttcaatctgccacttttaacttttggtaagtgtattagtccattttcacactgctgataaagacatacccgaggccaggcacggtggctcatgcctgtaatcccagcactttgggaggctgaggcaggcagatcatctgaggtcaggagttcgagaccagctaggccaacatggtgaaaccccgtctctactaaaaatataaaaattagctgggcgtggtggtgggtgcctgtaatcccagctactcaggaggctgaggcaggagaattgcttgaacctgggaggcagaggttgcagtgagccaagattgcaccactgcactccaatctgagcaacagagcaagactccatctcaaacaacaataacaacaaaaaatatacccaagtctgggcaatttacaaaagacggatgtttattggacttacagttccatgtcatgtggctggtgaggcctcacaatcatactggaaggtgaaaggcacgtctcatatggtggcagacaagcaaagagagcttgtgctgggaatctcccctttttaaaaccatcaaatctcatgagacttattcactatcacgagaacagcatgagaaagacctgcccccatgattcagttacctctcactgggtccttcccacaacacttgggaattcaagatgagatttgggtggggaaacagccaaaccatatcagaaagtttcatttttatgccccttttactaattaggaaattgagatgtggagaaatgtagtaacttcatgaaggtcacataagcactattggagccagaatataaacctcttcctccaacagtcttcttccagaacccactcttcttacctgtatactatgctgcatctccatgtagtacaggtttctcattttacaaaactgtagcttggaggtctccatatctttgagtgtgttgtgcttctcatttggaaagctttctcctttctctccatcctttagtgctcccctacttggtctttactcagtattctaacccacatgcctctcctttggtaggataaagtggtgcagcagaatgtaagagctgggtttgagtctcagcttcagcagctaccagttttaccttaagcatttcagcttgctgagcctctcctttttcttctgggaaaaaagctcatttaattcttataatgttcgattgttgtaagaattaagtgtattagcacatgtacatacatacgcctagcccatatgtaggcacttgaacaacagtgtttccccagttctaatgtttcttgcagatgtaagaagcacatcaggtttttcaaggcaaaaaaatagtagcacattaaggtatatagtgatttaaaatacacctccaattttagacattataaatgaggaaaatttgtacctctctcaatagaagaaaatgcagaatgtcttatactgttagggtaactgcaaatgtggatgttatgcctttgattataagctttttgatttatgccaaagattataagctctttgaagacacagactatttttaatctttttatgtcactcctgatatctagttcaatgattaatggaaatgtattaagcgcttagcacatatttgatgaatgaacagtctatatattaaaattcaaaagtaagagcatttctctatttgaaaatggagtctggattacatctagatcataaatttgggaactctaaatctcatattttctatttgctaaaaggcaaaaattaatcactggagaatggtcatttgctattggattaagaactttttattacaggactttctaattaaaataattacatatatgtagaatgttcattttgtcatattataaagtaatatgttatttatcatacaaataatttctgtactagcaaaacactcaagatctacattgtgtcatctataaagatgaagatgaataatttattttaattttaactggtgtgaaagctttaagaaattccttaataaaaaaattttcatagcaatatttttaaaaagcacctcaggatgttataattgcaggttaggttattttgacaagactgtgtaactgatccatgcattttatgtttctattcatagaggagtgatggagctaaaaattaaattaaaataagagctgaaaaggcatgtgctaatgtgactggaagaacttacacattatattttaatttggttcccaaggtctccagctgtattcatgagggtgactagataccttatccttattcttatataaagaaacttttattatttaatgtaacattattttagggaatgaatttcgtaatacaaactaaaacatcatgattcaatatatgcaaataatctgtcatgctcctcatttttaaaacagaatacattgtacttttactttatctgctttggaggattttgtaagaataatggtagtccatgaggatttaaaacagtgagcaagatagatgtggatcctgcccatatagacaggatgaccagataatttatcatccaaactgggaaacaaaagagaacaaatgggatgtgattagtaaattgcactgggacaatatgcaaaacataaccattccagaatgaatgatcacctcacttaaagaacttattgtctagggaagggttacaggtagaaatgaaactagggcagtagaccccccaccccaacaagtaattatatagagtgctgattatgctgtgagtggggatctataggtgctattggatcatataggagagtaattaactgtgacctgggaggatcagggagggcttcccagaggaggtgacatctgaaacctgcaggatgaataggggttaaccaggcaaaaaggaggggtagaaagttctaaacagtgaagatggcagttactggtaccctgaggggagagaacaattgagtgttgatgagtatgtctgtatgactgtaaccagaagaagaaggatcaagtggtaaaacacaaggctggtagtgttggaaggggtactaatttaagaagtttgactttatctcaacagctttaagtagggcagtgagacgatcaagtgggccaagagctattgcctgtattcatttgatcatcatgtatccagttatcttggctagaactggatcttcacatctctcagcacgtggagctaggcaatgtttccccacccattggaaagaattcagaaagggtcatatctgacagactagtgggttacccatggaaggtagctgggtagaaggagtgccaaggaaaaaaaaatcaccctaagttatgcagaaggcatgcaggtgcacacacagcttggcctcagggatggagtgttgggaggtgatggtgcttcaagcatatggctgtgcgtctacactttggaccctcatccctctctgcttggacccccacagtacttatgaaagctggaagggagtgttctggtaaaacaagcaaattatatgcctgggtgttgaaagcaacttcccagagaaaatttcctccaagagtggtggggtttagcacctagagaaagatgagcgctgattggaaaattgaaagctgggggccagatgctccaagaggacagtagtggagaggccactgtctcaggccccaggaggcctccaacgtcatggattcctcagcatgcctgtggtccagctttgtctgagcagagcacagaccatcccagacctggaggtagtgtggtctgcaggcccgggacagcttctgagccacagtagcatggaagagactggcaaagggctgccataacaaagtaccacagactgggtgacttgaacaacacaaatttattttctcacaattctggaggctacaagtctgagatcaaggtgttaacagggttggtttcttctgaggcctctctctttggcttacagttgctgccttctccctgtgtcctcacgcggtctttcatttgtatttgcatgtgttttaatctcttcttagaaggatgccaatcattttgaattagagcccacccagtaaccttttaactttgattacctctttaaagcccaaatctccaacacagtcacatactgaggtattggaagcttcaagacatgaattgtggggggacacaattcagctcacatcagggcctccttgggagacactagcatgcggtggttgcaggttctgatccttggcctttggtttctatggatcaggaaggcctaggagcatttgaatcatcttcagaacaatgccaagtgtcttatggtcctatttttcacttccagtgacagaggtattaccttacatagtctgtgtgcatcttagattattggaaacttcctttgtactgttggtctttggtctctttagcacttcagggtatgactgtgtcctagaatagttcccttttttactgttaggtgtggttaagggtatgggctctgttggatttgaagcctgatttcactatttattacttgtgtgtctttcagtaaattccttgacctcattatgccttattatccagatccatacagaataggggtagtaaataagctagggagaagttagcactgtgctgcacacttattacatgtttaattaaggttttatcatcttcatcattatcatcattgtcatcaccatcgtttccttttaacacgacactgagaaaggcctgcactgccactcacatgatgacctgtgcaggaagaggaggactagcattttccctattcttactgaacaattctcgtttaccgtacttttcctggtcatcttcccataacttgtctttcccatctagaagcccaaaacccctttacctttgattatcctaagatcgtatgtaaggccaagttctaaccactcctttgagttactcataactaggggctcccacatgtatttatgttgaacatgttaataaacttctgtttgtttttctctttaaaaattataaggtattattggagtattacactaaaacattatcaaacaaatatgtgataatagcatgaataaaccagtgttggcaaaaagagtcaaattctgtaaaatattttgaagggatttattctgagccaaatatgagtgagggcccctgacacagccctcaggagatcctgagaacatgtgcccaaggtgttcaggatacagtttggttttatacattttagggagacataaggcatcagtcaatcatgtaagatgtacattggtttggtccagaagggtatgacagctggaagcgggggcttctgggtcataggtagattcaaagattttctgattggcatttggttgaaagagtttaattattgtctaaagacctagaatcaacagaaaggaatgtctgggttaaggtaaggggttgtggagaccaatgttctcattatacagaagtaatccccaggtagaggcttcggaaagaatagattgtaagtcagttgtctcctggatcaggaaaaaaatgaaggacaaggaaggggattctcttcagaatgtagattttccccacaagagtgagctttggaggactatttcaagacatagcaaagaagacatatttggggttaaaatattttgatttccttctttatctgccatgtgatattatgccagagtcaggttggaaagtcagccacattatatagggttaaataaaaccccttggatgagattttttggtttgtagggcatgactccccagaccccttagataggaatttgggcagtagaagaaaaaggtcagagttgagttcttcaccagtctcttatatgttggtaggattggtatgcatccacataattaaggtagcttaatttttggtatcttatgtttattgattatattaaactaacttaccttgtctggtccttctttctttgtatgtcatcaagacctataggacacttacttttttcctaccccttttgttactggctgggctcgttctgcctgtatgcagcaagctaatcactgtggtgacagtttttgcaaaaaagaaaagactttattcacaaggctgcaatgtgcagggccagggaaataaatctcagatctacctctctgaaaatagggcttggaggtatgtatgtgatagaaagtggggtggtctaaagtatagggaaagatgattggtgagtcggaaaggtgaggtaattagggcttctgcacaagggtaattgagctgtatggttcttcataggatatatgtgcagaaaatggtggcactagcataatgtgataatggagtttttggctctctgatatcaaaaaggtccctcttcaggcagctgttgcaggcccaacctgtgcaaccaacttgtgaagttgaaggtctcaactggcttgaactagacaaaagctgccccctagtttctgaaaaataactataagcaccgttactaccgtgacccatagtcagagacgttacccataaggtaactagtgggagtttagttatgtatttttcggtcatataacttgccagtggcagttttaagatcaactagaagtaagtaattaaaagctagccagctagtttggaaggcttaatcatgtttcacttgctcactattatggtttaataagatatttattttgtctgtgtaaatatattttcaggtttgacttcaaaaaaacccaagtgagactctagcaactttgaaacattttaataaaaataaagactattaagaggttagaccccatcaatcctatgtaccagattatatttgaaaagagacttaccagaaatggagaacgttccactaatgaatatttcctaagggtgaggatggtaaataatttcaattatgtgaaaaaattgctgtattttaagaaatttttgctgtgtttctgggggttaatgcccagcttcctctggagagcttggagacgggggtctgagtcttcaccagctgtaaagttgtcttgagaacagtccttgaaggattgctgctatacacattcttggtattaaaaacactagtatttggcatatgaactacattagcaaaaagtgaaacaaaagaaaaaattcacagagatacctgtcactggagcaaatcactacatgattcatatttgtattctataataaaagaagacacacaatgatgtttactgagaccctgtgatgtgtcagcctttgcactaggtacactacatacactatacagccccctgtgataaggtgatattatctgtatttttagaaaatgaagaaactgagtcttgggaaaggtaagaaactaccctagcctagctgcatattgatatgtgcaaacagcttcattttgtaaaatgtgtgttttatttttgtttgcaagctggatttatttggttgtatttttcatcacaaagactgaaatttgtggtactagtcttttgggggtcattactcactttgagaagttactacagtagctgaacttttacactgttaaatgaaaaccactatgcctgttgtaggggagggggaaaaatcttttttcctctatcttagatttttcagcagggcctccatatgttagaccaccaaagacagattagcaagagaaaaacaaacagaaatttatttccatgttcatcacagatacatgtgggggcacccagtgatgactaacccaaaggagtggttagaacttggccttatatacgatcctaggattatcaaaggaaaaggggtttggggcttctggatgggaaagacaagttacagaaagatgactgggaaaagtactgtaaacaagaattgttgagtaaggtttgttgtgcagattgaagtcagtaccttctccattgataagagttaggagtcctcctcttcctgttccaggagaggaagagaacttcatttacaaaaagaaattatgaaaatgttctttataaatgtaaattttctttacaaaaggaaaacggtaccctgtgtttagagctactcctgcatctgctggttctcaatggcttttaggtcaaaatgatccctgtgctgaggaggcatattttggggtggctattctggtaccctccctgccttgcttttttatagtagttatgcaatagaggcaaatcccttcctccttcccgggttcattaagctgaactgagaggctgatggatacttaaaattttaacatgttttattaactatttttatacattccttgtctttaaatgttcagtaaaatcaataaattctctgttcaccaaaataatattgccattattcagtggttgaccacaaagctcctgaggtcatgcccaaggacagggcctacttgaaaaagagctcagaggagcctgactagggtttggtctggaagagaatctttgtcatgccaatggctcagaagattgtagatgatcacagttgaaagagatctcaaaggtgatcactcttaagtgacagaaaaagagccacctcatttgcttccagccccacatagcactcccctggggtttgtgataaatgcagttctatctcttgagagtgtgtgagcagccctaaatgctggctacctggagagcaactctggccttttttcatattgctctgcttcctaatgctccactcagctggctcagctctgattatttctggattctgaggaggggaactgcaggagactggcctggatttccctgggctgtaggggaaaacagccttgggttaatccatgtgcgaggcatgggaaaaagtgcaaggaggtgggaagagggagaagaagtgtctgcctggagcttacaagtagccatgttgttcactctatttatggtgagagaaactttttataaaaacaaatatatggtcgggcgcagtggctcatgcctgtaatggcagcgctttggcacgcccagatgggtggatcacaaggtcaggagatcgagaccatcctggctaacacggtgaaaccccgtctctacttaaaatacaaaaaattagcagggcgtgttggccggcgcctgtagtcccagctactcaggaggctgaggcaggagaatggcgtgaacccgggaggcggagcttgcagtgagccgagatcgccccactgcagtccagcctgggcgacagagcgaaaccctgtctcaacagaaaaacaaaacaaaaacaaaaacaaatgtgtttgctagcaaattttaattcaatatatacattttaatcaagtatataaatatatggaggatatagggaataataaatagtaaataatatgtagtaaaaatagtaaatataacaaaccttttccagtggtgattaatccttaactcattttaactcaccttttgaaaaaaataatttcaacttttattttggatttagcatgtacatgtgtaagtttgttacatgggtatattgcatgatgctgaggtttgggatacggatgatcccatcacccaggtaacgagcaatggagttttttagcccatgcccccagtccccttctagttgtccccaatgtttgtgtttcctatctttatgcctagggatactcaatgcttaactcacttagaagtgagaagaacatgtgttatttgtttttctgttcctgcattaattcgttttgcataatggcctgcagttgcatccatattgctgcaaaggacaagattttcttcttttttacagctattaatacatagtattccatggtatatatgaaccatattttttaaattcagtctaccactggtgggcacctagttaattcacgtttaaaatggtgtccattcccctaagctttgtagtatatagcggattatgattcaacaattttagaaaacacctgatttagtgagttggtctccaaacgataaatgtctgtaaaagagaatttcatctatcttattatttttaatgatcatgtttgaaatgaagcatatcaagttagacttattagttagatgccatttaatttgagattattttaactttaggatttttgctctccattcagttgttgggagtgttttaaaaacactggactttcagaaagattaaggtgttacaactccctatagtaatcaatattctttgcagttttaaagctcaagtgtccatgcctgttggagtttgtgttaggctacaaaagatgagtttataacctagattctgaaaggacactgtagcaacattaggttgctaagcaagtcccttggctacttaaacaacgtgccttgaattattctgactgcccgtgctgctcagtcataatggagcaattaaaaaatgacactcacttttaggtttgtccagacttaagttagaaataaatggaagtagagacatactatttttaataattaaaaaaagaaaataagaaataaaaatatagttgtgtgaaaaatgttcaaagcaactcaacaacctaatgttcaataaaatggaatacttaaccaactatgatatactatatgaagtatgcagtcataccaattgagggtttgtacacaatataacaaatattatatttcactcagattgtaaatcatagctctctcttttatacaaatcatcagaaataggcacagcttaacatattcctttcataagcactttcctcctgttattgctttccaaaataaaattgagacagaaggaagcctatttagcttatccagattataattaatttagccacttgggtgtattagaaaatgggagctagaccctctactgagggttgtaaagtgtagtcatggaccaggacccagactattcaaataatttatttttctagtcagagttactccagtgattaaaaacaaagacacgggatgggggcagggactaaatgaataaatgtgcttgaatagccaaggagcaatttcaagcctgacaactgcatcctgttatatatttcaatcatgcaatattgaagcccctataagaatccatttttcatttcctactgatttttattctctctctatgttattttttccacctacttttcagaaatctgctcttgaatggaaaattatatttctgtagacacttagccatgaggtacttgattttaatttaattccactaatcatatttggaaggaaaataaaatctctataaatgacaagtcaactagtatttgtggtttagatcattgtgtctttattttatccaatcttaatttctttcctttggccattccatctcttgttttaatttttacttcaacacttaattactattgttgattctcaaacatattttacttcctagtccttgaagcttcaataatgtgaaaacacttaaaaatatccagaacaattacttgtttgttaaaggagcattgtgtcagaacgttttatgtggacagtaaagctctccaagctgtctccctggaattcagaaactttagcatcaggaagacccagagtgtgcttttctgcatttagctcaatgcacccttttctcttgtctttttattcagctggaatgcttgctgattcctctgcacacttctaaggctgagaacctgaggaacccagctggaaaatgccgtctgaacgctgcctcaggtatgccctgtaggatatgtcctcacatgccgtagtgagccctgaaataagtgcattgcacgttctaggatcaagcacaaagcaggggcttaatgcatatttgaaggaatcatcaaactagtcagagcttttgtgaatttactgtggtggcacaaggactaactgctgtgacctacttatttgtcaaacctaaatatgtttcctgattctttgaatgatactattttttaatctttttttcttatttaggatgctaacttccctcaaacatgaggtatgctagtataaaggtatatcacataaaaaaggaatcaaaaaactatacatatatatgtgtgtgtgtatatatatatatagatgtgtatatatagagagatgtgtatatatatatagagagagagatagggatagagaatgagagagagagagagagagagggagagccctctctaaggcaatcactttggggagtacaatgcttattctcaaaatgctcacaacatttccttttaataattcatttatttaatagatattaattaagccaaacactctgcttggtgctgaggacccagctatgaataaaacagataaggttccttccctcttaaaatgtatattctatggcgaaaacagacattaaacaaataagcacaccagtaacgacacaaaaataattgtgaaagtgctctgaaggaaaagtacaggatagatagagcaagaaaatgccttcctgagaaaggctgtatacctgagatttgaaggggggcatgccctgaggcaggaaggagcttggcacattccagaaactgaggggcagccaatgagaaaatgcatggcattcatttgaatagtctcactggaggtaaatctgcatcatcctctgagggaacagtcaaaatatcttcagagcaaagaataagagagatgacaaacctggggaatacatttttcttaagaattgggtgtctgttaagtaatgagaccagcttctttccatgactctgaagctattagaggtgatttgttccagaaatgtgttgagaactggtgacattgctgtagcaggtgtaacgcctctgcactccctatgtgagtctgttgctctcaatcagtgattctcaatggtggatggttttgccaccagtgtacgttgtgcaatatctgacaatgtttttggatgtcacggggattgtggatacatttggcatctactgggtagaggccaggaatcattttaaacatcttgcaatgcatagggcagccccctacagcaaaaaacaaaaaacaaaaaacaaaaacaaaaacaaaaaaaaaaacatctagcccaaaatgtcaataatactgaggctgagaaaccctgctctagacctggcatccaaccaatacagcacatggagaccatggtgtctgtctgtcaccacctcagccaagttatttatttctggctaccaggatcagtgtgcatacttaaaataattttttacttttaagtctgccatcccgttcttattaatcaactgtcttccacagtgcagtaatctctatgatgttctctccttctctgcttcaacccagagccctcccttccccacctctcagactctcccactgtgccatgtggaagtgtcacaacacaaccacatgctctgctgtatcatctccttgtcctgaaaagctctgtttgcctccgacttcattgagacccatcctcctctgaggaccatttcccttgtagccctctcaaagtagtggcattattatttcctcacatcccatgtatttcaaggatgggtagagagagtgtcatcctcctagggcatggttttgcttctagaccattactccacaaattgattgtttgagaaagccacagccacaaaaacaacaaagacatgctcttctgaagatgatgccctttatctctctcctcttcctaactgtagtcggggtcattgtcctttattcactgagcatttcggcacttggcttgcagtcttcctcctcatcacaaaccccttactacacccccagggccctcatgtcagcctggaggatatgtctgcttcatggtccttggaccctcaatctgcttatctccaaagaccatctccctgcactcagccactcagtttcatggccacacctcagaccttgttatccttagtaattgctctgtttctgaaatcacgctatcagccattttactcttaccacagcctcctctcctttttcaaaatatggttgtactttgacctcattgtaatgtctcattttctggccctgctactttctaccaacccatccagtctttcctttcctcattttccttcttaagcagtttagattctatcactgttgctaaacccttaagttctctcatttcctgtatttttgatgcatttgcttgagaaaaccccaatccagatgaaccgatctattcatatttccatgcctacgttgtctagtggagactagttccacaaaaatcttcagattcaacaagccaaaaagtgcccagagttttagtatgtgattctggtccactgattccctgccactcaagaggcaatcctttcccacaactaggccaaaacctgcctctgtgcttcaaacttatctttcatatcttctcagcaacctttgagtgttgcttgtttctcagccatgttcttgagatacagctgtgttgtcaccttctctatgcagatgagtctcagatttacatttctagcaaagactcctttctgagttccagatccaggaatcaaactacatatttgacatttgtgcttggatgtcttaaagacaactcaaacttaacatgtcccaaaccaaattcatcatcattctcttctacaattctgattctctttcatttgtttcctgttctggaaatatcaagttgtataagccagaaatataggtgtcttctggaaatcttcctcccactcacctccatatgtaatctaacaccaagacctgtagattttcccactaaatagcttttaatcccattcacctttctgaaacttcatctgagtgctccttgggctccaaggcccaactccatcattcagctgaaccacagccacagtccaggtctgctctagtctggcccagtctcccctactgctcttggtactacagcttgaatgaccttttctgtgacttcccattgcccttaggataacctggcccagaattcctgcacaagtgggctcaggcctctgctgctcgggccttacctgcaccgtgttctcctttgtccctagctgttaactttctgtagacactctataagggccatgctccctcctgccacaggatcgtagcatttgctgttctcctgcctggaaaaccttctctttcacttttaaaagattaacttgttctcatccttcagccagcagctcaagtattatttctttagggaggccagattatttgattaatgtgtaactgccctactacactgaatgttccatgagggctgctaccacatatggtttgctcaccattttatccccagtacccagcacaacacctggcacaggcttaataaatatttgtggggtaaatgaatgagggaaggaaggaaacaaaactattcattcataattaagttcctttctacagagttttcattatttaataattgtctaagcatactgtatcttctttgcttattactatgaccattgctattagttgatcaagttcattttaaagtgtttataaattataaagtgttctatagaaatgaaattattttattatagggtcttttaatatcctgctaccttaaatataatttttaaaatattaatgtctttaattttcatgaaaagattttgactacataatttaagtgatttaagatgctcacttgatagttcaccaatagactgaattgagataattatgcataattattactgttagatttttttttgtccagcctttttctttcttgtgtaaagtagcctagttaagaaatgagaatctttatcccacttagttgtttttaatatgtaagtatgtaacaccttattggtagtcttacttaaaaactactgcatattttttatatatccaggttgtaggtaaacactgacatagaaattgacttgaattttaaaatttgaaatgcagatgtttaaaaccatatagctgttttcggaatttacaactttaaaactgacagaacttagtcaaaattctttccatgaacatcaaaccctataggatttctgtgaccaaaaatgtgaactctgtgacctcagagcagcaatttgcactaaagcagtgattcagtctgagtagggaatatgatataatgaacatcgttctctgcatttgatttattagtttttgtgatcaattccagaatgaaagttaaaggcttaaagttatgaataatcctctttcctgagacctcgtttatttatttccccattactagatactgacatatggctgatcaaatggttgctccctggcattactaaaaggtcatcttactgttcagggagtctggggctttccattgttgcatgagggcctatgtggggtcctgtgaaatacagggacagcagttcgcacaggcagcctgacgggggttgcctaaagccgttacagtgttcaggtggaaaaaaacagagggacatatatccctgggaactcatagagtatccaatagaaccataatgagaagcatatctataatttaaaatttcaggtagctatattaaaaagggtaaaaaaaaattttttttctgttgttgagacagagtttcactcttgttgcccaggctggagtgcagtggcgtgatctcggctcactgcaacctctgcttcccgggttcaagtaattctcctgccttagcctcctgagtagctgggatacaggcatgcgccaccacacctggctaatttttgtatttttagtagagacggggtttcaccatgttggccaggctggtcttgaactcctgacctcagatgatccgcccactttggcctcccaaagtgctggtattacaggtgtgagtcatgatgcccagccctaaaaaaggtaaaattaattttaacaatatattttatttaacccaacataccctaaatattataatttaaacatgtaatcagtacagaaatattgagctattttgctttcttttattcatattgtctttgacattcattgtgcattttatatgtatggtacatctcaatttggactggccatatttcaagtgctcagtgaccatgtgtggttagtgtctactgtataggtgtatccctacaatagagtattactattgtattgatacaacacaatacaatagagtgttactatggtattaatatagcatatactcttttgtattgatgcagttctagggcatccctcagagaaagaggttgcattggggaagccaggacactgtctgcactcactgatgaattttgaggtggcaacatggcttctgtgggagaccttttccagttttaggatgacactcaaatctgtgtttccttgagaaatatggttcttgctttcagtcttttttccagaaatttagaagttttaggatatacttttccttcctttatttctcaaaaaattgagggacattgctctaagttgagaggcttagtttgctaatttgatatatgttctagatgctgagggagctgtttgcaagcatgtgtctgctccccattttaatttagacatagtgcattacagtcttcgatttatctcctccctggtttatgactattgacttggtgaagtgggcgtgctcccttccagctatgttctgtggccacgtgtgccttaacatttagagggttgagatgttttacaaatttacatccaagagttgagtgggaagttactttcagaatacaataatgatttgttgattaagaggcctttatttcttgccaaatgttggagtatttgtttctgcttttaaggatccctaacatattggttccaaaatatttgggatcttgtgccaactgttgtcttaaatatttagcttgttgttttcttgaagcttgaattttcaagcccagctgaatgatcctgtgaaattgtgcagcatcactattgtttaaaagctgaggcttttattctttgccaaatttcagtttacagctgctctgtttctggtaagatttattcactctcaagagacatataaaatgcaaataccgattcagtcttaataataaggacaggaattgtggcactatatttggaaaactttttaaggcaattatcttaatatattcttcggttccactacaaatgaaattttgaaatacatttatttaacatttaaggtgatataaaagtggagaaagtaagttgtgaaagtttcaaatatattttctaaggttataatgattagaatctattttccatcccaaaactttcagtcacagtatgaagataaatgtttttgaagaaaaatttcaaacatttcttactgctgtgtcatgttgttctgttcatgtatattattctaaaaggctgattttgagattcattatacataatataaagttaatagggacttacatggttttttccccttaagcatagatttttgagatctttacagattgcctttttttttttagacagagtctcgctctgttgcccaggctggagtgcagtggcatgatctcagcttactgcaacctccacctactgggttcaagcaattctcctgcctcagcctcctgagtcgctgggattaaggtgcgcgccaccatgcctggctaatttttgtatttttagtacagatggggtttcaccatattggccaggctggtcttgaactcctgacctcaagtgatccacctgcctcagcctgccaaagtactgggattacaggcatgagccaccgtacctgacttcttctctttttttttcctttaagcaggaggaggaattacattgttatattcttggtgataggttctcaaaataccggatcttggaccttcagtttttctatctgtaaaatagagataataatagtacctgcctcatggtgttgttgtgcagattacatgaactagtcattgtaaatcactgagaatagttcatgggacacggtaagcactatgtgtttctcaaatatattaaaaagtcatccttttaggaaagatttttcaaagactatcctaaagctttacttggctgatacaatgtttctattactattccatttcttgatttgagatgctaattaattgagtgatgctaattaatctccattctagactttgcatagaaacttgcaaaaaattatttatgcttctgaatgtggtttttaattactgattttaaagtctgcctatagcttgagctactagatgaatattcagtgacagtaaccatttcaaaactcactgctacatttcaactgaaaataatcctcccaccttcccacaggaacttcctatatcatcaccgtctgtcaagttttttctttccatatttctgacattctgatgcttcccagtcaaaactgtccaataaagcttaatgactgccttctggcatttcacaggaagtatttggttaattttaagatggtgatttgtacctaactgtaatttaccagccaactggcaccacaggctgagcagagccctgccaaataaacccaccatgcaaactaggctggtggcaactctggctcccctgagaaactctttcacattcagagggaggggttggatacaggaattaccaacatgggagagacacagcttaatcatcccaacggtatttttactcagctttgagatggatctgctggccagaatcagggcttgatggctcttgctttcactctgggagtaacctattcctggcagatcacctgtcttagtccaataccagttctgagattttagagcactgtatagattcccgttgatataagctggaaatgtccatagctgtctgtaaagtgaaagtttgcattttgtgtttatggcattacttctgtattattgtagaatgatctagagcttcacctaggacttttgaaaggacataaggataaatgttttaggttggggtagagagtgaaggggtaagtttcacaatgtgtgaggttagcaatctcacaaagtagaacaaaaagaaaattatatagtcattcataaatccagtataatgatcacacatagaaactaaatgctgataatagataaattttactttcagctttaaatttgttttcatttacaatgcattccttttgatgttcttatggtgcacaatttccgaagtttaataataagcttctctggtttaattgccttttacatggaatggtcatttgcagccctttttgtcctaacatttgctcagttttcttgtatgtgttaacagagtcttgtgtcctgtgggagacatggtaaggtacaaaggtggggaaggaatcagggaattagagagaggggacagagtgggaagggtcacacacacatatacacatgcccagatgcacatccagaggaagttttgcactcagagatgttcacacactgaagggacgggacccagaaacagaggcttgcaggtccagacacctgggtcagtatgcagccacagatgaacacacacaaacacaaatgcagaaagagatgcaccagtaaaagagagaaagaccctgcagggagggaagcagagagaataagaaaaagggagaacaagagaatggtggagagaaagaaaatgagggaacagatggtcacactcatagagtgcactggaacccgtgttgcctcagtcgatgttcaaggaatgagagagcagctggcccacagggctgggaaaaggaaaaatgttgacttgattgctctcctttgtagtattcaagaaatgctgacaggccagaggctctgccactccgaatctcacaatgacagtgtcctggcagcgctgaatcagcagaggagtgatggcatcctctgcgacatcaccctgattgctgaggaacagaaattccatgctcacaaggcagtcctagcagcatgcagtgactatttccgggtaagtcagcattgtttgtttctcgtaaaatattgataaagagaggatgacaatgtttcccaaactgtcactaaaccaggagccaattaggtggtacccccagagctgaatggtgggggcctttgttctttcctgggtagaatgcttcctggggccccattgggtcctctctgggcagggcacctggatgtccctccaatgtagaacagacctcccttggcatctgagccaaggagtgcttggcactttaccaccatgggaaaatgtggcactgtagtgcttcatgtgggggtgcagactggagtgagaggatgcttctggattcaggatcaaagaccaagctataagacaatttgttaaaatttaaaagtctttaagtatatgtattgtttcggatatatatatatatttttgttttgttttgttttgtttgtttttgagacaaagtctcgctctttcacccaggctggagtgccaatggcgcaatcttggctcactgcaacctctgcttcctgggttcaagtgattctcctgccttagcctcctgagtagctgggattacagggacatgccaccacacctggctaatttttgtagttttagtagagacggggtctcaccaagttggccaggttggtctcgaactcctgacctcaagtaatctgcccgcctcggcctcccaaagtgctgggattacagacacacaccaccgcggccagcctatatatactcttaatgctttctaattatttgctccaaggacagagattcataggcctaatggaccttcatggtcagtacatgcatgcggctaatgaagacacatcttgtttaccagagctttggggttgatttccaacagcaaattacatgtggtaataagattgctgtttttcttgaagatgaaagtacataatatagtgatagctgattaaatgccacttattagcacttcttgtgattcacatggtgagcaaaggattttatatgcatatctcatttgatcctcacaacaacccattgtgcacatatatatacatattattaaaatgaccattttgcatatatggaaacaataacaaagactaagtaatttgcactaactcaggatcagtaagaagtcacacagttcctaaatggcagatctggaatcgaaatctatgtttgactcttaacgagtgtgatagtctgcttcatatatggacataaaatagcaaacctggacaattattagccagaatgttttgaaacattaatttctaaatatacattatttcaatgcctatttaattttcttttcaatgttttttcagttaacaagtgactaatacttttggaacataatggtatgaatctccatataaatgggaatataaacaatttaattgtgttgtgttgtttttttaatttcccccagtaaagcctaaatgttacagacaccaacttaggcccatgagcaatttgttgattggtttgaatatttctaataatactgttggttttgttatttaagagacaatatcaactgcacttaattgccaagtagcagtcacagagatttttcaaagatgccaaagcatagaagacagccttttttaaaaagcgtattaaatgtgatgaaactgagtaatgtagaagataaagaggtaattacttgaaatgtctgtttctgaaataaaaagtagggatttaattctaaactacaaagatgatacagagtatctgtaaagtggccttttagttccattaatataattatacatttcacacaccctcactcacattgtcaggtattcttctttcagaaaggtcatattattcagaggggcttttggatcagcaaaacacttcagattgtatgcagattatggaataggaattttgtcttttaatggaccgtaatatagccttcttggtgttaacttctctctacttaggtttcagcatttcagtattggatttttttttgaacttttattttaggttcaagggtacatctgcaggtttgttatgtcagtaaattatgtttcatgagggtttggtgtacagattatttcatcacccaggtaataagcataatactcaatagctagtttttcaattttctcccttcccccaacctccaccattaagtaggccccagtgtctgttgttcccttctttgcatccaagtattctccgtgtttagctctcacttataagtgagaatatgtggtgtttggttttctgttcccatgttagttagcttagaataatggcctccagctccatccatgttgctgcaaaggacatgatctcattcttttttatgactgtgtagtattccacaatatatacataccacattttctttatcctgtctaccactgatggtcatttaagttgattccatgtctttgctattgtgaatagcgctacagtgaacatacacatgcaggtgtctttatggtagaatgatttgtaatactttaggtctatacccagtaatgggattgctgggttaaatggtaatactgttttaagttctttgagaaattgccaaacggctttccacaatgactgaactaatttgcattgccaccagcagtgtatcagcattctcttttctctgcaacctctccatcatctgctatttttttactttttaatcatagtcattctgactggtgtgagatagtatctcattgtggttttgagttgcatttctctaatgattagtaatgttgagcactttttttatatgcttgttggctgcatgtatgtctttttttgaaatgtgtctgttcatgtcttttgccccctttttttatggtgttgtttattttttgcttgctaatttgtttaacttctttatagattctggatagtagatctttgtcagatgcatagtttgcaaaatattttccccattttgtggggtgtgtttgttgatagtttctgttgctgtccataagctctttagtttaattaggtcccatttgtcaatttttggttttgttggaattgcttttggtgtctttgtcatgacatatttgtcaggacctatgtccagaatggtatttcctagattatcttccagggtttttatcattttaggttttacatttaagtctttaatccctcttgagttgatttttgtacctggtgaaagaaaagggtctagtttcaatgtttgacatatggctagccagttatttcagcatcacttattgaatttggtcttttcccattgcttgttttcattgactttgtcaaagatcagatggttgtaggtgtgcagctttatttctgggctctctattctgttccatttgtctatgtgcctgtttttatactggtatcatgctgttttggttattgtagccttgtagtatagtttgaacttgggtaatgtgacttcaaactatactacaaacaatactacagctttgttctttttgcttaggattgctttggctatttgggctcttttatggttccatatgaattttagaataggttttttctaattctgtgaaaaacatcattggtagtttgataggaataacattgaatgtgtacattgctttaggcagtatggccattttcacgacattgattcttcctatccatgagcatgaaatatttttccacttgttggtatcatcgctaatttcaatgagaagtgttttgtaattctctttgtagagctcttttacctctccggttggctgtcttcctaggtattttattctttttgtgactattgtgaatgaaattgcaatcttgatttggctctcagcttggatgttgttggtgtatagaaatgctactgatattcgtacaattgattttgtatcctgaaactttgctgaagttgtttatcagatttaggagatatggggcagagactatgtggagagttctaagtatggaatcacatcatctgcaaacagggatagtttgattcctctcctcctatttggatgccttttatttctctctgtttcctgatcactctggctaggacttccagtactatgttgaataggagtgctgagggtagccattcttgtcatgttctagttctcaaagggaatgctccagcttttacctattcagtatgatgttggtgtgggtttgtcatagatggctcttgttagtttgaggcatagtcatataatgcctagttttttgagggcttttaacatgaagggaagttgatttttatcaaaagccttttctaaatctattgagatgatcatgtggtttttgtttttggttttctttatgtgatgaatcacatttatttatttgcatatagtgaaccaaccttatatttcaagtataaagcctacttgattgtggtggattagctttttgatgtgcttctggatttgatttgctagtattttgttgtggatttttacatttatgttcatcaaggatactggcctgaattttctttttttgttgtgtctctgccaggttttggtatcaggatgatacttgtcccatagaaagacatagagaagagtttttcttccttagtttgtaaaagtagttttagtaggaattgtaccagctcttttttatatatctggtagaagtcagctgtgaatccatttggtcctgggcatgttcaggttaataggtatattagtccgttctcatgctgctaataaagacatacctgagactgggtaatttataaaggaaagagatttaattgactcacagttctacagggctggggagacctcaataaacttacaatcatggcagaaggggaagcaaacatgtcattcttcacatggtggcagcaagaagtgcagagcaaagtggtggggcgggggggcaggcgggggaaaagcccctcataaaacccttagatctcatgagaactcactcactatcacaggaacagcatggaggtaactgcccccataattcaattacctcccaccaggtccctcccaggacacatggtgattatgaaagctacagttcaaaatgagatttgggtggggataaagccaaaccatatcagtaggcttcttcttactgattcaattttggaacttcttattggtctgtacagggattcaaattttttcctggttcaatttgggaggttgtatgtttccatgaatttatccatttctactaaattatatcttgtgcacatagaggtttgtagtctttgaggttttttttgtatttctgtgaagttggaagtaatattccctttttcatttctgattgcatttatttggattttctgtctttcttttattagtctagtttgctgtctatttatcttatttattcttttgaagaacaaactcctagttccattgatcttttatatgatttttagaatctcaatttccttcagttcagcattgattttggttatttctggtcttttgttagctttgtgattggtttgctcttgtttctctagtttttctaggtgtgatgttagattgttaacgtgacatctttctaactttttgatatgggcatttagtactgtaaactcctctcttaacactgctttagctttgtctcagagatgctcatgtgttgtatctttgttctcattatttttaaataattttttgacttctaccttaatttcattgtttacccgaaaatcattcaggagcaagttgtttatttccatgtgtttgtgtagttttgagtgattttcctagtattgatttctatttttattacactttggtctgagagtgtgatcggtataatgtcagttttttttaatttgctgaggattgttttatggctaattgagtcatcaatttcagagtatgtgccatgtgcatatgataaaaatatatattctgttgtttttggatgaggagttctgtagatatctgttaggcccattcagtcaagtgttgagttcaggtcctgaatatcttggttagttctctgcctcaatgatctatctaatagtatcagtgaggtgttgaagtctcccagtattattatgtggttatttaagtctctttataggtccccaagaattctgtttattaatctgagtgctcctgtgttgcgtgaatatatgtttagtatagttatgtctttttgttgaattgaccctttaccattaggtaatgcccttctttgtcttcttttattggtgttgccttaaagtctgttttgtctgaaattagaagagcaaccctgcttttttccattttctgtttgcttggtagatttttctttatccctttacattgagcctttgggggtcattgcatgtgagatgggtctcttgaagacagcacatcattgggtctttcctttatcaaacttgccactctctgccttttaattggggcatttagttcatttgcattggaggttaatattgacatgtgtggttctccttgaagaggtccttcacatcccttgtaagttggattcctaggtattttattctctttgaagcaattgtgaatgggagttcactcatgatttggttctctgtttgtctgttactggtgcataagaatgcttgtgatttttgcacattgattttgtatcctgagatgctgctgaagttgcttatcagcttaaggagattttgggctgagacgatggggttttctagatatacaatcatgtcatctgcaaacagggacaatttgacttcctctttttctaattgactaccctttatttccttctcctgcctgattgccctggccacaacttccaacactatgttcaataggagtggtgagagagggcatccctgtcttgtgccagttttcaagggaatgcttccagtttttgcccattcagtatgatattggccgtgggtttgtgatagatagctcttattgttttgagatacgtcccatcaatacctaatttgttgagagtttttagcatgaagcgttgttgaattttctcaaaggtcttttctgcatctattgagataatcatgtggtttttgtcattggttctgtttatatgctggattatgtttattgatttgcatatgttgaactagccttgcatcccagggatgaagcccacttgatcatggtggataagcttcttgatgtgctgctggatttggattgccagtattttattgaggatttttgaattgatgttcatcaaggatattggtctaaaattctctttttttgttgtgtctctgccaggctttggtatcaggatgatgctggcctcataaaacgagttagggaggattccctctttttctattgattggaatagttttagaaggaatggtaccagctcctccatatacctctggtagaattcagctgtgaattcatctggtgctggactttatttggttggtaagctattaattgttgcctcaatttcagagcctgttaattggtctattcagagattcaacttcttcctgatttagtcttgggagggtgtatgtgtcggggaatttatccatttcttctagattttctagtttatttgcatagaggtgtttatagtgttctctgatggtagtttgtatttctgtgggatcggtggtgatatccctttatcattttctgttgcgtctatttcattcttcttcttttcttctttattagtcttgctagcggtctatcaattttgttgatcttttcaagaaaccacctcctggattcattgattttttgaagggttctttgtgtctctatttccttcagttctgctctgatcttacttatttcttgccttctgctagcttttgaatgtgtttgctcttgcttctctagttcttttaatggtgatgttagggtgtcaattttagatctctcctgctttctcttgtgggcatttagtggtataaatttccctctacacactgctttgaatgcgtcccagagatcctgatatgttgtgtctttgttctcattggtttcaaagcacatctttatttctgccttcatttcgttatatgcccagtagtcattcaggagcaggttgttcagtttccatgtagttgagcagtttcgagtcagtttcttaatcctgagttctagtttgattgcactgtggtctcagagacagtttgttataatttctgttcttttacatttgctgaggagtgctttacttccaactaagtggtcaattttggaataagtgcagtgtggcactgagaagaatgtatattctgttgatttggggtggagagttctgtagatgtctattaggtccgcttggtgcagagctgagttcaattcctggatatccttgttaactgtctcattgatctgtctaatgttgatagtgggatgttagagtctcccattattattgtgtgggagtctaagtctctttataggtctctaaggacttgctttatgaatctgggtgctcctgtattgggtgcatatatatttaggatagttagctcttcttgttgcattgatccctttaccattaagtaatggccttgtctcttttgatctttgttggtttaaagtctgttttatcagagactaggattgcaacccctgcctttttttgttttctatttgcttggtggatcttcctccatccttttattttgagcctatgtgtgtctctgcacgtgagatgggtttcctgaatacagtacagtgatgggtcttgactctttatccaatttgccagtctgtgtcttttaattggagcatttagcccatttacatttaaggttaatattgttatgtgtgaatttgatcctgtcattatgatcttagctggttattttgctcgttagttgatgcagtttcttcctagccttgatggtctttacaatttggcatgtttttgcagtggctggtaccaattgttcctttccattttagtgcttccttcaggagctcttgtagggcaggcctggtggtgacaaaatctctcagtatttgcttgtctgtaacagattttatttctccttcacttatgaagcttagtttggctggatatgaaattctgggttgaaaattcttttctttaagaatgttgaatattggcccccactctcttctggcttgtagagtttctgccaagagatcagctgttagtctgatgggcttccctttgtgggtaacctggtctttctctctggctgcccttatcattttttccttcatttcagctttggtgaatctgacaattatgtgtcttggagttgctcttctcgaggagtatctttgtggcattctctgtatttcctgaatgtgaatgttggcctgccttgctaggttggggaagttctcctagatcatatcctgcagagtgttttccaacttggttccattctcttcgtcactttcaagtataccaatcagacgtagatttggtcttttcatatagtcccatatttcttggaggctttgttcatttctttttattcttttttctctaaacttctcttcttgcttcatttcattcatttcatcttccatcactgataccctttcttccagttgatcgaatcagctactgaggcttgtgcatttgtcacgtagttctcgtgccttggttttcagttccatcaggtcctttaaggacttctctagaattggttattctagttagccattcatctaattttttttcaaggtttttaacttctttgccatgggtacgaacttcctcctttagctcagagtagtttgattgtctgaagccttcttgtctcaactcgtcaaagtcattctccgtccagctttgttccattgctggtgaggagctgtgtcctttggaggaggagaggtgctctgatttttagagtttccagcttctctgctctgttttttccctatctttgtggatttatctacctttggtctttgatgatggtgacgtacagatggggttttggtgtggatgtcttttctgtttgttagttttccttctaacagtcaggaccctcagctgcaggtcttttggagtttgttggaggtccactccagaccctgtttgcctgggtatcaccagtggaggctgcagaacagcagatattggtgaacagcagatgttgctgccggatcgttcctctggaatttttgtctcagaggagtatccggccgtgtgaggtgtcagtctgcccctaatggggggggcctcccagttaggctactcaggggtcagggacccacttgaggaggcagtctgtccgttcttagatgtccaactgcatgctgggagaaccactactctcgtcaaggctgtcagacagggacatttaagtctgcaaaggattctgctgccttttgtttggctgtgccctgcccccagaggtggagtctacagaggcaggcaggcctccttgagctgtggtgggctccacccaattcgagcttcctggctgctttgtttacctactcaagccttggcaatggcgggcgcccctcccccagcctggctgctgccttgcagttggatctcccactgctgtgctagcaatgagcgaggcttcgtgggtgtaggaccctccaagcaatgcacgggatataatctcctggtgtgccatttgctaagaccgttggaaaagcacagtattagggtgggagtgacccgattttccaggtgccatctgtcacccctttctttgactaggaatgggaattccctgaccccttgcacttcctgggtgagacgatgcctcgccctgcttcagctcatgcttggtgcactgcatccactgtcctgcacccacttcctgacactccccagtgagatgaacccagtacctcagttggaaatgcagaaatcacctgtcttctgcatcgctcacgctgggagctgtagactggagctgttcctatgcggccatcttggctccaccccccagtagtttgtatttctatgggatcagtggtgatatcccctttatcattttttattgcatctatttcattcttctctcttttcttctttattagtcttgctagcggtctatcaattttgttgatcttttcaaaaaaccagctcctggattcattgattttttgaagggttttttgagtctctatttccttcagttctgctctgatcttacttatttcttgccttctgctagcttttgaatgtgtttgctcttgcttctctagttcttttaattgtgatgttagggtgtcaattttagatctctcctgctttctcttgtgggcatttagtggtataaatttccctctacacactgctttgaatgtgtcccagagattctggtatgttgtgtctttgttctcgttggcaaaccactgctcaatgaaataaaagaggatacaaacaaatggaagaacattccatgcttatgggtaggaagaatcaatatcatgaaaatggccatactgcctgaagtaatttatagattcaatgccatccccatcaagctaccaatgactttcttcacagaattggaaaaaactactttaaagttcatatggaaccaaaacagagcctgcattgccaaaacaatcctaagccaaaagaacaaagctggaggcatcacgctacctgacttcaaactatactgcaaggctacagtaaccaaaacagcaaggtactggtaccaaaacagagatatagaccaatggaacagaacagagccctcagaaataatgcggcatatctacaaccatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggatgaaagacttacatgttagacctaaaaccataaaaaccctagaagaaaacttaggcaataccattcaggacataggcatgggcaaggacttcatgtctaaaacaccaaaagcaatggcaacaaaagccaaaatagacaaatgggatctaattaaactaaagagcttctgcacagcaaaagaaactaccatcagagtgaacaggcaacctacagaatgggagaaaatttgtgcaatctactcatctgataaagggctaatatccagaatctacaatgaactcaaacaaatctacaagaaaaaaacaaacaaccccatccacaagtgggtgaaggatatgaacagacacttctcaaaagaagacatttatgcagccaaaagacacatgaaaaaatgctcatcatcactggccatcagagaaatgcaaatcaaaaccacagtgagataccatctcacaccagttagaatggcaatcattaaaaagtcaggaaacaacaggtgctggagaggatgtggagaaatgggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagatacatgcacacgtatgtttattgcagcactattcacaatagcaaagacttggaaccaacccaaatgtccaacaatgatagactggattaagaaaatgtggcacatatacaccatggaatactatgcaaccataaaaaaggatgagttcatgtcctttgtagggacatggatgaagatggaaaccatcattctcagcaaactgttgcaaggacaaaaaaccaaacaccgcatgttctcactcacaggtgggaattgaacaatgagaacacatggagacaggaaggggaacatcacacactggggcctgttgtggggttgggggagggaggagggatagcattaggagatatacctaatgttaaatgagaagttaatgggtgcagcacaccagcatggcacatgtatacatatgtaacaaacctgcacgttgtgcacatgtaccctaaaatttaaagtataataaaaaaaatattgacatgtgtggattttcctttcattgtgttgttagctggttattatgcagacttgattgtgtggttgctttattgtatcagtggcctatatacataagtgtttttgtggtagctggtaatgatgtttcatttccatatttagcactcccttaagtgcctatgttaagccaggtctgttggtaatgaattcccttagcatttgcttgtctgaaaaggattttatttctccttcacttatgaagctgagtttggctggatatgaatttcttggatggaatttttttctttaagaatgctgaatataggccccaatctcttcaggcttgtagggtttcttttgaaaggcatgctgttagcttgatgggtttctgtttgtatatgtgatttgccctttatctctagctgcctttaatatttttttctttcatgtgagccttggagaatctgacaactgtgcgtcttggggatggtcgtcttgtatagtatcttgcagaaattctctacatctcctgaatttgaatgttcacctctctaatgaaacttgggaaatttttctggataatatcctcaaatatgttttccaagttgctttttctccccccctctcttccagggataccaatttgtcttacctgtggtctctttacataatccaatatttcttggaggatttactcattttttaaacttttggctgactgaattagttcagaaaccagccttcaagctctgagattctctcctcagcttggtctattctgctgttaaaaaaaagtgcgattattattatgaaattcttgtactgtttgtcagctctatcagatcagtttgtttctttcttataatggccatttcatctttcagctcttatataattttattgtaatccttggattccttggattgggtttcaactttctcctgaattgtgatgatcttcattctcatccatattctgaattctctgtctgtcatttcagccatttcagcctggttaagaacacttgctggggaactagtgcagttgtttggagaaaaagacactctggctttttgacttgccagagtttttgtactagttctttcttatctctgtgtgctgatgttcctttcacagttacaatttgagtacattcagttgcctcttttctggatgttttcaaagggctgaggctttgtgcaggatctttatttgcagctgatttcttgtccttgtttttatgggggtgggggttatgttagcaagtatttttggtgttgaagtttgggctgtgatccagtaaatggtgcttaagtataatggtaagttcttgctcaaccacgtggctcctctgtatttcctctcgatttcagctgtgctccctcttagtgctctgaaagtgtagtttcttctcccagtcaatttctggctgcagatcttggattggcactcccagggtgcacactgcagctctggggtgagctcaggctttgtgtgtcctctccaacttggaggcagcagagggagggaccttggcagtggctgtagcagagagccattcacttgtctcttggggctccagcccagagaaatacggagctgctaccagttggtgtgattggcccagagttgggcagctgtgttatgggcccaagctggggtgggggcggggcttgcttggtgatgagcagggagcattggaggctcataggtgagctagactggcctcttctctttaagatggctgtggtttctggaggtgtaggtaaagcacttaaggtctttgttccttccttagtccaagggcagcaagggaagtaccactgcagtggcagtggcagaggggctttcggttttgtctaggagctccaccacagagaatcacagacccgttactaatgggaatgtttaatcggggcttgtggtgactgcactactggccctgcttggtgaagcgcagggggtcaaggcctcatggggaggagagactgggctcctctccttatggcggttttggtgctgggagtgcaggtgaagccctcaggttctttgttccttccccaatgcaagggcagcaagggcaggaccagtgcactggcggtggcagagggtctgttggttgcctctgggagcccctcccagggaaacttagagccactagcagtggaaatgctcagctgggggtggggtgtctgctctgcaattccagctgaagggtccttcctggggaagaatacagggtgggagctcacagagaagagacattgggtttctctccgtatggtggctgggtgtgctagggatgtcagcatagcaaccaggccctttgttccttccccaatgcagtaagggtggtacccatcgcagctgtaatggcagaggggctatgggttgtctctggggatttcctccccaaagaaacacagagctgccaccaactgacatgttcaggccagggcagggcggttgtgctaggcgcccaggtggagagatcctgcccattgaggggtagcagggtggggacctgtgtggaaaactggccgcttttctgtaaggcagctctgccttagtgcctgatcactgcgttccttcccaagccggagagccacaggagcgagggcttcagagcagcaaaagtagtagcttgcctgttacctccgggagatcccttccaagaaagtgcagagctgctaccgcggagagccctagcagggagtggccaaggtcgcagatctagaggccctgcccagtgaggagtagcaggggcgggggacggcattgaaaacaggccgcttttccgggtaaggtggctgcgctgtgctgggggtctatgatagtccctaatcactgtgctccctccccagcctgagggcagcaagagcgagggcttccgagcggcagaaatggcggcctgcctgcgacccgagagctcaggcagggctgcgatggccgcagtagagtcccaggccagtgggccatgtctggcgaggtgcagtggaggtgaggcgtgcactccatctgctgctcagccctgtggatttgcccccatcctggtgggcctgtgcgggagcctgacctctcttgttgccagagatgcagctgccggtgtccggtaccaggggatccatggctcccgggacccagggttgcaaaggtccatggcagaagtgtgggtccccagggactctcactgactcactcaccgtttcctggctgtggggggcctcccctggctcttcgcctctccccggtgggcagttgtcctgtctcactcttctcacttctgtgtggattgtattgcttccttgatgaaagtgtccacttggataatccagttgaagagctaatgtttactcactactctcttctctctctgagagcaatgcgcactagctgcttctagtcagccatcttggctggaatcccggttttgaatttcattttgggaaatgatttgatttcgcacatttgtgtatgtgtgagagagagaggggagagcgtatcaatacgtgcgcgcatgtgagtgcaagagaccatttcacttgttggcatttaacggtgtttgctgctactcccagtttctcaactcttccaccacaatgcccctcatactctaataggttatgcacaaagagtgcctcctttgtaatacctatattataaagcctctggagaaacttcattatttgcattttgcaggtgtgggaactaaattacgatatgtttaaataatttgcccagggactgccagatataaagtagaagagctgattttcacacatctgtctccctcagtaccaagttgtgccgtttccacttaagctgtgtgctctgctggattcatgtgcatttccttcagtctcataagctgcttgtaagatgaaaattcactgacttgtgcactgattgttcagatggagaaagccgaataaagttggagcagttggcacttaactgttatctgggcagtgctaagtgctggagttttggtatttaagagacataggctgagccctatggagcttgtaatatagataccatactggaagtaattttttccttatactcagtattttctgttagcttttgctgcataacaaagtacccgaaaacctagaggctgaattgttctggtctgtcagctcagctgatctctactggatttgcttttgcatcagtggttaatcaaagggttgattggaggctagtgatctaagttggccttgttgacatggctggtgattggtaggctgttggttggggtggtaagggaagctgggccatgtatttagaaactagcctaggcattttcacgtggcaactaaatcctaagaacacaagaggaccagcctcaaggcacaagtgcttctcaagcttctgtttgggtcttgtttgctaatgtcccccctgctggccgagcaagtcagatggccaagtccagaatcatcagaatcattttaagagggtgtacaaaagggcatagacacaagtaggggaacattttgttgccattgttgcacccttctcctgtcaggaactatcaaaattctgagatttttaccctacttgcaagctaactagtcaggctaccacactgttatagatgctggtagaagacataagactcctaatcagaaacaaaggagtttatcctcataatggcagtagtaatcaagtctcagcatttttgcacctcttttctgagccccaattcccacaggatgacatgaagagggccagcttgtgagtgagttgtgttatgggagaatatcattgaggttagggaaccggagtcttttataatgagtagcaaacatgtctaccctttgctctggagagagacattattattctggacagtaagcatgctaccctttgctctacatagagatactgtatcttccaggattgtaaacaaacctaccccttgctctggagggagatactactctgtcttccaaggctgtttgctatagaaacatccttgaaaagaaagttcagaacaaaaaacagttgtctcattcacaatatatgccaaaatgcaagaaactcatggagaattgtctcccaacagtcacatgccctaaactagaatatttgttttccttgtgtcttatactctatcaaactgaaacatctggaaagagtatcctgtcttagtaatttgtgcctctcacaatactcataatgttgcctcatgtttcataaaggctcaataaatatttattaagggaatgaagaaatgttttctaatattttatagttccatttatatttcaattcttaatatccggaaaataaaactatacaaattatttatgttttttttccttttagtgtgatatgttcaagttaattaagtactttggtataaagtagatttttgtgctctgtactctgatatttggcagtttattttgaagctcaagtaattgttgttctgattcagggaaggtgggactgcaagagtaagaaggccgaagctttgatggatcttttcctttatattggtctgtgagttaatatcagcttttcttgtttaaaatatgattaatgaatgattagttgcgtgcaaagtactatgagttcctgtgatcatcaccattttaaaagaaagtgaaaaaacacatttttcagccagataataatgctttaaaaaataacaaaaatgttaggcttaatttaagcagtgtgagcacagcatagcattagccagatgctgtaacagtcagaccaggacttctttcatcaaagtgcaaagtagttgtggaaagaagaaagggatgagcttatgagtcagatttgagtttgaatctagcagcagggacctaatctgtctgttctgttcaccattgtttcccacactacctggcaaatagtaggcactattttaataaatgtttgtggggttactcatcttcttcactatccattctatgaacatagccaaatcccgttacttctgtgaacctatgttttttcatctatacattgataatcaccaagcatagttctctggatgggttgatacagagacttaagtgagatatggtatataaagctccaagcatagtacctgacactcaataaatgtgagctgtttcacttcttggactaacttgaaattcctggtcatgttctgcctaggtgttacggtgaaggaagttcagttaattgttaggctcagctactgcaggttcactcactttttgatgggtcagaataactttttaatttcatcctttcccaacttttcatttcctgactctgtcaccaccttccctcttgcttagagcattccagtagccatttaacttttctcctcctctggctgttctttttcaaaccattgtgcagatgactccatgactaactttcccttcctgctaaggtattcctgagcccctcacttcctgcctaccaggctccaggagtggcttcacactgtctcatcatcattcaccctcccctttgttcccttgtctgtttatccagtgttgtagccacactattctccaaacacattctttccacctcagggcctttgcacttctcagctttgctagtgaccattctttccacctgtaacttcctgttcagctcttagtctaccctgtccatcttccaaggtttctcacaaccaacaaatatgatgtctctcatgaagccctatcctgatcaccctctgccaccgcgttaagttcatatgtaaggttccccttttttgaaatcttaatactttcagcttgtcaccttccaggaattaaagattatgtactatgtgtggcagcccccttaccagtaacatctcagagagattgtgaccaactaaacactagtgaagtccaccaaactactgttgaacactattaagtgaggaagtattgaaacagagatagcaagagaaatgaggggcctcgagtggtggggacaagtcagcctcttctccctgcttccttggaagcccctctgacagtgggtacacataagttacagggcccagcgtgggcagccctgggctgcgggccactctgtaggttctggaagctgttgtctaacatttgctatctccagcttaaatctccatgaacgcctacagtttctggccagggaaacagatgtcttgactgtctaacataacttcgtatatgtgttggtaaagtgattcaaatatgacattttggaaaattaaatatttgagcatctttttccgttagaggctgggcgtgctcctgcctatgtaatttttagaattgagaaaagggcataaatcccatgattaaaacaacaacaacaacaacaatctgtgtttcatgtattttataatcctactttctagttgctatttgattaaaattacataaaagactataaatgagtataatatgtaattagaaataaataggtttttaaaaattcaataaataagtatttgttacatacctaccattttctagacactgaatgaattcgtagtctggcaggagttagaaacaagtgaccaaatgactgcaatataatgtaattggtataccagttttggcgtggtattttgggctctaaccttatttttatcccttttcctctcttcaacattctcaagcaataacaataataactaattaatattaaataataattaattgagcacttactgttctcaggcaactattctaaatgttttatgtgtatcaaactcatttaatcctctagagaaacttgtaagatgggtattactgtcatctctattttaaaaataaagaacaggaagcccaaattttaataattcacattaggggcatgaaaagtggttaagtaagagctgatgatggcctgaagtaagcaaggagcagatggctggagagaagagggtaagtttgaggaatgggttgggaggtaggtaaacaggacattgtgatggatggcgatggggaggaaagacaagagtgagtgtggttgagggtcagggagcatgggagcaaagggatgttcatgctgaccaaaggcttgaggtctggagagtgttgggaaaagagcaggcacaagacatttggaaagaagctgtaccattgagcaagcaaatgaggaaggctatgtgtatgaagatgtctgtcctccttgaggctggagccagtgtcttttcctttctgatgtttgtaccctagaacccacagtgcctggcccacatagaccatcttcattctccctgttgctatctgattggaatagtttcttgctgtgtcatgtgggtgggccctcccaaacccctctccagaatttatcccctaaaacacccacatatgtatgcattggttaagacattagtttgtcttatttcctcagaaagtgtcctataaagacttgaaggtggccaggcatggtggctcgtaaatgtaatcccagccctttggaaggcccaatggggagaattgcctgagctcaggagtttgagaccagcttggacagcatagtgagaccctgtctctataaaaaaaaattagctgggtgtagtggcatgcacctgcagtctcagtttcttgagaggcttagcaggaggatcgcttgagcccaggtggaggctgtagtgagccatgattacaccattgcacaggagtgcacaaaatacatgaacagtcatgccaacaacaacaaaaaaaaccatacaagagatcctcctgcttaagcctctcaagtagctgagactacaaaacatacaaacaaccatacaaaccataaaaaacgtacaaaccaaccaaccaaaaacagcttgaaggtaacagtactgctgattttaaaatatgtaaatggaatcaatgttggattcatgttgtttcctatttggttgctttgtagactcttcattaccatttctgcttctcagaaatcacatgtagtgacacgtggtgtttattacataaaggataaatggcagcataacattgacagtaatttttgcttccagcccccaagactgtagccttctgccttattcctagcctgctcctcaacctccattgagtctgtaaacctccagtatacttccagtaaattatccttttgcttaaaaactaaaattaaaaataaatatactttgtaaactgtcaaatactatatgaatattaaaagccttttagtagtcagtttcagtctttcattcagtcatccacgccacagctttcttctgggcacatactaagcagtccctgggctcgatgctgtaattagaatctgctcgtttgatctgcaggaatattgtcacattctgattaaaacagttctcaaaaattaaattttaacttggaacaacatacactaaatctctttttcagaaaaagaattaataaaaataatagtaaaataaccccaagtcctttaatacatatagtgattatttttagtttagcttttttatggttactgtaagcatataaatatttactactgtcctaaatagcaaagcattaccctgcagttgtctaattggtgcatgaatgtcactaaaattaaatatcatgatgttcaatattttccttagtcaattttacactatcctgccctgtgattaattactttgcttgaggccaagcaagtactactgagtcctgtgataagtggatgtttatgccaaaaacaacagcattgctaattcttgcatatttgcacatgttaagttcttttctttctctgccacctgtatttcatgtgttgatcacagaggcaccagagtatcattcttacagtatttgaattatgcattacatggtaaactgatcgttattttccatcaaatgaatactttggcttacacttaattttataaaatctgtttatagaaatcattaataactagaacaacgttagttagaaattgaagaatatggctaaagaatttattaccttggaagatattatgaagatcctaagaagaaaaaaaatttaaggaggcatctaataggcagattaacaaggctgtggggaagtgatacaaatgtatattgctttcaaaaagtatatttcccttgggcatggatactcatgcctgtaatctcaacactttaggaggctgaggcagaaggatcatttgagcccaggagttcaagaccagcctatgcgacatagggacaccccatctctacaaaaaattagaaaattagctgggcatggtcacacgtgcctgtagtcctcgctccttgggaggctaaggtgggagggtcatttgagcctgggaagtcgaggctgcagtgaggcatgattgtgccacagcactccagcctgattgacagagtaagactctgtctcaacaacaacaacaacaaagagttaatttccgtttttgtttgaattttgatatcaaaaacatcaataaaataatttatttccagattgtactcatctgttttcaccatatttgatggaattttgaagtgaacaattcctgacagtataaaaaggtaaaaatccaggtattaggaccattttttccctgctattttctttttctgatgacaactttatttttctctgtgaagctataatttgcctctgatatttttattttaaatgtttttcaaactttgaattttaattttttagattctagttagtattaatattttatcttatttgatatttttattacagtagctattggtacttcctgaataaatgtgcttctttattatggttcttaatgtggtaagaacagataaaccacatgcacgtaattcaccattatctcaatttcatagacatttaccgagcgtctactacatgcaaaaaagtttgtgccggatgttgcaagggctcctaaaacatcaccactacagcttctgcatagagatgattgttgacacttcaggaatagagactacatggggagggaaagagagcaggaaaagaatgtctgtgatcagaacctaaaggatgcttttacttgggtggtagaaaaagaatgcaaagatggccaatgggacaaagaaggaaaagtcaaagataaaaacataagcaaagtgtacattttaatcaaagccagaaaaggaaagggtttcaggaggttgacatattctgcagaagactgaggaggactcaggaaaattcaacaaagtggtactattagagagttgggaaaggaaggctaactctaagggtgttatataaaactattaattgatgctactcaaagtgtggtccatggataagtgccagtctgcaaagtgcctgttaactatgcatgctgatgagctacaggatgtaaatgaactacattgttacacactgtgtcagttcaatgggcattttttgacaggaagtctttcttgaggaagcatgtagtaagttcatttgtgtgctggtaaccggatttctgatcttgtcccagatgtttaaggagcagttcacagacagactactttgaggagcactgatagaaatacaatacaatgtagacaaacatgatttcatttttagataaaatttatgatttccttgtgaggtaataaatatgattataatttctattgaaaatacttgtgccattttctagacatcaaataaaacttgcaagaatgggtatctttctaataattcctgtcactattactttggggtacattttaatttttattctaattactcaaaaacattctctaaaaaatactgcacataatttccaaaatgtgaagcaacgaagatgttactcagtaggtgaataggtaaactatgctatattcataaaatggaatattagtctgtaataaaaagaaatgagctatcaagccatgaaaatgcatgggtgaaacttgaatttatattacaaagtgaatgaagccagtctaaaaagactatctattctatgaatccaactatatgacattctggaaaaggcaaaactatggagacaataaaaggtcagtgtttggcagagacttgagagaaggagggataatagatggagcacaggggatttttaaagcagtgaaactattctatatgatactgtaatggtagatacaaataatcatacatttataaaaacccatagaatatacaacaccaggagtgaaccctaacgtaaactttggatttggtgaataatgatgtgtaaatgttggttcagcaattttaccatactggtggggcatgttgatggagtaggctgtgcttgtggagggggaaggagctatgtggaactctctatactttctactcagttttactggtgaacctaaaactggtctaaaacatacattttattaattaaatttttaaattaaaaaaattttgtaggtacctcacaactgtctcataattgttttattgttttcgagaaaggtggccttccaatgaaggttttgtgttttgttttggtttgtttttttgtttgtttgtttgtttgagacagggtctttatcactcagactgaagtgcagtggcacaatcatggctcaccaaagcctcaatctcccagacctgagtgatcctcacacctcagcctcacgagtagttgagaccacaggcatgtgccaccacacttggctaatttttcttatatttttgtagagacagggtctccctatattgcccaatactgaactattaggttgtaaaaacaaaatgtattcctttgaagaacagataatagtcatggtctattaggtcttagtgtcaaagttgagtgattctaagataatgaaagcagatatttttagatggagagtagcactctgaagatgatctgcctggctcttttgttaaaggttgttgccgttcatctagacgtatgtatatgcctaagaagagcgttatactgatgctgttacaaaagagagaaatcagacactgattgagtgtgagttctccaaagaaacataactaagaggaatagatagatagatagataactctactgtaaagaactggcttacatgattatggaacctgagaagtccttggatctacagttggtaagctggaaacccaggagagctggttgtatgcttctagtccaagtctgaaggcctgaactaggagaggtgttggtgtaagttccagtctgagtataagtccaaaggtaggataagaacaatgttcctgctcaaagacagcccggcagagagaaggaattcttttttcacttagccttttattctctccaggtcttcaaccagttggatgaagcccactcacattagagaaagcaatttgctttactcattctaccaattccttgacttgcttctgggaatccctagttgactaataattttactttaaaatatttcaagaaaaaagcataatttaaaaatataacgaatatagcttaagagcaaaaacaaatatttttcaaactctatgaagaacccatatttttgtttatttattattttttgcacttttagggtcagggtacatgtgcaggtttgttatataggtaaattgtgcgtcataggagtttggtgtacagattatttcattactcaggtcctaagcgtagtacgctataggtgtatttttatcctcaccctcctccaaccctccactctcaagtaggccccactgtctattgttcccttctttgtgtccatgtgtactcagtgtttagctcccacttataagtgagatcacgcagtatttggttttctgttcctgcgttagttcacttacagtagtgacctccagctccatccatgtttctgcaaaggacatgatttctttcatttttatggttacacaaaaaagaatagtacatatgtagtacatattccatggtgaatatgtactacatttcctttatttagtctactgttaatgggcatttaggttgatttcatgtctttgctatcgtaaataatgctgcactgaacatgcatgtgtctttatggtagaaaatatatatattcctatattcctttgggtatgtacccaataatgtgattgcgggtcaaatggtagttctaagttctttgagaaatcgccaaagttctgtccacaatggctaaactaatttacattcctaccagcagtgtataagtattcccttttctctgtaaccttgccagcatctgttattttctgactttttaataatagccattctgactggtataagatggtacctcatcatggttttgatttccatttctcaaatgattaatgatgatgaacattttttcatatgcttgttagcagtatgtatgtcttcttttagaaagtgtctgttcatgtccttttcccactttttaatggggttatttgttttttgcttgttaatttaagttccctatagattctggatagtagacctttgttggatatatagtttataaaaattttctcccattctctatagtgcctgtttactctgttgatagtttcttttgctatgcagaagctatttagtttaattagtcatttataaatttttggttttgttgcaattgctttcggcatctttgtcatgaaatgtctgccagggcctatgtctgaaatggtatttcctagattatcttccaggatttttagagttttaggttttgcatttagctttaatccatcttgagttgattttttgtatatactgtaaggaaggggtctagtttcaaagttctgcatatggctagctagttataccagcaccattgattgaatagggagtctttttcccattgcttgtttttgttgactttaacaaagatcagatggttgtaggtatgtggctttatttctggttctctattctgttccgttggtctatgtctctgcttttgtaccaatatcatgctgttttggttactgtagtctggtagtatagtttgaagttagttaatgtgaggcttcctgctttgttcttttttctttaagtattcaagctctcttttggttctgtatgaattttaaaatagttatttctaattctgtgaagaatgctattggttgttttataggaatagcactgaatttatatgttgctttgggaagtatggccatttaacaatattgattcttcctattcatgagtatggaatgtttttccatttgtttgtattatctctgatttctttgagcagtgttttgtaaatcttgtagagatctttcacctccctggttggttatattccaggtattttattctttttatggccatcgtgaatgtgactgagttcttgatttggctttcagcttggacgttgttggtgtatagaaatgctactgatttttgtacactgattttgtattctgaagctttgctgaggttgtttatcagatgtcagaacttttgggcagaggctatgtgaggttttctaagtatatagtcacatcatcagcaaacagggatagtttgattcctgtcttcctatttggatgcctttcatttctttctatttcctgattgttctggctaggacttccagtgctgtgttgaataggagtggtgagagtgggcattcttgtcttgttcccgttctcaaggggaatgcttccagcgtttgcctatttagtatgtttgctgagggtttgttgtagatggctgttattattttgggatatgttccttcagtgcctagtttattgagttttttttaacatgaagggatatttaattttatcaaaagccttttctgcatctattaggagaatcataaggttttggttttagttttgtttatgtgatgagtcacaataattgatttgcatatggtgaaccaaccttgcttcccaaggaaaaagcctatttgatcgtagtgcattagctttttgatgtgctgctgggtctggtttattagtattttgttgtggatttttgcatctatgttcatcaaggctattggcctgaagttttctttcttttttttttgttatgggtctgctaggttttggtatcaggatgatgctgctctcatagaatgatttagggaagagtacatcctccccaatgtttttgaatagttttagtgggaatggtatcagcacttttttgtacacctggtagaatttgactgtgaatctgtctggtcctgggctttttctggttggtaggctttttattactgatttaattttggaactcattttgtctgttcaggatttcaatttcttcctggttcagtcttggaagattgtatgtttctaggaatttattcatttcctctaggttttctagtttttgtgcctagaggtgttcataatagtctctgagggtattttgcatatctgtggggtcagtggtaatgtctcctttgtcatttctgtttgtgtttttttagatcttctctctttttttctttattaatctaggtagtggtctatctctcttatttattctttcaaaaagcaaacttctgaatttgttgaacttttgtatggtttttcacatctcaatttcattcgattcagctctgattttggttatttcttgtcttctgctagctttgggagttggttgctgttcttttcctatttcttctaggtgtgatattaggttgttaatttgagatatttctaactttttgatgtgggcatttattactataaacattcttcttcagtctgctttagctgtgtcccagagattctggcatgtggtgaattgattctcattagtttcaaataatttcttgatttatgccttaatttcactgtttacccaagtcattctgtaacagattgtttaatttccatataattgtgtggttttgagagattttcttagtattaatgtcttttctatcagactgtgctctgagaatgtggttggtatattttcagttttttattttttttaattttctgaggattgttttctggctaaatgtgtgcttgattttagagtatgtggtatgtgcagaagagaagaatgtatagtatgtacagaagagaagaatgtatatgctcttgttttggggcatcaagttcagtagatgtctgttagttccatttggtcaagtgctgagtataggtcctgaatatctttgttagttttttccctcaatgatctaatactatcagtggagtgtttaagcctctcattattattgttcagttatctaggtctcttcataggtctgtaagaacttgctttatgaagctgggtgcccttctattaggtgcatacatatttaggatagttaggtcttttcattgagtgagtccttcaccattaggtaatgctcttctttgtctttttaaattgttgttgttgatttatagtcttttttgcctgatactagaatagaaagctctgctcttttctgttttctgtttgcttggcagatttttctccatttctttactttgagcctatcggggttattgcatgtgagatgggcctcttgaagcgagcatacagttgggtcttgcttctttatccaagttgacattctgtgccttttatttgggcatttatactgtttacatttaaggttaatattgatatgtgtgggtttgatcctgtcatcgtgttgttagctggttactatgcagacttgattgtgtagttgctctatatacttaaatgtgtttttgtggtgaccagtaatggtctttgtttccatggttagcactcttttaaggacttcttgtaaggcagatcttgtggtaatgaattcctgtaccatttgcttgtctgaaaaggatcttatttctcctttgcttatgaaacttagtttggttaggtatgacattctttgttggattttttttctttaagaatgctgaatataggcccccaaactcttctgcttatagggtttctggtgaaaggtccactgttagcttgatggtgatctctttttaggtgaccaaccccttctctctagatgcttttaagagtttttctttcatatctaccttatggaatctgaggactatgtgtcttggggatggtcatctcatatagtgtctcacaggggttctccacatttcccaaattttagtgttggcctctttagcaaggttggggaaattttcatgaaagatatctttaaatatgttttctaagttgcttgtttttttctctctctcttttagggatgctaatgaattgtagatttggtctctttacattatcccatatttcttggaggttttgctcattcttttttactcatttttatttatttttgtctgactgaaatattttggagaggtagtcttcgagttctgagactctttctttggcttcatcatttctgccgttagtacttaggattgtattatgtaatccttaaagtgagcttttcagctttaccagatcatttcttaaagtggccatttcatcttttcgctcctgtttcattttattgtacttcttatatctcttggattgggttttgattttctcttgaatatggatgatctttgttcctatccatattttgaattctatgtgtcatttgagccatttcagcctggttaagaaccattgctgacaaactagcgtggctggttgaaggtaggaagaccctctggttttctgagttgccacagttcttgcactggttctttctcatgtgtatgggctgatgtttcttcagtcttcaggttgctgtcctttggatgaggttttttgctttttcatctttgatacccttgggagtttgattgtgctataaggtaggtacagtcaactggcctcatttgtggaagattttatgaggccaaggctcagctcagcactcctggactatgtgctctaactctggggggctggcagtggggccctagctttgttctctggcccctaaaggttaggaacctgctgcactggaggggccaaagtgttcccagtctgctgtccacaacaccccgatgagggctgcccactaaattacttcatcaaggtgttggcagtggaatttgtgctcgcttgcacatgccagcgattgcagcaatgctcagtgtgtatgtgaattgcctgggatgtgggaccagtggaagcagggcagtggcattcctgctgcacctcctcatgcaggtggttgtggtggtggtgacatgacagggtcagggcactgtggtaacaggttgtctggcatttgtgccagtggtggtggcatggggttgggtgtcagggtgtgctagcaccagcagagggaggttgtggtgggggaagaccgtggcagccctgtgtgtttcagccggttccagtgcactggaactctctgacagtcaggtgcagtctgccagcaaaggagctatggtaaagttttccaggaagcaccctgtttgggcatctgaggctgcactgcaagtgggtgcaaccagtctggagccctaggagaggccagaagacagggtagtgctcagatcagactagccccatctcacaaggaagaccaccctgctgtgtccaggtatgacagtcacccctaggctaatgtctcctagaggagcgtaggtgtccctggctgtgctccattgcagccactcccatgccaaactctctgagctgtgcactggctggagtcctgctcctgccacctctcctggcagctctccctgccagggtaagtgtttgtggaggtcatggggtctcctgctgataggattctggagatccaaggtgagagcaggccataccttggctgttcatctcactccttccccaggagacgctggagcccaggaatgagtccctttgctcagcagccctgtgcagggttcctagcatcctttccctccagcctggcctctatgtcttccttccatccactcattgccttctctccaaagatctgctcagagagtatttcattcttccctatgtccctgtctcttgatgggagatgttcctcctggctgtgcttagccggccgtcttggctccccagccgcatttttataggataattaattagaagggcagtatagttttagactgagaccagtctaatttataacatctctgttcacatactttctggctgtgtatatccttgggcaagtggctttatatcattaagttttatattcttctccaattgtaaaagcaggtgagttgtcacttaatggggctaatgtagaaattaaataagataaatgtcagttgcaaaccaagggtctgaaacatactagatgttaaactgatggtttactagtattggtgatggtatctagttttcaagcacaatagagtggaattttggtttataaaccaaaattctgttaagaaacagtatttttaaggctattcagcagagacaatttttaccaatttcatctatattttaaatttaaatgtttcttttattttgaaataatttttcgcaaggctttgcttttcaaatgtaaatgtttaatcttttaaacacattggctctctgggcacctaaaactctcttcactatcgacactttaggatttactggccatgctgttgcttctgttttaatttgcaatagagcacttgtataaatgtactttgaaatgtttggaaagttgtgtatggactggaaaaatgcatgcgagatgttcctttgctttgtatattgtgaaagggaggatttgtacatgctttgttgttgttgttacatacgctagtttactgttttgaacataatttgtttactactttgaattccctatttgatggaagtgaaatgtgatcttgctggacagtagaaggaaagactgcctgtatttcatgctcatacctactaaagcatcagactgtttcatatttaagagcagtttaaaaagcacgtgagggtcttcttaatcttaattctagtgtcttaaaaaatgtatgtggagattatatgtttttgagacactataattaaggtcaagaagggaggtaatttgcattccccttgaaaaagctttgataccagctctggggactgaggggcattgtcagtgagagggccccacacagaggcttctatgtctccagcctgcagcctggagaactatgaagacttctgtttagcctcacacagaggaaggcagaataaacaaactgaaatggcccaaacaagctactgggtttttccctagacttagggtaaggaaaaggatcaggcactgatttgacaaaaaaaaaaaaaaaaaaaaaaaaagtgagcatacagaaaaatatttataggacactctatgccatgctcctggttcactgcagattatcaatcagtggaaagtgatagaagcaatggatcagcagaatgggtatagaggtaagacagcagttgcagcagcagtggtgcttggctctggtagggctggtggagcagggttgctgtattagaagagtcaggacttgttcatatgtctgtctctccctctcccccagatcatagctgaatacccagccctggactttgcagataataagtgtagcaaatattttttaaaacatttatcagcatcatttaaattattacaaaagtttataaattgaatcctatatagtgcattgttccccttaactatttctgattatatatcatcttgttattttagatattgaagaatttatccctcatgtttcctcaattttgtgtgtgtatgagtgaggaaccacaaaagtgttttcctaaaaaaatacttgctaatattctgctgtgtgttgtattttggtcctaatgttgaaaaacaaatatcctcaaatgacctcaaatcttgctacctagggaaggaaatagtggcttttgggaaatcaagaacttttgaatataaaaaagtacctagaagaataaaaggcacattcctttatgtatcttattaggctttctttttttcctaagtagtaaaacaatcattagtttcactgagtattttggacagcatattagaaatttgaagtaccaagtttactattctttactggagattgtccagcagaggaaagcaaataccagtggatgtgtggaagcattttctgatctttaacacgtacacctgctatacctaacagcctgctcagaagaaggttctatttctagatggtaaatgagagcttcccagtggaccattattttatcatgagtggtagtgggaggagggacagcgtttggacatgagggaattatcatgtatgccatcatatcattgctaggtcatttatctcttgtctagccaagttcacgttaaattctactaggttagcacttgaggtcatttaacaaaactgctgtttattaagaatgggagacatgttcttctttgaatcctgcaagaggtggttgctgaaaataataggaaccatatcttcatattttaggcaaaagtcacttttaagaagctttgtgataaatcacctagagaagccagtgaattatgccctaatggttggaatgagacaagttttctaatagtgatgacaattattaattactaatcacaagtatgtgtgtggtgggagtgaatctcaaagctataataaaaggaaatttgtgcctttttgcataatgaatgagaaaagtctctttaaaagagcaaagaaaactattaaattataaaattgttgaatttcttgtcacaacctttagaaactctataaactcatctaaaaccccaattcactgtagtgtgaaaaatagatacatattcagagtgatcatttatcttgaattaaaattaagcatccgagtcattacaaacttatctcctgcttatggacatgctgacataaaagtatttaaaacttctgagtagaaaaggatattaatgatgcaaggataggccagaaaatgaatacacttcttactaaggaaataatgattgttattcaagctgcaaaacctaaacatggaaaggaaggtaaactggcgtttattaaaaatctttctttatttgtttgctaacctcagtcctagttgtattcacatttgttactttgtttaatccccccaataatccttaaatgtagatattacaacaactttacagatgatgaattaaagtttgctaaacattgaattaatttgtaatcaatcacgtaactgctgaatgctagagtctaaaccctagcctaggcaaacatgcctccaaaccccctccattttccattataccaagctgtgtggaactgagtactccctgttcatgtctgccattagctattgagcattatggtaggcaaaataatagaccccctggccaaagatgtccatgccctaatttctggagcctgtaataatgaagtgatggaccttgaggtggcaatactatcctggattatgtagctggacccaatgtaaccacaaagtcctaaagatagaagaaagagtcagcagagtcacagtcagaggagtcaggacagaagcagaggttggagtgatgtgattgttggctttgaaggaggagaccatgaaacaagtgacttctgtaagctggaaaagacaaggaaacaagttcttcctaaagcctccagaaggaatacagccctgctgacaccttgattttagcccagtgagacgcattttgggcttttgacttccagaactataaaatagatttgtgttgttttaaaccacgaagtttgtggtactatcacagtagcaaggaaactaatacaggcatcttaacagttgctagctgcagtgaatttttcataatttttgtgaattttcagatgtggctttgcttactatcatttctgtaatcctggtctcatagtgccacctgaaaatgttgagaaacgtaattcagtcataggtttcagatttgaagagcaattaaactatatatgagggttctcatataagaagtaattgggttcctttatttcaaagcagaatatcaaaagagagtcagaaggatttgacatgtttgatgtagaaaactttattattattgttattgttttggttgtggttatttttcactgcaccttcctcagcactctaagtccaaaagagccctttttcaaaatttcatctttttcttgttaataatagagatctctgtgcctctaaatggtgtttggtcagtgagttttgtaatcttaaatggcagaaatgtcatgacatgtaattttgtgagaaaaggatacttacccctcctagcctttacataagtgaaatatagtaaatgctcttaaaataattgtacattttcttgtgagaaataacattccttgtactttatgagaaaaatatgtgtaaagttgcacatcatagaagatgcagattttaatatccagtgtatttcagcagtttggtatcagaaaagtgcactgagctagtgttaaataactttttattagaatgtcctctctattgttaagttgccacattatatgaggaaactcacttcagtttttgtgccttggtttcgttgttgtaaaatggagagaatggtacctgttttgttattccatttaaaaaatcacttgatataatataagtggcagtgcttagaaaggaataaaaatagttacaccaatgctaggtggtgtttttgtttttactaagaaagtccctgaagtcaccctgctctccccaccacatacatacacagacacacacatacacacatgtacacgtgtcaggtctaacaatgaaatacccagttaaggcattttgattccatgaaaggataaaataacatttagtaaacagcctaagtattaattaaaaagttattcaatcttttgatataagttccacaaataccttcaatcagaatttatattaatttttcagtgttcccagagctgaaatgattatcacctactaaggcaaaggaagaaaacagcgtattatgggagtcaagccaactttgcaacttgctgtgacttattatattgggttatttcccctgttgccacaaacaatatttgtcaaaagggataaatgctcattttataaatttgttgtcctaaagtttaaactgaaaaattaacataagtgcagtggtctctgaagtaggggtttgtgcacccctgagggtgcaggggaaggaaattttctctctgtatatgtttcttttttggccgggcgccgtggctcacgcttgtaaccccaccactttgggaggccgtggcgggcggatcacgaggtcaggagatcaagaccacggtgaaaccccgtctctactaaaaatacaaaaaattagccgggcgttgtggtgggcgcctgtagtcgcagctactcggagaggctgaggcaggagaatggcgtgaacccgggaggcggagcttgcagtgagccgaaatcgcgccactgcactccaacctgggtgacagagcgagactccgtctcaaaaaaaaaaaaaaaagtttcttttttcgtatctgtaaattattatttgcaactttatttctgctttgggtttgttttatagtatatataacaaattggtatatagtatgtctatataatttataatttataaatatgtaaatattagggctactactcaacagtatggtgatggtgtttgcacagtgaaaaaatgtttcaagaatactacaatagtgaaacagtacacagaatttaaatatgacttcataggcactactactgaagtttagagaaaaagaattcattgacccatttgacaaattctgattgtctactataagccagataatctgcattttgtcactgtccatgcaacagttctctgaggcaggtatcttcattttgtgttcatgaaaactgaggcttagggaagtaaagtaacccagctaaggtcatgtaactcataaaggatgcagccaagtctcaaatccttatctgttggacttcaaaggtcaaattcccaaccccattctcacctgcctcctactctgctgaatagcttagtatgagagcaaaggttgtgatatggttaggctctgtgtccccacccaaatctcatctcgaattttaatccccataatccccatttgtcaggggaaggacctggtgggaggtgattgaatcatggcggtggtttcccccatggtgttctcattgtagtgagggagttctcaggagatctgatggttttatatggggctctttttccttcactccctttttctctcccctgctgccttctgaagaaggtccttgcttgccccttgccttctgccatgattgtaagtttcctgaggcctccctagccatgtgcaactgtgagtcaattaaacctcctttctttataaatcacccagtcttgggtatttattgcagtgtgagaatggaccagtacaggaaattgatactgcagagagtagggtactgctataaagatacttgaaaatatggaagcaactttggataacaggcagaggttggaacagtttggagggctcagaagaagacaggaagatgtgggaaagtttgaagctccctagagacttgttgaatggactttaccaaaatgctgatatgatgtagacagtgaagtccaggctaaggtggtctcagatggaaatgaggaacttcttgggaactggagcaaaggtcactattgctatgctttagcaaagagactgtcggcattttgcccctgccctagagacctgtggaactctgaatgtgagagagatgatgtgaaattggaacctatgtttaaaagggaaggagagcataaaagtttggaaaatttgcagcctgatgatgcaatagaaaaggaaaacccattttctggggagacgttcaagctgcctgcagaaatttgcataagtaacaaggagcagaatgttaattgccaagaccatggggaaaatgtccccagggcatgtcagagatcttggtggcagcccctcccatcagaggcatggaggcctaggaggaaaatatggtttcatgggtcggcccgtcactatgtgcagccttgggacttggtcccctgcatctcagccatggctaaaagggaccaaggtacagctcagaccattgcttcagagggcacaagctccaagccttggaggcttccatgtgatgttggggctgtgggtgcacagaagtcaagaattgagtcttgggaacctcctcctagatttagaggatgtatggaaatacctgcatgtccaggcagaaatttgctgcagggttggagccctcatggagaacctctgctagggcaatgcagaagggaaatgtggggtcggagcccccacacagagtccccactggggcactgcctagtggagctgtgagaagagggccaccatcctccagaccccagaatggcagctccactgacagcttgcactgtgtgcctcggaaagctgaagacattcaatgcaagcccatgaaagcagagagggggactgtaccctgcgaagccacaggggtggctgcccaaggctatgggagcccacctcttgcatcagtgtgccttagatgtgagacatggcgtcaaaggagatcattttggaactttaaggtttaatgactgccttgttggatttcagacttgcatggaactgtagctcctttattttggccaatttctcacttttggaacgagtgtatttacccaatgcttgtacacccattttatctaggaagtaactaacttgcttttgattttacaggcttataggtggaagggactttccttgtcttagatgagactttggatttggacttttgagttaatgttggattgagttaagactttgggggattgttggaagggaatgattgtgttttgaagtgtgaggacgagatttgggaggggccaggggcagaattatatggtttgggctgtgtccccagccaaatctcatctcgaattgcaatccccataatcctgggagggacctggtgtgagatggttggatcctgcggttggtttaccccatgatgttctcatgataatgagtgagttctcacaagaactgatggttttataagaggccctatccccttcactctcttctgtctcctgctgccatgtgaagaagtccttgcttcccctttgccttccaccattattgtaagtttcctgaagcctccccagccatgtggaactgtgagtcaattaaacctcttcctttataaattacccagtctcaggtatttctttatagcagtgtgaaaatggactaaatacaggttggaaatgttaactggtttttaaagtcagtatgactggaatttggtgagtaaattagcatgacgttttatagatgttaatttcaaaaagaaaaaagaaaaaaaatcctggacacatctggatgagttatcccatgccatgtccttgagatttaggagattaataagcagagccaagctggtgcatctaaaagatttgacttgaactcagagacagatagcatagctaatttcagctggaagcttcttaatctccagggttcttacccaatgttttggctaccatagggaatgccctcatcattgggagagttgctgcccttctctaactatagtttgaggtttgctggtagcattccattctggagagggactgatggaacagataatgccaaatacagaacaaaggtgaggagtcaggcaagggttaggtggaaaaaaggatggaagacagagaaataaatggtaccatgcaaaggagccagggtcttctaatcttgaagttgtgatagacaagccagactattctggaaattatagaaacaagagtgtggcagagatggccagccaatttaggtttctcttttggggatatggcttggaaattcttctcagccagtgacttcactttccagtcccacttgtatctaggtggggccatatgactagcccttgccaggagggtatgactagaaggacacaatggttatgaaacagaggtacctgttccacagtctctctttctcatctacaagccagatggaatggcagcagaggacctagaggaatgcagagccccgtgatggaaggaacctgggccccaagtgatcatgtggatgatggcttaactaggaatacacacactatgctgtgtcatgagtgagtgaagtcactgggaatttgggttttatctattataaaactgcctaagattttaatgccacattaccttagttaatacaaaatcattaacagactcaacaagtggatgaaactaggacagtgtggaaactagttattgatgcagtcaaaaagagtacagtaagtataattaatattgaatcgaaacttttttcaatgctacatacttctaaggagaaaaaaagaaacagagaaagcatggaatgtaaaaacacaacagaagatgacagatattagaccaaatattttagtaatcacaaaatatgtgaactgatcaaaggcatctgttgaaagatacaaactaagatttattaaaaatatcaatttggccaggcacggacaccaaggcaggcggatcgcctgaggtcagtagtttgagaccagcctggccaacatggtgaaaccctgtctctacttaaaaaaaaaaaaaaaaaattatctgggcgtgttggcgcactcctgtgatcccagctgctcaggaggctgaggcaggagaataggagaatcgcctgaaccagggaggcagaggttgcagcgagccgagatcacaccactgtgctccagcctggacgacagagcaagactcagtctcaaaaaaaaaaaaaaatcaatccaagtatatttattaataaagaaatgtacctcagaaaaaatattagtcagatgctaacaaaaacatatgtgtaacaatattaatatgctataaagtagaattcaagatgaacagaattggaagggagaaaaagtagaaattctatgctggccaaagtaacaatctatcagatgacagttatgaacctatattcacttaacaaaccttcaaaatatgttaggaaaatgatagaatcataaggagaaattaacaaattctcaatcagttggagatttttaacattcttctctctgaaactgacagatcatatagatttttttaaatgtagacggaagatatggatagtacacattctcagcacacatgaaacaattacaaaaatgatagttaagtaggttgttctgatcaagtacataattggacataaaggactcattaaaatcagaaatctgtaacaaaattgataatctagcctcctcctatcatatacttgcaattgtaaaaaatactcttaaaagtctatgagataaaaggaaaacaaatatagaaattacaaaatatttaaaactgaataccagaaaaaagcagcgttcttaatatggacttgaagaagtatagttatagcctttttgcaatttgcgttccttgggaagtagactctgagacagagattagtgtgaagagcccttggacccaataactgcagaagggaggtaaagaaggcaggaaggagaagttggtcttcaatgcaagcccaacgacagcctcagtggactccacagggaacacaggagctaaaatgtttttcagagttggccagtgtgattaggacttatattcttgcaaagattagtcactggatgtgggccaccccggtaaggtgtgggacttcgggtgaagcactcacagtagctgagtcaatccctgaaaaggctggcaggtgaagtcggtctgcccacagttctctcagcagctaggaatgaagaattcttcattaaagagggatctgagtggcacatcagtgtcctctccaaaccttggtgcatttatttaaaaataggagacatccaaaataagagctatgctttcaaccgtaataaaataattggaagtaaataagcataaaagcagacattcatgaaacagcaaaaaaatttttatactattttctttttttgagacggagtctccctctgtcgccaggctggagtgcagtggcgcgatcttggctcactgcaatctctgcctcccgggttcaagccattctcctacctcagcctcccaagtagctggaactacaggcgcccatcaccactcccggcgaatttttttttttttttttttgagacagagtcttgctctgtcgcccaggctagagtgcagcaatcttggctcactgcaacctctgcctcctgggttcaagcaattctcctgcctcagcctgccaagtaactgggattataggtgccagccaccgtgccaggctgatttttgtatttttagtagagacagggtttcaccgtgttggccaggctggtctcaaactcctgacctcatgatccacccgcttcggcctcccaaagtgctgggattacaggcgtgagccactgcacccagcctatactattttttaaaaatacaaattatttagataaactttgaccaaattattcaagaatttcaaaaaaagaaatacaatataaaaaatgaaaaaaggtgttatctagagatgaaaataatgattaccagaaatactatagaaactctatgccaataaacttcaaaatcttggtaacaagtttatagaaaaatgtaattatcaaaagtgggcctattttgttgacaaaataagcacacattttgtcagaaaggcaatgggcctagatttttttcctactagtactatcaactctttacttaatagctgattcctatattacataaacctgttctaaagtccagaagaagatggaaagccacacacctcattttataagactagcataatgagaaccatatctcaatatagatacaaaaattataaataaaatacagccaagttcaataatcagtttccagtcctcattttcctcaacgcatcagcatctcagtcacttcctatttcttccttgaaacattttcttcacttgactttgttccacattctccaggttttcctcccacttgctggctgccccttctgaaccttccttgctagtttttcccaatctccccagcttcttaaaattacaggactgacccaggttcagtccttccaccttgctgtctctattagcttccatggtgatctcacaggatctcacacatacatgtattcctatatgatgatgtattatatagggtagtatatatgtattcctatatgataatgtattagagtcctccagagaagcagaaccaataggttgtatatatagagaaaaaaagatttattataaggagttggctcatacgattatggaggctgacaagtcccaagatctgcatttggcaagctggagacccaggggagccaatagtgttgggttttttattttaacttttactttaggtttaggggcacatgtgcaggtttattacgtgggtaaattgtgtgtcactgatgtttgctgtatgaatgaccacatcaccatgtagtgaggatagtacccaacaggtagtttttcaacaatggtgtagttttactgtcagcctgaaagcctgagacccaggagagccgatgatgtagtttctgttggaaagctggcaggcgtgagacccagaaagggctgatgtttcagttcaagcctgaagatggcatgtcctagcatgaagacagtcagtagagggaatcccctctttttcagtcttttgattctattcaggctttcagttgactagatgagtcccatctacattaaggaggacaatctgctttattcagtctactgattaacatgttaatttcatccagaaacaccttcacagacatactagagtaatgttttaccaaatatctaaacacctgtggcaagtcaaattggcacatgaaattaaccaccagagatgatgactgacaaatttatatttccgaattggacttcccctaaaattgtgaaatcatatatccaacagcctgcttatcatctctagttggatgtttaagaggcatcacaaatccaatgtgtcctaaatcaaacttccagttttctcccacaaaactgcttattgcacagttttttcaatttcaattaatggcaactgtccagttaatgcaggccgcaattatctgtgtcatccttgactctattttcttgcatccagactgctggcaggtccccatagctggaccttcaaaacatatccagactccagccacttctagtactaccaccctggtctaaactaccattatgttttgcctggagttttgcagtatcctcctagtctgttttccttcttcaatccttgatgctttggagtctgtttcaatactgcagccccagtgaacccactgaaaacacaaattggattgtcatttctgctcaaaccctatgacggtttctactcttatgcagaataacagccagagtctttaagggtacatgattctacatcatctgtcatccctcctacaactctcaacctccgtccattccagtcacactgcccttcttgctattccctcagacaggcacctgagaatctttgcacagctgtttcctctgcctggattactcctctagatagctacatgacttccttccttgccctctgcaggtctttgctcaaatactgtattaccttctcagaaaggaggactctaattttacctgtgataacacctaattttttttttttttttgagatggagtttcactcttgttgcccaggctggagtgcagtggtgcgatctcaactcactgcaatctccgtctcccaggttcaagcgattctcctgcctcagctttccaagtagctgggattacaggcgcctgccaccacacctggctaatttttgtatttttagtagagatggggtttcatcatgttggccaggctggtctcgaactcctgacctcaggtgatccattggcctcagcctcccaaagtgctgggattataggcatgagccatggcgcccagccctgatcacctaatttttaaagaagacttgtattagttcattttcatactgctataaagaaatacctgagactgggtaatttataaaggaaagagttttaattgacttacagttccacatggctggggaggcctcaggaaacttacaatcatggcataaggcgaagaggaggcaagcactttcttcacaaggtggtaggagcgagaagagagcaggggaaactgccacttataaaaccatcagatatcatgagaactcactgactgtcatgagaacatcatgggggaaaccgtctccacaatccaatcacctcccaccaggtctctcccttgacatgtggggattatgaggattacaatttgagatgagatttaagtggggacagagatccaaaccatatcaactatattcatatattactaaatacatataatttagaaattgtaaagacaaaaaagccacaatttaggttttttaaaacatttgaaggcataggactggttagcaaaagatctttcccctctggggttttggatcatattttttcagcattgacaatctataaactataagctgacaatctataaactgaatttatagatacacttgtaaatataaaactgatcagtgtaacttctttcaatttcacaagtaaaactgattttctttaaaactaaatatatattttttgtttttatccttacagaagctgctgtgggggtgggaaacacaagggtcactgtctctgttttctttctacacatgacagtatggcattactgatgctgagattcatttaaaatccagggcaacaaggattgtacccattccttaacgtagaatttcttgaattcttagtggatgcatactgctgaaatggagatttaattgtaagtcccaaagacttgtcacccagcaggcttttcactgttttctcagatccagctggcctagttctacatggatagtatcacctgaagccactagagaactaggggccaggaaaatccttggctaactaattgggaacctaatgtggtaactgtggtctctcttctcttcaacttgtaactctctggagatattagaatctggttcagaagagagtcctgaaaagctgcaataggctcttcttgtcttgtcctaaagcaattgtgacttttgaaaaatgtgtgaaaaaatatagtccaaggagctgtagaaattgacaaaaaatcatccagagatgaaaatgtgcttaatttgtcacctaaatcatattatactgttgtctgtgagtagaagttggcattgtccactttgtgtctgatgattaatcatttaggtagtatctgttaggaagaggactcaagaaatagcttctaattttagtcagaaaaagtagcactattaatagcggccttgacattctgcaaagccaaattaagcagtcaacctggcattttataaacgggctgttacagagcctcacatctggtagatattcgataagcattaattgcctggctgactatgagcagccacatagctgctgtaatagagtctgcacatggtggtgggataaggctgattctgatgtactgtgggacaggaccttgtgaacatgaagaagtatgtgggtttttgttgttgctttttttttttttcaaattaaatgacttcataatttccttttgaaactgagcacatttcattaaaaatggatttccttttgtcaattcaaggtaagttaccaggtaacagtgatattggtcaaatgttacctcttttttaaatagaaagctgagagccttctaaagagccatcatcatattcttctttaaaattatttgaatcaatgccagagaaattgttaacatttcagtcattcatttaattttcattatcgcgtttataattagttcattgtcttcattatagtgaatggatggataatggtgaagtctggtctacattttattcttttatttaaactgattcacatctagtaaatgtaagtattatgaagctagaaaaatagttttaaagtaataataatagctaacattttttatcatttacactgtgacagtcattgtgctaagcccctttatatgtatttgtttcaaatatatattgaaatatcactttatttttctgccatatcttttctatgcttttaagattataacttttatgctgttttatttaaagtaaaatttgcattcatgcttatttgatctcaggtatacggtcaacctcagcttcatccaaaagaagaccacatgtttaaaggataataaagctgatggaatttttaaactcttaaaaattagtgttgagcgaaggcagatgttttacaaaagaggagaagacatctgatcctgtgagcctgatgaattggtataaagaattattggaatctgtagaaatgccatgattctgtttatcgtctttgtaaaaatctgatttggaacgaattgtccatagagtgggatgatccagctgcttgttgaatcggttgcttttcattagcccatctgatgttgactgcattctgggcttgcatgcctgaactcctgaaagattgaattatcagtatgcttctcactcagagagctgtgactctaatgagagattttcatatcaaatcattcatatcactttataatcacaatacaagtattagatgctttctgatcctgctacaattatgggaattagctaacttcatgtgaaattccagtaatagatatgaatgcatttctcaggtaggcaatgaatattcatccttctgaggtcaactgtggtttgaagaagtggaggagaggaggtctgtaagtctaaacacagcctgattctgtttgtctttctttgaattgaagggcctaccagtttcccagtttatctggcagtctttccaacttgagagggaggcacctgagtaggcacagaagaatggtggtgaaggcatgggttcaagtcccgactctccctcttaccagctttatcgccttgaaccgtttgcttaatttcactgggtctcattttctcatgtttaaaatgaggtaatagtagtacctgacttcacagagttgtgaaaataaaactttaattcaagtaggactctgacacagggcctgccacatggtaaaagctgggtaaacatgagttgctattgtcattgttctcattatcacaccagagctatagggaggccctagaagaaaaaactatttatctttcttttaatgatggagcaaagctcatttcacccaagagaaaatgaagatcaagatgggtaatatgtaaaatataattatataaattttgagaaataaatacattatatatatataaatgttcataggattaaaagaagtccatctaattattttttaaaaggtgtttgaaagcttgtggatgattcctaaacccttttgtttccccatttttataagatgtagagactttgtgttagcctgcatggacaaagcatcaaatgtgtttgcagaaaaagtgagcttgatgggaggattgcttgagcccaggagttcgaggttgcagtgagctatgatcatgtcactgtaccctagcctgggtgacaaagtaagaccctgtctcaaaaaaaaaaaaattaactcgaacatttgggaagacttgaactcttcatattcattgagctgacctgttcttagattaggaaggtgccagggaaatggttgcttagcaactaatggggttaaatgaaacagtctgttagctgggctcttgccctgtctgtgtgcatgcctaataaaggagatggtctccagtgggtattgcttgactcacagctgtcaaacaaaagtgatgaataaaatgcaagatcgaagggagggtccacacctggactgggcatctatatttatggtcatataccttcctttatgttagatgttgaagaaaaagttattaagagaggacattaaaaataagagagggactgttgaaattgagggttaaaattttaagagcgatcattagtttacattgagttttaagagactaagataataagtgataactgaggaaattccacactattatcttcaacattcttctaaaaaattctctatagaaaagggataacagggctgggcgtagtggcttacacctgtattcccagcactttgggaggccgaggcaggtggatcatgaggtcaggaattcgagaccagcccggccaatgtggtgaaaccctgtctctactaaaaatacaaaaaccagctgggcgtggtggcgtgcacctgtagtcccagctactcgggaggctgaggcaggagaatcacttgaaccgaggaggcagaggttgcagtgagccgagattgcgccactgcactccagcctgggcaacagagggagattccctctcaaaaaaaaaaaaaaaagaaaaagaaaagggataacagatcttatggatgacattgtgaattctaggacagaaattgtgtgttttagtacttgtctgctcctggtccctatttatacccatgacagacattatgactagatcctgaccactctcacttgagctggatgtggcttacagccctcaacggggctgcaggaagccattaccaatatcagattgggcaggtaagaaacttccatgtcattctttatgacaaattgaaacttgttaaaaacttctactttttgaattccataggaatattctgaatgatttgtgtcaaaagcagctttgaggtagccacatgaaattcgtcttaaggaaaattgataagaaggaaatggaccagagaaaatcaaccaaaataattgggggaaaagggagacagtgtgaaagattttcctgaaagttcttaccactgccaccattcacaagcttaggatgatttactctttcaaagaccatgtccttgaatccactttctttcttttgaaataccttttattttctgtatagtaaacactcccacccctccaaatctagggatcagtcctcccatgctgggatttggactcaggccttctgcccagcctacaaaacttcgagcattggcttcaagcactaacattttatgactccgagaattcagattagatactatttccagtaggagactctagagctgttactgtatatatttgaaaggctattaagcagaaaagagagtgaactcattgaccttctcctatgaccaaggggagaaagctatcaagagggtgattggaagtcaatattttgaaggttttactaatatttctccagcaagggacagcctgtcatgaaaaatattaggtgtctcatcacttcaagtattcaagtatgcaaggagtgctgcaaggcggggaggactgactaccccagctgtgcttctcaaacatttatgtgcatgtggttcacctggggctttcgttaaaactcagctttcccatctagtaagtgtcgggtaggagccgagattctatatttcttacaagttccttggcaataccaatgctgctattccagggaccacaccttaagtagggaagggccagtgatctctaaagtgttaacattccaaaattctatttgcagaagagaggctagagtttagtcttgcttcttacacacacccagcacagctttgaaaaccacacaggagtctcttctggtcttagagaattctccctgaattcctatcatattttcctcagtaaagaatccccctctctgtctcctcagttgcttcacttctttctgcaggctttcaaccttttctgatatcactgttctctaaataaatttccttttttcatattttctctgatccatgcagactctaatcacaactgctcagtcattccttcgtgcaagccccaaattctgtcttaggacagctgtcaaaattcaggaaatctaggttatgtctcagttggggtgtccttagaagtttgtgaagagcaggattgtgccattggctgccatatgcgagagatcaaacagcctcttcaattaattcgattcattcaataatggtttagcaaatgtattcaataagaaagcgtaaaagtgccatccctaaacatctgaaagaggcaaatttgtgatagataaaacaatggacttctttgtatggtgggtaggaatgtattgtgatcccacgttcaggggatacaattagaaagtaacagaactaccagaggaataaggagaaccatagggatctgagagggcaacccaaggctgaagtcaaatgtgtggatgccactttccagaagacagaaagactggcaaggacaaattttgtgagttacccaactgcatggtgagcagcagtttctggccttcacaattaccataactttggctaagaaacaacttgatttgtgtcctttttttattccaccctttcctctcccagaagacccaggtcgttgaaacatggccacattcaagaggaggagaattctaaacagacaggataaaccataatgatgcttgttttgaagagctcattatcactgtatagttaatttaggaagcaactgtgccaagagcaaagctgtgaaatgcagctagatcctttaaataaacaagctacatatttgaagattttagaaaaaaaacaatatgtaacataatttttagcatataagatggatctttatgtggttaaggtgagggaaaattggtattttacagatattaatttgtgttgcctaattatatttacagtaatataattttactgttttagtttgtcttgtgatattttattctctgacagtattattatactatgggaggaaaaattaaaacaattgtaaagaggaaagaaaaccaccaaccaaacatcctcactctttcataccatttagctctccaggtggattgggttatttttttcatttgcaagataaaggaggtaaatagtccaatttaactgtgattgggaccctcctctccctaatggaagggaatggactattgcagttaattgaatggtctcattaactgagatttactacccattctatatgtgaggtgtaaccaaaatgtaataaaggctaataaccattaacactaaattgagcaaaatgtaatctttgttgattcagaagttagttcaaatctctgtaatgcctcatggccattgtaaacatcattaattatgtaacagtgggcatatagaagatgtaagatgtaatggatctactgtaatcattgcgagttgctcttttcaatgacttccttaaacatgtctttttactttcatttaactctgtttaatgcttataaaatgtaagggttgaatgtacctccaaacaattcagttatttcacctgtaagattatttgtattcttgataaaatgggagtcgcagtggttttgcctgtgttcagagtaactccaaagctgcacatagtttgccaggtaaaaagatcatattttaccagatgctttaaaaagtctatcatctgccattttacttatctatgaagatgtagtagaatttttgtcagttttgtgtcgtaaggtaccaccctaaaatgtagctgtaactaatcttgtgtctgcatgacaagtaacatgactcaagaaaacgtcacatactgtgattttaggactcaatttgcatcacttctgtgtgaaataaagagggaataacacaccataaatccacacctccctctgtggtaggcacttaaagtggattatatactcacaaactaggttttcaattagaaaggtttgttgttggtggcagcacattatcagccacaaatgagctgtgatgactgtaaatctcagcctggccgaggctctcccaaagacaaaatcttgtgaaccaagcatgagtctgtgcaatgctttcatatttctaagcagaactttatcccatgctttggcagaatgttgtgacttgatagagaacattgacatatgttcttttttttctaaatgtctagctttgaactcacttgtgtttctcaaatgtttagcttacagtagatgctctttctctttagttacgattttacattttggtatctaaaacaccttacatgcagaacatttctgttacatagaatgaattctttttgtttatgacactgtagggtggtaggacatcatctgcagatgagttttgaagatgatattggttgattcattcattttctgtatttattgcatgtatgcactcctagaatctgggagcaccacagtgagaaaaggagatatggcacctgccttcatggagcctgcactctaccttttcaagatgttatatgcttaaaaatattactgctggtctcatcacctcttttgctgccaaggagactttgaccttcctcctggtttctagcaggtctctggacattgtttcactagtttggatagactaggcaactggtgtttcactgtaccaaatggccaagttcttccttatcaccaagtggtatccaatgaggctcttcctaattgagatatcttttaaatgtattatacccaagacattgaccttgatataatagttccccttttttaatctttagattagttctagtttttaaaaattataagcattaagtttttaacattttttttttttgagatagagtctcactcttttgcccaagctggagtgcagtggtgtgatcatggctcactgcagcctcaaactcatggggtcaagtgatcctcctgcctcaccgtcttgagtagctgggactgcaggtgcagaccaccatgctcagctaatttttttttattgtttgtagagatagggtcttcctatgttgcccagcctggtctcaaactcctggcctcaagtgaacttctagcctcagcctcccaaagtggtgggattatagtcatgacccacggtgcctggcaatgttaactttctaaaacagtatgatgtgatgtcaaagtggaagttctgtatttatagaagtggtggtgatgatttttataatggggtcattccataaagtagaagtctaggagtatgttgcaaaagtaaagtcctgaagccagagatagggatttagagtgagactgtcatttggaaactatttgaaatgaatggatttagtcagcagttgagtggagggtgctgtttctcagctctcgtttcaattggagtcaaagggagacatgggacagtaagaccatcaacctggattatagcgacagtttctatataacatttactatgtgccacatattatgcctaacattaagcataattgtatttaaacctataacaaccctgtgaagttggtattattcccattttacagataaagagcctgaggctcagagaaggtaacaaattagccaaagtttcaagataaattgcccacatgactagtagtttatagaaccagatgtatcttcctgcatagttctgaacattaaaaataaagtttttaaaagggagttgtttgaaatacataagtaatacatgttcattgcagtgatccaaaagatacttacgtaaacaggataaaattaagtctcttttttccctctacaatcgtactctataatatagcaattatagatgcatttaattgtattgatataaaatgattaccaatatggtgttcctttattgctcatacaaacgtgcaaatatagatatacattatttaaggaattgtgttttcctcccaactctactaactctctgatgaggatccctattctatgccagtgttatcctgattacttttgaaagaccctagaaatgtcgatttttaaaactcctttggcagcctattttgtttttttaacctttgttctcaggaagtttttccatttcattaacccagatcattcttctgcagtttaagctattttgagtcctgctgtatatacgggattggtggcaagcaggccgtcagcacatcaggggcaattacaacttggaagatctgaaaaaagaacttggttggtgtggggaatgttaaaaacttaaccactcatgtaataaaaagcagacactgaaaacaactgaaatttctttcaggttctttcaaggagttcagaagcaaattcaacattttataaactaaaggtttttatttaactgtgatctgttttttaattttggaatttcgggtaatcttctgcaaatgcataaacaaaatctacttaactctaaaggcaatttcctgttagcttttttttttttttatctatagccacacttgatttaaaaaaacaacaacagaaactggtgcttctcctaacatatcaatccttttagccagggaatacataaaagaaacttcactacattttattgttaccacaaaatataaattttactaagagcttgccatatgtcaggcactgttcactttgtatgtatacttaatagaccgcagtatagtgtcaacataacttttatatgtactgggaaaccaaaacatatgtctgactcactgtattatgatatttgctttattaagttggtctgaaactaaacccaccatatgcctatataagtgagatcattcaatatttgtctttctgtgtctagtttatttcacttagcataatgtcgtccaagttcatccatattgttgcaaatggcaggattttcttcttttttaaggctaaataatgttcgtatgtgtgtgtatgtctcacattttctttatccattcatccgttgagggacattaagattgtttccgtattgtggctattgtaaataatgctgtaataaccatgggagtgtggctatcactttaagatactaatttcattttctttgcatacatacccagaagtgagattgttagatcataagctagttctttttaaattttttttagtaccctctctactgtttcccataatggctgtaccaatttacattacaaccaacaataaacaaggattcccttttctctacaacctcaccaacacttatcttctgtctttttggtaataattattctaacgggtgtgaggagacccctcattgtggtttttacttgcttttccctgatgattagtgatgttgagcatctttttatatacctgttgcccatttgtatgccttctttggaaaaatgtctattcagatcctgtgaccattttaaaattcagttatttaattatttatttattttgctattgaattttgagttccttaaatattttggatattaaccctttatcagatatatggcttgcaaatatttttcccattctgtgggttgccattttaatctgttgaatgtttcctttggtatgcataaggttttagtttgatgcaagcccacttatttttgcttttgttgccagtagtttggtgtcttatccaaaaaattattgcttagaccaatgtcaaggagcttttcccctacattttcttctgtattgtttcaagtcttacatttaagtcattaatacatttaagttaatttttgcatatgatgtgagataagggttcaattctattctttggcatgcggatgtcaagtttttcctgcaccgtatattgaaaagcctgtcctttccctattgtgtgttcttggcaccctgtcaaagatcagtttaccatagatgcatggatttatttctgggatattctgtttgttggtctatatatctgtttttatgacagtactatactgttttgattactgtagctttgtaatatattttgaaatcaggaagtgtgatgcctccagcatgttctttttgtttaagatttctttggctattcagggtcttttgtggtttcatttgattttagcatttttttttctatttctataaagaatgccacttgaattttgataggggttgtgttgaatgtatagatcattttgggtagtatgaacattttaacacatttttttcaatccatggacatggatgtctttccattttatctgtgtctttgatttccttcaccaatgttttataattttcagttaacaagtctgttacttctttgattacatgtatgcctaagtattttctttgttattgtaaatgggatggttttcttaaatttctttttgatgactttcctgtttgtgtacacaaataccacagatttttgtatgttaattttgcaccaaaaaactttgttaaactcatttattagttctaacattgttttttggttgaatcttcagggtttcctacgtatataatcatgttatctgtggaggtaatttcactttttcctctcccatttggatgctttttatttctttttcttgtttaattgctctgggtaggacttccagtactaagttgaataaaagcggtctctcgtcttctcttgccatcttcctttgttatctgattatttttgtagtatttgccttgattcttctctatttatcttttgtatatctattataagtttttttctgtgtggttacctcaaggctggcataaaatgtcttgtagttacaatggtctattttaagttcataacaacttaactgcacacagaaattccacacttttaccacctcccccaaactttgtgtttttgtagtcagagtttaattctttttatattgtgtatccatcaacaaattttggtcttttatcttttaaatgttggggtaaaagtaacttacacaccaccattacagtgttacattattatatatttgtctgtatatttaattttgccagtgagatttatgttttcttatgctttcacgttactgtttagcatgtttttgttttcaatttgaagaacccccttagccattttgtgtaaaataggtctaggagtgacaaactctctcagtttttgtttccctgggaaagactttctctttcatttatttttaaaggatagttttgccagatattgtatacttggcagtttttttctttcagtattttgaatgtgtcgtcccactctcttctggcctgcaacatttctactaaaaaaaaatccactgatgtcttatggaggtggttcccttatacatgacaagtcacttttcttttgcttctttcaaaattctctgtctttaacttttgaaatttaattataatgtatcctggtgcagatctctttgtattcaacttatttaggattctttggggttaatcaatctggatgtccacttccttccctgatttagaatgtttttggtaattattccttttcaataatctttcttctcctttctatttctcttctctttattaagctttcataatctatatcggtttacttgatattgttccataaaatccataggctttctttactcctttttattcttttttcttttttgtcctctgactggataattttaaacgaccagtattcaagtttactaattctttcctctgcttgatcgagtctggtattgaagttctctgtcgcatttttttatttcatttattgtgttcttcagcttcagaatttgtttgcttcatttttgtggtttacatttctctaactttccctttcatttatgtattacataaaatttacatttctctaactttcccttttgtttatgtattactttcctgatattattgagttgtctatatgtgttcaatgataatttcttaaaacaataattttgtcaggcaattcataggtccccatttctttgggatcattactggaaattatcatattcctttagtggtgttatgtttccctgacatttcatgttccttgtagccttgcattggtgtctgagcatttgaaggagcagttacatctttcagatattacagactggctttggtggggaagactttcacctgagatgtgatgatacctgaggtgtgatgatgggtggggtgtgtggtggttcttaaataatcacctgaggtgtgatgatgggtgggctgtgtggtagttctgggtccagtgcaagttgtgaggaatgtgcaggggcactggttttggggattgtgtgacactgtcatggtgcatgggggtgccaggtcctggtgcaggtgtaagacaagtgacatcacacccaggtgtgggctcatgtgaagccgtaccgggtgcagggtgccagagtggccccctccagctccaggggatgcaaggcatgggctccaggcatctctgtcagctgggatttgtgttggtaaagactggggatctttagcagcaaagactgtaggaatcctcctgctcttttcccctatggggggatatagtggtcaaggcaatttctgttggcactaagctgtactatgtggaacatcctcagttctaaaaaatgttcaatttttaaaatttatgataaagtaaatttctgaaagttaagtacattatgaatgttagctttttaatatatcaaatataattgaatatattatatgttaaatactcccaatagctttaagatattttgaatattattttattttttcaaattgtatttaaaatatattttagaaaatttcttaaatggcaagagagcaataatttagtgtttctaacagtgaaaggtttaactataaattaagctctcaaaaataatccttttcattatgaaaacataaaactctctaatgcagtgagatggaaatgaagatctctacaaggaataatgggtcatcagtttatattgtccatcttatacatattaatttaaaatgtatagacttgtgaggataaaaaaataacatttgttaaaataaaatcctattagttcaatagtacaaagaatataaaatacctaggaatcaatttaaccaaagaagtaaaatatctatacaaggaaaactataaaacactgatgaaagaagatgatgccaaaaaaagggaaagatactccgtattcatggataggaataattaatgctgctaaaataacaatactatccaaagtagtttacagattcaatgcaatccatatcaaattttcaatgacattcttcacagaaatagaaaaaaatcttaaatataaatggaaccacaaaaaccccaaataaccaaagccaccctgagcaaaaagaacaaagacattacactatcagatatcacaatgtactacaaagctatagtaactaaattagcctggtactggcataaaaacagacacatagatcaatggaatagaatagggaacccaaatataagtccacacatttacagacaactcatctttgcaaaggtgccaagaacatacaatggggaaaggccagtctttttaatacatggtgttgggaaaattgcataactatatgcagaagaatgaaactacacccttatctctcaccatacacaaaaatcagatccaaatgtattaaagacttaaatctaaggccccaactatgaaataactagaagacaatattggggaaatgctccaggacattggactgggcaaaggctttttgggattaagaccccaaaaacacaggcaactaaagcaaaaatagacaaatggaatttcatcaagctaaaaagcttctacacagcaaaggaaacaatcaacaaagtgtagagcaaacccacagaatggggacaaatatttgtaaactaccatctgacaagggattgataaccagaatatataagaaactcaaacagttcactagcaaaaaaaaaaaatccaatttaaaaatgggcaaaaatagatatttcttaaaagaagatatacagatgtccaatagatatatttaaaaaaatgctgaaggtcactgagcatcagaagatgcaaatcaaaactacactgaaatacctcaccccagttaaaatggcttttatcaaaaagagaggcaataacagattctggcaatgatatggagaaaggggaaccctagtacactgttgacgggaataaattagtacagccactatggagaatggtatggaggttcctcaagaaactaaaaatgtagctagcatatgactcagcaattttactactgagtatatattcaaaagaagggaaatcagtatatatataaatatatctatatatctatatatatctccaaaggaaaggaaatcagtatatctgcactcccatgtttattgtagcactgttcacaatagtcaaaatttagaattgggctgggtgcagtagctcacacctgtaatcccagcactccagcactttgggaggctgaggcaggtggatcacttgaggtcaggagttcgagaccagcatggccaacatggtgaaaccccgctctactaaaaatacaaaaattagctgggtatggtggcacgtgcctgtagccccagctactcaggaggctgaggaaggagaattgcttggacccaggaggcggaggttgcagtgagctgagatcatgccactgcactccagcctgggtggcagagcaagactctgtctcaaaaaaaaaaaaaaaagaaaaaaagaaaaagaaaatggaattaactaagtgctcatcagtgaatgaatggacaaagaaaatgtggtatatatacccaaagaaatattatttagccataaaaaaatgaaatcctgtcatttgcagcaatgtggatggaattagaggtcattatgttaagtgaactaagcctagcacaaaaagacaaatattgttaagttgtcactcatatgtgagagctaaaaaaagtgaatctcatgaagacatagagtagattggtggttaccctacccagtaggctgggaagggtcgtagggagggggaggatgatggggatattgaataatgagtgcaaatatacagtttaatagaagaaataagagctagtgttagatcagtagagtgactatagtttacagtaatctattgtacacttgaaaatagctagaagacagccgggcgcagtggttcacgcctgtaatcccagcactttgggaggctgaggcaggcggatcacaaggtcaggagttcaagaccagcctggccaatatggtgaaaccccatctctactaaaaatacaaaaattagccaggagtggtggcgggcacctatagtcccagctactcgggaagctgaggtaggagaatcacttgaacctgggaggcaaaggttgcagtgagctgagattgtgccactgcactccagcctgggtgacagagtaagactccatctcaaaaaacaaacaaacaaacaaacaaaaaacaaagaaagaaaagaaaatcgctcgaagagaataatttgaatgttttaagcataaagaaaagatattttaaggtgatagatatctcaaatacactgatttggcaattaaaaattaagactatattaaattatcatatgtacccctgaaatatgtacattccttaggcattgataaaatttaaataaataaataaaattgctaaaagatgaatattgatacattggcaaaagtaaaaaaaaaatcacatttttcaaattaaaaaaattcagcatgaactaaataccacatagcatagtgaggtttttttggttttgttttttatgactataaagttagctaaactgcagaatctcagggaacagttcccacaaaacttctctcattatcagtaaacaaaattgaattctctttatatttcttaagtcaaagattaaaggtgcacaaattagcatggggttgtattttttttttccttttaaaatgcatttgttttaatttgtcaagtttttgtctttttaatttcaaattttcatttgacatactgatttgcagtaaattggccatttggagaattggttgggggcaaattcacttgcactgaatagctgagtggttctcaaattcaagtgggcatgagagtcacctggagggcctattacagcacagattgctgggccctgcttggagtatcagtttcagtaaatctgcattggggccctgagagtctgtactcagacacgttcccaggtgatcctgatgtcgctggtccaagggctacactttgagaacaactgaaacggagtgtgtgatacatggctttgtatccccacccgaatctcatcttaaattgtaatccccatagtccctataatccccacatgtcaagggagagaccagatggagggtaattggatcatgggggcgatttcccccatgctgttctcatgatagtgagtgagttctcacaagatctgatggttttataaagggctcttccccttccctcggcacttctcctttctgctgccttgtgaaaaaggtgccttgcttcgccttcaccttcgccttcgccttccaccattattgtaagtttcctgaggcctccccagtcattctgaactgtgagtcaattaaacctctttcctttataagtcacctagtctcaggcagttctttatagcatatgaaaatgaactaatacaatggcagatgagaggaactagctgtttcattggactgaggcagaaaaaagcagagaagtcagaagatgaaggcttttcatgtcctattgggcaggatgtttggcattgctgcatataacttggtagcaatgagaatccaggaccaagagaaagcgttcggtgggcctaaatactatcacctcaaaatgagactgtgtattacatatagaagtactgtatatggtgaggaatgccatcctgtgtgtgttgttattgcaactgttcagacatcaaaatgatttgcagtggtttgtgtgaatgacactttctagaagcatttcaaaaatcaaaatcaattattaatttgtaaaacttttttttcccctagtctctctagaattttgtcttgctcccttgctgtcaaagtctcataactgtctttctccctttcctcacctcaggcaatgttcagtctttgtatggtggaaagtggagctgatgaggttaatttgcacggtgtgaccagccttggcttaaagcaggctctggagtttgcatacacaggacaggtatggtattaaatgtgatctgtaaagtttaacatttcaactacatctaaccaaaggagattatccttgaggtatgagatttagttattgttcttgttactcattttgatgttaaaaataagattcacatcctcttaattttatgactaaagttatggaaaggtaagtaaagcaatttgattttttaatatgatccagtgaacatagtattttaaatttaactcagtgcttgctggtgtaattttttgaatatcttaaagaactatcgtaagggaaagagtttgcaagataatggattctcattgttatcactgaagctcggtgactcaatcatggctttattgccttaaaaacaagacaaaaaatttagatccccaaaaatttatgtccaacgtcttggtaccatgtcctccacatatctcagagtcagaattgaaggcatttagattagtagattgtgatggtttgaaatcctaatacattaatgaccaaagttgttataggatttataggacatcagaggatatccatttacatttgagaactactcaaataaatcaattcaaatacagactggatgtttagctccccttttataaattgttgttctttaacaacatttcatccaacgtggatttagtatcttctatgctaaaatgaaagtgtcttctcttgagatgctcacatcctagtaagagaaagacaggcaaatacatgattaaaatcctcactggtattggagttataacagaagcagaatacaaaacagagtgggagaaggatgcatgtggtcaggtgtggctatcagtacacaattttacagatagggtggtatttgtgtcttgaagaatgtgtgggagctcatttttctactgaattttatttttgtttaattttattcttaattagcaaataataattgtatatacttatgtgatgtaaatgtgatgttctgatatatgtttacaatgtggaatgattaaatcaggctaattaacaaatttatcacctcacctacctacctattttttttgtggtgaaaacatttaaaatgcactcttctagcaatgttgaactatacaatgcattattatttattatagttaccattctgtgaagtagatcactacagcttattcctgctgtctaactgaaactatataccctttgatcaacatctcccattagtccatccacccctgctacagtttggatgtttgtcctctccaaatctcatgttgaaatttgatccccagtgttggaggtcgggtctgtaggtggatgttggggtcatgttgattgattcttcgtgaaaaggctgatgctctccctcagggtgtgagtgagttctcactgttaattcctgaaaaagctatttattaaaaagaggctggcacctccttcccactctcgtgcttcctctcttactatgtgatcttggcacatgccagctccgcttctcctctgccatgagtggaaacagcctgaaaccctcaccagaagcagatgctggagctatgtttcttgtttagcctgcagaaccataagccaaataaacctctttcttatataagttacccaatgtcaggtattcctttataacaactccaaatggactaagaaaacaccctcccctagcctttggtaaccatcattctacttgctacttctatgagttcaacttttttagattcagcatataagtgagatcatgaagtatttgtctttctgtgccttgcttatttcacttaacataatgtcctcaaagttcatccatgtcattgcaaatgacaggatttatctgcttcttaaagctaaatagcagtatgttgtgtatacataccatcttttctttattcatctgatgatggacaactaggttgcattcatatcttagttactgcgaataatgctgcagtgaacatgggtaggcagatgtctctatagcatactaatttcagttcctttggctattacccagaagtggaattgctggttcatatggtaattttatttttacttttttgaagaacctccatactgtttaacataatgggtgtattaatttatattcccactaacagtgcacaaaggtttttctccacaccctcatcaatacttgttatcgattgtcttttttttatagtaggggtgaggcgatatctcaccatagttttaatttgcatttccctgatgactaatgatgatgaattttttttcatatatctgttggccatctgtatgtcttcttttgagaagtgtctattaggtcctttgccagctttttgattgggttatttattttctcatcttcttgtgatggctctagctttgttctttttgcacaagattgctttaactattcgagttctcagttgtattttttttttcttgtctaatttctctggctagaacttccagtactatgttgaatagaagtggtcaaaatgggcatacttgtcttgtttctgatcttaaaggaggagctttcaacttttcaccactaagtataatgttaactctgggcttttcagatatggcctttattgtattgatatacattctttctatgcctaacttgttgagagtttttatcatgataggatgctgaattttgtcaaatgctttttctgaatctattcagatgatcgtatggttgttatctgtcattctgttaatatggtatattgcatttatttattaatatttgcatatgttgaatcatcattgcatcccagggataaatctcccttgatcatagtgaatgattcttttaatcattcactgtgctgttgaatgtagtttgctagtattttcttgaggagttttgcagccatgttcatcatggatattggcctggaattttcttttcttgtagtgtctttgtctggctttggtatcagaataatgctagtctcataaaatgaatttgaaagtattccttctttaattttctgaaagagttttaagagagattgatattctttcttctttaaatgtttggtagaattctgctgtgatgctataaggtcctagatttttctttaatgggagatattttttattaatagtattgatataatctccttacttgctattggtctgttcagattttttattacttttttattcagtcttgctaggttgtatgtttctaggacttcatccatttcttctagattatccaattttttggtgtataattattcatagtagtctcttatggtcctttgtatgtctatgatatctgttgtaatatcttctctttcatttctgattttatttatttgaatcttctcgttttttttcttagtctggctaaagttttgttgattttatcttttcaaataatgaagtttcactttcattaatcttttctattgtctttgtagtctctatttttcactaagttttctttagaggcttattaaaacgtatgatatcatttattctcttttctggagttagtagaatttaagatatgtgtcttagaataattgaggcaactctggcagctagaagaaaatagtaagtataaaggaaataagccattaatcaagtagaaagtataacaggagaaagaaaggtgatggatcacaaattcaagattagcccagccaaatttcaagacttaggaaattaaggcaggccattatcattcacagagttgccaaaatatattcctagtgaagtgagtaaatcatgtattttgtgttttttggtttacagatgtgaagaaagataccatctctaaattctgtcttattatttctctttttatacttgaattacatgcagtcacatctgtatttgcccatctctagagtaagattgaaaacccatagctcttacttcacaggtgtgccatgggatgaaatagtaattttttttttgtaaaactacccaagtaaataatatctgcactcagctgcattagcaactaaatggtttaagcttagaggcaatggtctgtaaagcatgtttgaagtattaggaaactcaagagcacaaattcctgggaaggctgagttaaaatacacatgcaaatatatgtggctgccttattgcttgcttgattgctttgtgatttccttcagaatggctaagttgatgtgtatgtgcgtgtgtgtgtgcacgcatgtgtgcgtgtaattcctgtcacacaaaggatctatgaaatgtgaactgaagtgaagatagcagaaagggagctgactttttgaaggtgaagaaacctacttggaaagcaggaagatatttgcagaagggcagccatatcccattgcccaggagtcatatgccttaggtgcttaaattctacttttatgagaaaaagaaagccaaatgagatgaaaatatatctggtgtaagtgcctttaaaaagaaagaaagaaaagcaagtcctagggccagatctggggttgcaattattctgtccaaacaccagagacttattctgactgtgcatccacagaggcatatgacagtctgtggcatacagcagtaattcatctgttcaaattgtgtgctgagaggacaggaagggggctgacatttcctggagcaccttctgaaaaagccaggggacagcactaggcactttatgcgtgctgtttaaactaatctttaaaacagctctaaggaatgctgtgaccccacttgaaagatgacaggcccagggaaatgcagtgaattgactaagatcattctctcatatattttggcccaattagtcaaaccgagtcctactaatttcaagtctgttgttcgttttttattataatctgtcattaagaaaagattaagttatactttgttatactttgttgaaggaggcagaaaagtgtttgggcatttacagagtccactatcttggtggttttctaaacttggaaactgtgccttttcaagtcagtccatgagggcttagacttgttctccctatgtgatcactctttgccacagagtagaagttgatacctctacagcctttcttgaacaacatccaagaaagtttggttctgaaacatctttaatttgtaataaatctattttccctttgagacatggacacagctgatggcaaaaagaatgaagttgcagtttacttgagattgttgaacagctgctttctcttactatggagtcgacattaacattaagcaaaaaggttggagcataggaatgtgagtgaaagcataattcttcagtttcttaactgttatttagtattagggacattcactgacatgtagtctttatccgtgatatgtatatagatttgtaaaaattcagggttaacatcgagtgtatctgcctatagctatttctaacagttgattatatgtttagtcagttgtaatatgcatagtatgaaatgtacgtattttaagtgtctgaaaattgttgctgtcttggagagaaattggaagtatagagtgggagtgatgaatgaatgcctctaagtgtaacaagatgtgtgcgtgttcctcctacacattgctctaaagtgtagccttcttaaaattggcctacagatttcatccaggaaattttaaagaaaaagcaaattttcctcttaatattaatacatattctgaaaatgcatgcatttcctatcaagtagcaaacagggctgcataagcattcactctgcctttgcactaatgagaaatatgcccttcttctgggcacactgtgtttgggacactgcttgaatagaccttgggatgcagtgcagtcttcatgggtgtccttgcacagccatgcatggaggccattattacagcagaaccaatggtggagggcatagaggccaggctgctcttgctctgcagggcttgttttgggagcaaggttggaagcaaatggtgacataaactgactctgggcagatctgccttagagagaaaaggacaaagtgaatctaagaaaatacaaactccagttacactggtgggcaagagggcccatcctgttactctggcctcccttactctcctcactttgaaactgtggccaagttttttcatgtttcagaccagtcctgagtagaagaggtatgaggaagaaggaagagaaatactctgatggaaatgttgcctgggagatggatcccagtccaaactagacaagaggtcagccacccaggagcaggcaggtgtttttagaaaatcaaaaagcaaaaaccaaaaaacccagcctgacagtgaagagcagaaaacatcaagacccttttataaaaagaagagccctgcttggaaagtagaacttccagcaccaaaggccttgggataagcctttagaaatttgagtaccttaggaccgaaatggaagcaaataggactgcgaaccacaataaagtttattgtttaacactctggctatgatgatgtcaaggaatatacactatatgccaagcactgtgataaataccttacatgtagtggaggaagggttgaaacctagttagcttcctcttaatttccggagagctctcctccttttctgtcccttggagactgatgaagaggttccagaaacccagtggagagataaactctgcaccaaatgatagtgacgtttatagtcccctttacaattctccacttccaggcactgctaactctgtcagctgtgaaccaattatgtcatatccgggcttctgaagaaggatgccttgggatctgtgttcccttgcatttctctttattattcagtaactccagcccttggcttctgaaaatcatagaagaacccatctcttgggggatagtcaccctaaatacatttctctgacccagagaatgcttcaatacgatctttacaaggaaatattgtatcaccattactgttcttattttgaagccttttggcaatcaagaaaactatcatactctgttaagggaaaaattactttaaaaatattcattcagtcagaggtctcaccatagtaactttgtttttttgattgtcatttggttccctaataagttcacatgactttttttatatagccctgataatgcaaacactgtgcattacattttgatgatcattgaaactgtattccccacagcagaatacttttctcgggagacctgagcatcaggccaggcagcagagtgacaggaatcttaattggatctgctttctcatggaccatcccttcaggggtagaagtatccatttatatggagaaagtctctgtcggatttacttataaatataacccaattgagctaaatagtagcacatggagcaaacatgggagaaaatttttaaaatgtttctctcaggagtagtgttaagactattcagtggtttaaatattttagcttcccaatcctttctttagctggcagtacctacctggcaagtaaaaggccctgaggcacctccactgtgccttgcactctggagggtacacagtgaaatccacattttaaggaagaatatagcatcccttccttacctgctggggctatattccaagaccccagtggatgcctgaaacctcagataagtaccaaaccctatatatactatgtttttttcctatccatacacacctgtcataaaatttagtttataaattaggcacaataagattaacaacaattactaacaataaagtagaacaattataacaatacaccagcatcacttctcttgtaccttggggccattattaagtaaaataaacacaagcactgagatactgccacagtggtctgataacccagagggctactaggttactaacaggcagagagcatctacaatgaggatatgctgaacaaaggaatgattcatgtcttggtaggacagagtgggatggtgggagattgcatcatgccactcagaatggtgcataatttaaaactcatgaatcgtttatttctagaattttctatttaatgtttttggactgcagtttaccatgggtaactgaaaccgtagaaagcgaaaccgtcgataacggggggcgggggggaactactttattttgaattttgcagaaagtgacatttctccttaccttcttgtcagagctatgccagagtccataactggagtgttgacatggaaagtttgagaagtgtgaaacaaaagaggaagtttgaatttcatcagttacttttttgcttttttagatcttttgaaactagttatttgccttggggtagattttctcttttatcagtgcattattgaaacaaacaagcagattagtctgcttcctgtttgacagtgaagtcataaaatatgaacagctttgttggtcccaagacctgtctctttctcacagagaacagctgattcacagtcaggtcatgtaggagggcctcccacctgtagggcagggccaattctaagtgacagtctttgcttcacgccagtctgttctcctttattaaatttctctgtgctatccagtcagaatgtgctcagagtctagtttgtgctgcaagaatcataaagccattcgttcagcagattcatgtctaaaatgtctctgtgcaaagaagtttaactgtggccacccttctaagatcagctttccaattcagtatgttttgatttttgaaaaatgtattcctgttttcccaaataatttataaatttatgtcttcattttcttgctgtcacttggcagaaatagaatgcgcaaccccccaacccaaaatctgatttggatgttgagactgataatgccacacaccccaacaggatgtgaaaaggtttattcctcacataatgaggctttctggagagagcagggtgactcctaagcaggtgcaaaaatggcttgagagagcatggaggtatggctggctttggcttttattgtggggcaggggcaagggctacccgcaggtagggcttgtgtattttggagagagttttcaggcttttttaaacctttgctcagatgtaaggcaagcaggaaaatagggaaaggtggggcttgaaagccatccggagtgaaataacaaaaataggggcagactctattacattaatctagcattctacttgagtaatagtcacatttcaggcacagacattttcctttggaatattattaaactcagtcacctaatgaaaacacaatgtgggctggacgcagtggctcatgcctgtaatcccagcactttgggaggccgaggtgggcagatcacctgtggtcaggagtttgagaccagcctggccaacatggcaaaaccccatctctactaaaaataaaaaaaatagccaggtgtggcggtggacatctgtaatcccagctactcaggaggctgaggcaggagaaccgcttgaactcgggaagtggaggctgcagtgagccgagatcatgccactgcactccagcctgggcaacaagagcaaaactccatctcaaacaaacaaacaaacaaacaaaaaacacatgtgtttgaacaatattcttacagcatttataatcttttctggcaccaattctgtgctgaggaacccactgtgggctaaggtgcctgaggtcgtatgtacagatcatgcacactgataacactgtgagggtctccagatatcttagataatatagatgacaaggatgagtgtggccccttctgtgttttaaccatatctcccttgtgtaaaaatccattcaaatgagctggatttgttgttctttcctccattctccttccaactctcagcacctcccaccctaccccattgccagtattgggaatagaaaaagaaatatttcctttttgctcttgataatggttttattgtcataggtggggcaataaacagtctttctctgacattctccaaagtagaaatggcgagtatccagtaactccaaacagtagatcaaccctcctagttaactcagtgggttttgcacttctgtgcacctgtttcttctgaatgtttcaacagaaagttccattgctacatatttcataatccatggtgtgcatctgagatttttactttgccatggtgggtaaacagcacagaaatcattacaactttgttccttcttgatcatgtgaatttctgagtgttgactgcactcagaatcatttcctaaagaaatttcgatccttcctttaggtgctccctcaaatcatcttagtggagggaagttaatcatttatatagtggggagtcttggttagttccttaaatttcataagaagatatcagcctattgatggatttttaaagcacatgaactttttctcttattgagaaaaaaagaacaattgtgctccagccttatcctgttttctggacaactcttactagaagttcatttaggagaaattttacacataaaggatccccagaagatatgcagtctattcatctggcttggtggttctcaacctcaactgtcagtccttaatataaaaaggccacctttactatcctaaaatgaaattcctagacaatataacatacttacacaaattactctaagcaccaatagaatttcctaaccatatgtaaaagaacaaacgaaagaagtttgtgtttaaaatcctttatatttcagtgtgtacatgctggggtacaacccttccaaaagacataatgaagtagtctcctgtctgcccccatagggagaatcaccatgattgggacagcagatgcacatgcagatgcagactggtgaatgaatgttgtactgtcaactcagataccacaaggacagatcccaggtggcatgtgacatgattttccaaaataatgaacaactcttggtattatacaattctaaacaaaacaaagtaacagtcttctctttgtttttatgggcgtagcattcctggaaaagccaatgtattctgacacagaacatcaaagaatgtgtttatatgtaaaacagagttaggttcggggcttcaatctgtgtaaacaaatgtttcacttctttgcacacccagcagggcattccggcgtgcaggctgtaggtcagtcctcatggttggtgaccgccctgtgtgttgcctggcatctagcctcccagccactgcccaataaaggccaatattgcccaccctcctgggaggaccagaaatatccccgcaaatttccgaatttccctgagaaggtagtattgactcgattgagaaggacttcttaaatattttaaattttatacctagatcaagccagaaaaccagaaaactggatgtctgggtcttaaataatctctttattaaccttcactttttatgcaatgttctataatataaacttctgatggtattattagaagtattatcaagcaaatcattcaataaccctcttaatgtctgctgggaaatttccattacatctcagggtctggagaatctagaaatctccttagtattttcaccttttaatcttgcattaggttacatttctttttcagttttgatgctaggaagcatagagccacattgtgacccacttataatagttatgaggatggatacacacacacacacacacacgcacacacattctctcctgacctcatattgtttcctcttttctcttgctttgagttatttttattcttaatatttaaatgcttgtattgatgcctcagatcctttttgaaatgaggcagagaagataataagtaactagactgaataaaaagatttgagacctctttctgaacatttttggaatcccagagggatcttaatgttagttgtaggcatgaatgctacagcccattagctctgcctatgaaaatgaagtgcctccaaattcccagcttgctccataaataaatcattccacacatttcccaaatttttttcctccttgtttcagcactaaatataaggatactgcaaattctataaaaagaaattactttatctttgaaaatgaaaaaacacaacccaaatttttataaaattattaataagactaaaagtaaaaaaatattttcacttcaaattctcacttacttacatgttatatgttatctttctgctttcttcggatgcccattttcttcagatgcccatatgtctatgtgattttataaagattttgtgattgtaatttacttcaacttcttttctggaattaggtaagatataagtacatttgttttttttaatttatatactatgcatttatatgcatagtatataataaatgtattaaataaatttattgtgtactatgccttttatttatatactatgcatttttatttatatactatgcattcatacatagatattttgtagtctgtgcatatactacacatacactacaaaatacatagactacacataatgtatgcatagactacaaaacatcttattttctttcttttctttcacttttccttaaatattcataataaggaattcttttttccttaaaatagaattcttgagccctctgctggaagtattcagtatttgtatgaagcagcagtatatgggagttttacaattctaacttaagttttttaaaaagaaagcaacatgatagcaaaaatatatggtcaaattgtaattaatatcaggataaataatttgctaaacagtacttttaagatgatttatattggaagttatattccatttgagtaaaataatgatgagaacattcaaatgaaggcataatttgaatgtattgaatactctaagttaacttgtgaatattttatttttgtatacttcataaaaaccatccatttacattttattctcaaatttagattcattaattcagcaaatacttaatgaacacctactatatgctaaggacttactagttgttagggatgcactgatgagaaaatgtacattggtgctttctcacagtaggtcaaactgtgattggaaatgccagatcaacacaccattgcatttttaagaaatggattagcagggatctgaattatttgcatatataacatagaaaaatacctgagtatgtttgatgcttcaaaagttgcactaattcaggtaggagaatggataattgagttgtagttctttgtcaaggactgcctgaaaaataagacagtaatttgcattatactttgcaggaagaaaataataggcatttattctatagtaattgaatagacagatatagcaccttaaaaactaatgatagccattcatctctatgtatcatgtatctgtcaaagtaggaacaacttggcacagcccaaagaatacagcctgtactcccggctattcgggaggttgaggtggaagaattgcttgaacccgggaggcagaggatgcattgggctgatatcgtgccactgcgccccagcctgggcaacagagtgagatcctgtctaaaaaaaatataagagaggataaaaattgattccagcttgtggcatctttggagaattatttgttgaatccaactgtaagaatcaattctgctggttggcactggagaaagtcactgttttcacttcaaatccatgaccccaaatctcagacagatacccaatgccaggcaatgttaatctgtttccctagtaaatttgctttcctcctcttcttgatgagtttctcaccctctctcttctctttttagagacattcccctcactaacctacctccagtacacatatcataaggaaaagtcaccgtccattgagaaaatagaaacagaaaggaagatcttcatcatcttaccatcaaattctcaaccctccctgtttctgaacttattctgggtatatccctcttttacagtgggaggggtatccctgaactgtcagagactaatctcccccacgtagggtccagatccactccctccgactctgtccaatatcactcctgttatcctgctgctgtctcttctgccatcagtttctcctctactgcattctattgctcacctttaagaatccttttcttgccaggtgtggtggctcatgcctgtaatcccagcactttgggaggccaacgcaggtgggttacttgaggccaggaattcaagaccatcctggccaacatggtgaaactctgtctctactaaaaatacaaaaattaaccaggtgtggtgacatgtgcctgtactcccagctagttgagaggttgacgtgaaagaattgcttgaacctgggaggtggaggttgcagtgggccgatatcgtgcccctgcaccccagccgaggtaacagactgagaacctgtctaaaaaaaaaaaaaaaaaaaaaaaaaaccccttcttatttctatattcctcttgagctaccacttatttctctgactcttctcacagcagagcttatgaaaagtgttacataaagttatttttcctcactttcactcatttatcactcacttttccactccaagtctggaggcttttatcttcatcattccactaaaactgttcttggcagtcacaaatattgccaaatctaattaaatactgtcatatgtgacctcacagcttcgtgcagcatagccagcctcccttttctttttttttctttttttttctttttttttttttttttgagatgaagtctcgctctgtcacccaggctggagtgcagtggcacgatctcggctcactggaagctccgcttcccgggttcacgccattctcctgcctcagcctccctagtagctgggactacaggcgcccgccaccacgcccggctaattttttgtatttttagtagagtcggggtttcaccatgttagccaggatggtcttgatctcctgacctcgtgatcctcccgccttggcctcccaaagtgctgggattacaaacgtgagccaccaggcccggcccaccagcctgcctattctctcttggcctttgtaacactgctcactgtgggcttttattctgtgccaccaccagccttcccgtcactcctttccaggtggctttgcttgctcctccccactctgtaggcttcaaatccttcctgcttcagaaccctcctgtttaatccaactagcttccttggtgatgtcatccagacccaagttatttggtattgacaaataacttgctattatcttatgctattgactcccagcccctacctatactctagaccaaggatcagcaaactttttttgtgaggagccaaaaataattcagtaaataattcaggccatataaagtttctgtcacagctgggtgcagtgggtcacgaccatagtctcagcactttgggaggccaaagcagaaagatcgtttgagccccggagctcgacaccaggctgggcaacatagcaagaccctgtctctattttaaaaagtaaataaagtttatttcgcaactactcaacttagctgttgtagcatgaaaactgccagagacaaatatgtaaatgaataagcatagctatgttataataaaactctatttatacttaaatttgaatttcatataattttcatgtatcacaacatattattcatcttttgggtttgggggactgttttaaaaagttaaaactatttttagaaattaataccccaaaaattaaacaggcgtaaatctaacaaaatatgtacaaaaaatgcagttttcctatgtgagtatctttttttttttttttttttttttttttttgagacggagtttcgctctgtcgcccaggctggagtgcagtggcgcgatctcgactcactgcaagctccgcctcccgggttcacgccattctcctgcctcagcctcctgtgtagctgggactacaggcacgcgccaccatgcccggctaatttttgtatttttagtagagacggggtttcactgtgttagccaggatggtctcgatctcctgacctcgtgatccgcccgtctcggcctcccaaagtgctgggattacaggcgtgagccaccgcgcccggccgagtatctttttatatgcttatttgccacctgtcttctttggtgaggtatccgctcagatcttttacacccccctcccgcccccatttcaaaaaatcagatggttcatttttttcattgttgagtgttaagatcttgttttttgatattttggataacattcctttagcagatgtatctgttgcaaatattttctcttagcctatggcttgtcttctcaatttcctaatagtgtattttgtggagcagaagtttttaattttaaaaaagtccaagttgtcaattatgtctttcatggaccatgtttttggtgctgtatctaaagagtcattgtcatacccaaagttatctagatcttctcctatgttaccttgtaagagttttctagttttgcattttacatctacatctgtaatccgttttgagtttatttttgtgaaggatttgagagctgtgtccaggttcaatttttgtatgtgagtgtccaattaatctagccccattcttgaaaagactatcttttatccattattattatattatctataatattatctatgctctttcattgaccatatttatgtgagtctgtttctgagctctctgttctgttccattgatctgtttctctcttcttttgccaatgtcacactgtcttgataactgtagttttttttagtcttgaagcgggtattgtcagtcctccaactttgttctccttcaacatcgtgttggctattttgggtcttttgcttcttcatataagctttagaatctgtttgttaatacacaaaaaataactgtgggattttgaataagattacattgaatctataaattgagttgggaagaactgacatcttgacaatatggagtcctttttatccacagacatgggccatctttccatttatttagtttttctttgatttctctcatcagagttttgtagttttcctcatatatatatgtgctaagtcccatggctaatgccctgattgcctaccaatattcatttcctcttttttctttatatagaactctaatttgatttgggactatggtgcatctagccataaaaatttaatttcccaggctcttttacagctatgtgtagccacccagccaatgagatgtaaatggaagtctctgtaacagtgtttgtaagaaatctattgtttttctgataaacaatgccagactcagctggcaaatgttttttgttctttgacctctcctttctttctgctttgaatgtagacataatgcctggtggtatggcagccaatttgagaccatgaaaccacagcctgagatttgccaagcaggaaaatacaaggaggctggttgccactctaagtggcctaatccaaatgttattggaaaagtaacccttatatttgtttaagctgctttgttacatatagacacacacaattgtaatgatacacaagcattcttttggtccttaaaacagtttttgaggtagacatcattattttcactgtacaaataagaacactgaggcacctggagttgagctgttctcccaagttgattctgtcagcaagtgtaggagccaggatttgaaagcagacagcgtgacctagaacacatgggcttattagttcaccagatgtctgtggagacccaggatgaggtaggggtggggagagatcttgccaagctttgtataaggagtggatttagagttggatcttgaaatgagtaggattttgacatatggaaattaaaggaatgaggaggacattgaagatggagaacaaggtattgcctgagtgtggagactagtagattactggctttagcaaagggaccagaaggtcataaaactggagaaaagtttttaacagcaggttggggctacatggtgaggttttccaaatacaagcctcaaaagtttgaattctctgattcatagagaactactgaattctagccagtattgctcagatggagcacttcaacaggcatatttatgaacatttcccaatatgatcacaacatttagaaactggaattcatgtgttttattatccttacctgaactatgtttttctttcttaaaaataaacttcagatgtcagatatagatgtgcagtgcatgagtcaatttagaaaattcttttcctttaaatggctgccaccttgtggataaaaagtccttagtgcagtggttttgaaactaaaactagattggtagaaatttctcatagctagatagatcttgtgtttcatgttccatctgtgagaattctgtcataaataactttatgcaaaacattttatgtgtgttgaatatatgatcatttaacagctatttatgctgttgtatccagttcatttgatgattataaattcaagattctgataatttgccattctgtaatactatacaggaaaaaaaaaataccaaagaaacaaactataaagaagggaggaaatgtaatcatttattctcataaatggtattagaccactctaatttgcagttgtacaagcgcttgttttgcttgcaaaagcgtgttgttcatgtgcacacatggtatgtgtgtttactaaagaccttagttgtctgattttaacatgctcaaatccttcagtccactgtacacatagaccaagaagcaggtaattaaaaaatctccttatgcaagaaatgaagaagatagctttgaagatctgaagatacaaaattttctgaagatgccaactcacttgatcacaggcaggagaaaaaaaaaggtcacactgagacttaccatggctgttaaagacagtccctaccagccaccaatccaagaggctaggtataagggagagggaaaataaagagaaaaagaagacagaattgagagagtggacatctgatgatccaggaggatgagctgaagaaggaggggcagggatgccctggggactgtggggtgtccctactcccaccgctcagtcccagctccaccctcccagagcccccatgtgaggtgtgggcactgactgaggtggcccacgtcatcatgctctatacagaatctcacctcaggtcccattctcctcctctttcaccggattctggccccatattctgcctggagaccaggagtcccagtcttattgcagtttagagggtcttcattggagatcatgcaaattctcctgtctgctaccaaccctgcttggattggtgaccagaggacatgttggcacacagtattcaagagtgcctcctaccaggagggtgattgggccacctcatgactgaattctgacataatttctcctaccaggtacccatccccttctcctgcacttgtgggttttacactattactttgtcacaccattctgtgtcaccctaaatacagccactggtcggttcttatccccaccaaaatgagtgtagagtttcagcatttggaatgggaatcagtcgtggccctctccttattcatatgaccttgcctgctacaaattgcaggagatgttcctgggccagacccaagtaatgagatgtgatcatctcattacttggtgaggtgagactagaggtgacctctctgctagcactgtccaacatccctcattcgagaacagccccttgtgttccaccacctggaggtcaggcggggaaagaatcctctatacaggtggttctgtgaacaagaaacattcatgcccccacctaagtttgctcctggttgcatcaaaacctgtttgcaaatctggagaagccccagctctacaggtgagctccacccaagcaggtgagcgtcactgggggtagaggcaatgcccaacctagtttggcttcttttagggtttcctttccccccacttcccccagcccgccccatcccgcccctggattctggaccacttggctttatgtatctagcattttcttgatctcttgttattaagacattttgtcttgtccactgtttatgcctctagctgtgatatgctcctccagactgatgagtgactggatgtgtcaggccactcacattagctcctattcccaccctgtgtgctttcagatcttggggaacatctcttccttcctgcaggtggtccttgagtcacccttcttcctatctgtcctggtttgagtgtcagactacatgttgatgggtatgtttctgaaatacctaaatataatgcttggcagaagttaaatgcagctgtcttagttgttctccataaacctgtgtgtttgagatccctttttttctgcagaggttgttcttttggccagtccttcgaggcaggtgacagataaattcaccacactgtaaatcatgaggagacttgacctttgatttcattgctggccaaacacaaattccctggaaaaatatattcgaacagtcagtcaccaaagagcaacaaagctgaatcaaaagcctctggtacagtgaggtttgcaaacactggttctgtttccataagtgagaacagctgtcctggtagggtttctttctccaaccctttaagagcacttagagattttctgtgctaaagcatattttagaaaaacttatgttataatgagtggaaggaaaaaactacaaaacaaaaaataaaaaaagacaaaaacaatcgccgtatgggtttttcatgtgcaggcttctggaagtcagcctgctggacatgtaacacatgctatggaatattcatcttgtctctctgtgatcactgtctttgtgtttgctattagtgagccttggaggttatcataaataccagttgtgtgaaatgagcgcaactgacaggatttaaaggctaaaccaacctttctaatccatctattccccattctcctccttaggccatgcctcttctgcaagactatacaacatccttgctcctctgatgggagctgcactaatttcgtgaatgtcagtcaaagcctccttccttgaggagttggcgaaagacgggtttctctttctgactagatggaaaaggagatataaagatttttcagaataagatgagtgttggtatttttgccacatgtgcttaactttttcacttctttactttgccacttagaaatatagagtccttttttctttcttataaaattagttaaaattgattctgaataaaaaacatgtgtagagatcaattaattcattagcattttaattaagtaacttcatgaatattgagcaacagctatgtgtgctgaacattgttctaagtgctggggatacaaaatagactaagtccctgctctcctgaaacttatactgagcagagaaaaattagcaaataggcaaaaagatatataatgtgaggtggtaagcactatggtgaagaataaaacaaagttaggagctagggaatgatggctgttcaggggtgggttactgttctacataggatggtcagggaaggtatctcaggtaagacgttatctgaagtatatgagggagtggcccaggcagagcaaacaactagttgtaaacaccaaggtgctcagcatattcaataactttttaggttatagtggagactttttggattttattttcatggagatggaaagtcttcagaaagttctgaataaaaacagtgacatgatttcatttgtggttttaaagaaccagtctggttgatattattaaaacagatagtgtgagtggacaaaggagaaagcagtgcaactagctaggaggtgattacagttaagtttaggaagaggaatggactggactaaagcagtgattatcgaagtcatgagcagtgattgaattccgaaactattttgaagatagaaccagcaggactggctgatggattcgatataaggcctaaggaaaacaagagtcaagaatgaccctgaggttttcaaacctaccatccagtagaaagagaacctatagtgatgcaggaacaagaggggagaattgcaggcagaaggggttgggatcaagcacacaagtggactgttggggagagcaaaaggtactgatacagatgtaggtagataggttggtagatttggtggtaagaggttttcaaagatcatgaagtgaaaatccagtggcagagaaggagttggaggcttgagaaaggagcgtgctgaagtagtagagtggaggggtgaattgactagtgcctccctgtgcatcagagccactcaggacacttgttaaaaacactagttgcctcaccctgaaacttactgattcagtatgtctgggaggctcccaagagtttgcagtttaataagttcctaggtgatgccaatgctgctggtccagagaccagattcaggaagcactgggctggggaaatgggttagaatggagggctggggcatcactaaaggcctccttgcacctggcagtaattcatgtgaattttgtcaacatggtcgtgtgccttttttccagccctgatcagctgctcaagagctggcagcagtaggtagataattggacttaacaaagtgaaaaattggtatcaccaggatacttgggaggcattacctctatgtgatgtctttgtattctgaaaatgctagttgaacctcctttattttaaatagaaaggataagagaatctgagactgagaaagaggaaaatggaagtttgcgtatgaagcttactgttgtaggacttagaagtaaaatggactaatatccacctctggtcttatatggcaaggagaaacatatgcccctttccctaaaatacctgtttctgtggtctactaaagagcaaaattctgaaatatactttgaaaaactaaaactcagttcttttgcattttataagattatatcacaaactgaattttaagagggttatgtttttctttgaaaatgtttatacccttctacaaaaaaataagtggttaagtgcagagcttcacacacacaaatggtatcagcacatgcagtaaagagaaaaattggctgttagagtaagggccacagctcattaatcagaacaggaagagaagaactgacttccataaaaaggaacagtgttaattgaaatagagtacgtaaagcagcaatttaaatatactatggtatatctacatattaagcagcattatatttttaagtgtaactgatagttttatttttgttaacaaacaaaacagattttgctggagccaggtgtgatccaggatgtgctagcagcgggcagtcacctacagctgttggagcttctcaatttatgctcccactatctcatccaggtatgtgagcttgcatcctgctcatacacccttcacattcctttccccacagtcataagctggcccccaacaactggagctgaatgacaggtaaagtgggggtggggtgtgggctgtggtagtagagtttctccaggacacaagctgagaagttcctaggagggcggctgcagctcttgcatccaatcacagaagcaggagtcttcctccactgtcctgcccaccttaggtccccacgaccattgagcagccgatcaactcagtgaccatgcacagggttccctgcaggagccgggggaggtgtcgctaaaaggagtcctagtccgaagcaatattgtctggttatggaaataatcacaaatgcaagaaaagtctaatagtcattgaagatttcagtaacagtatctagtaaatcacaaagtcctatgtaattaattaccatgtgaacttcccaggcagtaaatgccggagaagggatgagtaatgtgcgtattcctccctgatttgctggtcaggaaaggccccatgagaaggagggagagaaaacccccgaacaccaagcactgactgtgtgttcacagttgtttcacattcagtcctcacaataactttgcccatttttatagatctaaaacatcagagactcaaaatatatccaacttgtctgaggcaatatggctggtaggacgttctgattccaaagaccatttcttggttggatgaaaacttcttgttaggtaggagtctgtggggcatcttaggcagacagcatggctatgagtctcttggactttatagagtgttactaactaatttgcaattttaggatcctcccacttcccccactggtgtcaccttcacttgcatttattatagcattaaaaaattaatttgaagaaataataaattcatcacacaatttaattccactatctttgtgcatatgacatgatattagtgagcagaaaagttttgttttcctgcccaattactttattttccttttaaatcactttctgtaattttaaatgtatacttttatcattgacttctgttacctcttaggtagtttacaaagctctttctcatctagcatcttatttaatcttcccagcaaccctggaaaataggaaccagcacttcccagggagacagtgtgaggaaggtcagccatgttcacctgaggaaaattcaaatacagtttatggaattcttatgattatttgagcacatttaatctaacagtaaatggttaatgatttttttttaccttattttcctttcttttcctctcaatattgttacgtggtataggaaagctatttttaatccctttctgcctgtagcaaatgggaatcatgtagaaaggttataagacttcaaaagtgtgtgtttgacttgtgaaattaaaattacttttatttgacatttctacatcaaatattgcaacttgggctttacgcatcatcacctgattcactttccccatggcagatagtaatcagtgatgcatgctgacacagtttggttagagcgttagttatcatgatgtacattataaatggtgtgtatatgcaggggtgtgtgggtatacctaagcctataattttctgtaagtgagaattccagatgaacattaaaggtccatgggtattttcctctatcccatcagatgggtgatctgttgagatactaagtgacttgtatactttggaatttaacttctgcatttcattattgtgctgaggtaaaagtgtagcatgcatacatgcttgtggaccgttattattcaggcttcttgaatagtggttgaaattttcactgacttttcacaaatgttttcattttgtcatgtaactttactttttctttttatctgtgattattgcaagatgtcaaacttgtagaaggaaattttgactatatgagtatcaaaatcatgtcgacgtagaaaccttccttatttcagcctttaaaaaatatatataccctgcttctctcttaggattataaaaatcacagactgggtcaattcaatctacttttatattttgatatagtctccatagctatatctatttgctgtgttttggtaatattgttcaactgatttttaatttaatgtgggactatttcattgagtatataaaaataatattttattaatgtgaaaaattcccagtgcttaaaatgtacccaggaattgtgccccttcaatcaatgctgatatattctctatctttgtgtggtactttgtcaactaggagtttttgaaaccgctctcttcactaagatgtctggtattgttttgttgttcttaaaatgccattctttctttggtttctctgccagaggagtgaagggcagaccggctcaaatataccattgccctccagtgctcactacaaagcagctccaagggaaaccgttggtggaagctccctgagcctcaccatcctgcagttcctgtgaacatgtaaatggtgctgctgccctcctgaaaaggaaagggatacctggcactgtgtgggctcctttctctttcatttcctctggcaggctgctgagaaaaggaaccccacatggcaggagcagtgctcctctgtgtcaatgaggacagctatttaattagccccctaattagccttctcacaggttctcaaagcatgtgtgtgggaaaaaggaaagctgggcaatgtatttaatgctaattgatgggggggtgcctttctttaggctcccattaatcttgtctataggttacagtaccctcctgagcagtctgcttgtttctagcctcaatctgtggtaacccatggcccccagaccatcactatctttcccaagaaagggaaccacatatattgagggcctatccatgctgagtgttttgcagggactcccatttccactgctaagtcaccccttaacactggtgggtgttgttttctttttacagatggagaaacttaaattcagaactaggatgttgatctggcttgaaaactttcattagctaccctgatcatcattcaggtgcattatttctcccacaaaagtctttagcctcatcttcaaggccaggcctgttcctccctggcttcatctccagccactgtgcctttcctagcctgctttgttctgggccctaaggcagagttttcatattgggacttgccattaggggagaagattcattggtagatatcctcagtggcgggcagagcctctcagtcccctttagattgtaccaaggggtaggaatggggaaaacttcatacagacacacacacacacacacacacacatacacacaccatcacctctgctgatgcacaatgccataagatcaggaatattggcaactgaattttgtgttacatctcctgcaagtgatgcatcagaagctttgatgaagatgtctcttttttgccgttacctttccaaaaaagaaaaaaaaaagtttatacattttgtatcaccttgcccaagcatattatattgttttattaacaaccattctttatgtgcaccaagtatcattgtctttttaataatatgcaatttaaatgtattgataaacagaaccatcatgtagacttttcaaataaaaccaccaaagtactgaatacgcaactccctttttgataggaatataggtttaatatctattgctagacagcaggtggcagtgtgaatccaccagaattcagtagttaatttaaagcaaaaatcagaaaaaataatgaaaagaaaaattatttattttgctacatattagtcttctgacctaatcagtaaaaaagtcattattcacaccacactgggcaatatgcactgtaatttttaacaaataataggaaactgttaatgtgttcacaggaaatacagttttgtcttgggctgctgtggtcatttatcagcacactttgtgaaatcactcatttgttctaatttgaatgtaaatgactctaaggttttacaaataaggtgacagactcacataaatgtaattgcagggttcatctccctctttttatatatcactcattaggttatgaattaaatacatcgtattaaaccaggggcatgtccaatgatgatattgtaatggcaaattactctatgctattagaggtgtattttttattcatggacattaatttgtcattaagcggcattagtttagcacttttatgtgaaagacgtgacctgcaagaggaggcgtgctgctgggatgtgagaggctgggacgcaagggcgataggtagagcattttatcattgtaagggaaacagagaaggggggggtctgttgcatttgttttgttttctgtttttacagcatgaaagatcatttcctcagattgaaggcattgttctgtttacagcgtgcacatgtggatcatcgagtaaagcaaagcccaaattcttactattcttcactcagaagccaaggaggaacataaagggaacaggagggagaaagggtcctgccctaaatctccttctctgtaactgatgtttactcagcatcccttgtcttcgttaaattttacactaagtgggctacagtgaaaattagttattttctctcttcagttaaggtacaaaggtttaaaaaatgctattctctcactagggagttaaggagaattctgggtgattttgttcctttttttttttttttttgtaccaatggcaatttcagtaagaaactatgtttccactttcaattctgagaagcactagattcttgaaatacctacatcagggctgaaggtatctgagtgctgtttttgcatcattctgcacatggtttaatgtagttggaaaatgtctcaccacctccagttacactgtggggctttcgagcagagggatcacaccttatactgattttatgccttataccctccctcccttcacatcgtgggagttcattatgtactgagggattgaaaggtgcctccattaagtaatttttctctgctttttaaatattaaaatttatgttatagtaggaaaaatatactaccagcctttcattagttttgcccactgaatacatttttttgttaaaaatactttcttcggggattaaatttgacactgaggagctcacatattttacagtattataatagattatcatttttaattaagtaatactacaatgacttataggaggttatctcttctaaacaatgtattattataattttaattattaaattaagagtatcacccaaatacataatatatagtgggtgttctgaagacaataacttctcctcaagattgaggagaagttataactcatgttcatttttcttcaacactgaaccattttttcccacattagagaagacaaatgattgtaccaacatatatatttaatatactcataatcaaatgcactgagtgctgttccatagttcactagagctgaggcttttgtgtttggagaaagttaaagtacaaagtttggaaaacatattacaagtggtttaatcttttggattatttttaatcagcgaaaatgatcaaaaagggtggaaatgtatcagacctattaaatcatagccaactagtaattatttgttctaatcaagagtatttgctatctggcatgggtaatccagaatatcatatttgccaaataacattcatatttggctttgaaatgcatcataagatctgcagtagccattttagggtcccaattaatttttttcatatgctattatgttggcttttattccctaagcccacactaaaggatgtcaggaagcgacagcccagaggcacactggctggccagggaagtcatttcagcattttaatctgttatatggataatgtaggattgactgtatcttcgtttgtgaggattttaaagaggagaaagattctcctgaaagaatatctcttgaaagagttcactaataatattagtcatttcaaacctaagctaactgttgtcagctgggtgattttaaaatcactttcagtatgcatttttcttcttaaaaatgaagtgtttccaggattttattcatgctagagttcagaatcaataatcaaaacaaacaaacatcaatctcactgagttccattattaatacttggaaattggtggggggtgtgtaaaagaagatctgtgtttcatttgagatatttattctcccacccacccatctgtaaatatttctagtcatggtgaaatgtctctcctctttcctgaagctaaaccacctttctgctccttattccatcagttacgccctgtgtttcctctggttttgatttctcctactttactggcacttttctttcagtttataaataggatcaataaggcaggagacactcttcttcatctctcattaccgcagctgctccttgccctcactacccaactgtacccagtgtcttcactccttacctcctgttcattcttcaggcccattgaactcagtgttctgccttcattactcctcaaaagttcttccaacaaaggtcaccaaagcctccttattgtctgatgcagcaggcctttgtggtatcctaagtgactcctctacagcatttaaacaccgggagctgcattctttcctgctcctctctttctcggggctctctcctattctcctcctactcattttcaatacctttacaagtgttcttccattagctccttgactgtccctcaaagcatgggagctctgcatgggcacccttcccttctgctcactatcactctctttcatgcatctggggagggttactgactccagccctctctcctgagctccagccctgtatgttcagccagcatttcacttgatatgccacatgctgcccaaattcgcctttgcccagtctcacacacctgttcctcctcatcctccctgtctttgttaagggaccatcatctttctagtcactcaaaccttggcataatcttacactctgccaagacctcatgaattccactaaatagtgttggtttagccatttaaatctttctcagatatgctaccttctctttctcctccttgtcattgacgtcattcgggttgggactatttttcctggactgccctgcaataactcagctgcgctccctgcctgtagtctaatgctaatcaacactggacaatctaagttatttgtctggtccacaaaacaatttctttccctaaaatccaagctagctttccatcttttggttgcagaaccatgtcctttctatttcttgtctctataatgtaccctattctgactgtaccccatggacagcttgtcttagctccaggccagctgcctagtctacacttcggcttgggtatttctcaggcacatgacctctctgagtgtgaacccaagccagaaaaccaggagtcatcctagaatctcccatctccttgagccccacatacactgacacagagacctttcagccccacccccttaacttgttaaatctctctcattgtctctctttccactactactgtcttcaatcagatccacattacttattttatggactaaagcaacttcttgctaactgatgaacctgctttccctcttgccccattccagtacagaattccaaaattctgtttgatagattttgaaaagttttcttaatccatgaaaaattctgtttgattgattttttaaaaaaatcacaacctgatcatgtcatatccttgcttaaaattattcattatgatgaatgtggttcacatagtcttcaggatgaggttcactccttttaatttggtacacagggcctgtctttattatgaaatgtgctatctctttggcttttttttttttgacaatttactacccatgtgcaatgcctgttccacagtcattatgaactttgtgcatttccctgtacctaatcctcttcatacgaaacctccttttctgtgaattatttttccctcactttgtcaccttctgaattcctatttaactttcaagtacttggctcacattgtctcctcttccagagttgcctgatcaatctactcagttggaattatatcttcctcctcttctttaattatgggcaatcttctgggaggccatattgtttgtgttaatttacttatctgtctccccaagacataagtttatgtcccaaagttgtgtgatgtcggacaagttacttaacctctttgccccccaactcctcatctgtgaaatacagatatggtatcctatatacagtctaccttttagggatgttgaaggattcaatgagatagtgcatgcaaagtatcttacaaacacagtatcctacatcggtgagtgctctataaaccagagccgatataatgtggtgcttcacctgtgaattcctctattaattccacagttatcctcctacccaatcccctcacccctgtcttccctcatttctggaaatgtcagcaaattttctgcctacttcaaattgacaacctattggacaaatctgttcctgaaattttggggaataatcaccattctgtaaaagatattcttcctcttagccacttctctttgattttgctgaaatgcatacattgttttttagaagccacaaataattaaatgaaccgtcactttctttctgcctctgaaatttgaaaacatcatactgaaattgtactttaataaataataaaataatgctttgacaaaagcaacacaatacatggtattgacactttgtagacagaaaattttgttgtattgtttcccctgccctttctataattaaaacatctttctccatcctggtatacagaatccaagaaacaattggaaaagtctttcatctctagttctagtgcatggtggtacttagaaacacatattgtctgattggattccttctgcatgtaccataagagctccctatgatagaaactttgattataaagttgcatgatatcctatgcttcctgactagggaacataaaaactgtgtatttatttaaaagaaaaaaaatctgaatttttccttactgggagaatgctatccatgtgtctcatttccctccagctgtctttctttcctctggctttccttccagaggaaggaaaggagtgtgaaggggtggagacttctcttcccctcttcctcactgtctatccacaagtatcttttagaccaggctaccaacctttttcctgctgcacatcaaggggcatgtgccacaggccctaggaagtggctgcttgtctgtgtcatggacttggctccagataccctggcctcagtcctgaacattcagtataacgtttgcctacttcagaggcacagttgaaggcctcgggtcacacagtttgtttgctgcaacagtatatttatgcaggacagagtcattcctgtcttcactgaaatgcatactccagagtaatgattcctaaacttgattatgcaaggaatcatctgaatggatggctaaaacagactgcttgggccccactccagagttcctgtttcaggaggtctggggagggcctaagaacctgtattctaacaagttttgagggatgctgatgtctgaactagggagcacagtttgagaactcccgctctagattctgttgccacactgctttttatcaagtacctgactgttaagtcactgatattcagattttgaaagtgtatttgtcacatttagatgaatttgaattgctcctagtaacataaagatattgatgctatgtatgcttcatagcatccaaaagataaaaagcgaaaataatgcaaatctgaaacaaacaaacaaaaaaaccttccaggtctcactcttattcgtaataatgattaagacagtctgtaggtaagtgagggatttaaaaaaaaaaaacaaaaaaactactttattaagttatgattgacatactgagggatgatttaaagtctgcagtactgggctaattttcagcaatctgactttgtgtactagagcaagtagggaaatagatgataatgacttctatactattcttttaaacatttttaaactgattttgcctatcctggttcaaaaagtacagttattgaaattttagttttaaaaccctagttgctcagataaactattttcaattaaaagaaaatatatatatatattaatttcttatatatattccatattcattggcaatctccttacgtgctgagtcaggtttagtgaactttgaaacagcattttgcagcacgtagtgactggggccagaattattagttattgttgacggctatgtttcacttcctccctactagatttccagcttactagagaatttcccaaggaacaatataaaattattcatgagccttgggtattatgcatacaattgattatgaaaatgtactagtaacctaattgtagaattcctctgttacacagcacaaatgtatttaaataggccttgcaagactccaaaaattagagcatgctggagttttccttgtacttttgaattgctgctaatactttgttttcatttaatcaaattgtatcatatacatatgcatatcaatgtttgaatatatcattacatacagttgtccatacatatttacatatttatatacaaaatatgcctatatctctctgtatgtttatacatataaacatatctgagtttgattattttatcatattacaagttatctggcctgcattgtcaatgaattgctcattttttcttctataacaattagactttatcctatcaactctatgacaatgttgagaaaattcacagagcccttcacatgcacaataaacatgataacttctttcctatataactgatcccaaggctattaaaaggtttggattttgtttatttattggtttgtttcaacctgttccaaaggccagaccttaccgcacatccacaccagccccctttatgttgctttctctactcctggagtaccaacctttcctgcagcaccaggttaggtagtcacataataccttgatttataactcagttgtaatcaaaataggaaacaggtggaatcacaactgggtatggtgccttggatattaatggcttggctcagcagtggaatttctaaagccgtatacacttttttgtcttaattatgcattcattaaaagcttttatacccaacagaataaagtaaatattttttgatctccatagtgtgctcccagactgtagatttgcacagcggggtcttgataatctgaataaattgtatttccccaaggagtttatctttcaaataaggtcataaagaaatgcagctcccccatccgtagatttctccatgtgccttttctgctatgagtaatatagagcttgagaaccagagtatattatagtaatacatacttgcttatggtccagtataatgtctctatctgttctccctgcttatctccagtgaagtattttttgagtacaaaagaaatgacagctatggtttttgctgacactcatagaaaaacaatgtccatattagacattcagtgttttcttccctttacccgctcagtgagtatggactatgcaaagctatagtttaagtactgttaacagcatttgtaaaagggagtaatgatagctactgtatgttgagcatctactatgtagaaggtactttatctgcacttttgagaatccttatcacagatctggaatgcagtgtcacttttcgcaatttttagatgagaaaattagacttgaaaagattaaccacttcctgaggccatccagatgggtcagctccaaatcatgtgtttttcctacagctctaaactaaagacaccaccagtgccttgttcccgcagtttaccacccagtgaaggagacagggaaactatgaaattaggaacctaagtaaatatgcacaattaggtgtacttataatatttctaaatcatgaagactaagatggcaatgcacctcatggtgcatacgtatgctaaaagtagcacacagttctgaaaagttcaggaaatagctttttcccatctttttaggttgccatatttatctccagtgtagctaacatttctaggcacgtacctttatttaaatattaaataaatgtattaatatttaataaattatttacattgtaaaatatttaaatatttttagaggagcaggaaaatctatgtttttgccataaactaagaaataaaagcaataaaatttgaaattttaaagatgtggcattttttcttgcctacccactgtatatcaatcaaaacttgctaggtagccactttctgaagacagagaggaagatctaaagaactaaagatactatctgcacctttatgcacagctggagagagaagagtcaaacaaatgatacaaatagcaagtgcaattaaaagtcagaggagggaaagtcctccaagctggagtggcctgcctttccctggagatggaatctgatctgggttgtcccgcagaagggaagggcatttatattacagaacttcccctttctcacaagctttttaaagtctactgaagcaaacgatgtctttaaatctttcacaaataataatcatttgtgacaaaagagtctcaaagttctgcttatggtataaaggaaaattaatgtgaattcatttgataatgtctgatttttttttttggcaaacagtttgcacatttatctttttctgatcatcactaaaaaccaagagaagtaagcttctttttcaacattctggggaaagggggaaaaatctaacatatagaaaacaaggagacccaagattcactgtggaagtcaggcctcatgtatctggcaccacaagagggcattccattttatttcccaattgtatgaaaaacccagtacctagatagcatcgcaagggactttctgaagctcagattaagtacttaagaacacttttctcagttaattgtgggagagctgtttattttgcccaactgttaagttgtatctataaccaagctattatttcctcttttcatgtaaagtcatagatgtgcctcacaactgtttgcttttttttcattcttgatccaacaaatacttctctgttgcaatctatgagaaagacattatgattgacattgtgcagaatacaaaaagcatacgatgcgaaatctactttttactagtttactaggtacatttttaatagtttgaagataagctacatgcatgaatagcttagtgacaagcttatgtgtatgtgataggaaacttgaagtgggaggcattagaattcattcagtgataaagagccttatacttaccgtatcctacttgctacttggtccttataagcagctgatacaatttttaaatttcactttgacttaacattgttaaaaatcaaaccatactgatttttatgtagagtggtttctcaggctgtttggaatagatttgggagtggttttaaaaagagaatttcttgacttacagagccaaggatggcctttcatttagagaaattttcaaattgtgatataaaatcaacattttatataagaacttcatgtatgctactacatcatgggcatagaaccactatgtctcctgcctatctttatctatagtaaagtatcgacatggggtaatttaggtgacatttcgaaggagagttgtctaagtgaagtgcatcaataattggaaatgaaagattataattacattgatgaaacaaagcattgttaaaatagccacatctgttgagtgttattacccggaaaaatctgtaatcctattcaatttggacatcttagagggggaaaacttgggaaatcaaaatgaaattactcttgttttaaccttgagaggagtttattatctttaacccaagtcatagttttctatagtgatagtacatgatgcttatttttctttcacacgtcagtggcattctcagaactagatgagacagcaagagaaataggtgtttttaaggctttgttttgaagggtgcctcatctagttttaagaatgtcaaaacacctatttttaagatgactgcatccactgtagactaactccattatctaccccacaaacagatatcatataattatgcataatgtgtataatttctgtgtcagaggcatgattaaactgcagtgtggatgggcaaggggttattgacaagccagggagccacggcggtagccaaaactaagactatgtttcagaaattcagatgattctcagcttgtatcatcattggcacacaagacacagctcttgagcgtgacatccctaagctaggctgtgggttatgtgtggtaaatatgcagactctaggcataaggctgcatgtttttctctcattcaagaaggtatagtagaatacaagtgagtctgggtggcattatttcataggcttaaatctactctaaattataaacaaagtacttcttgtatgaactttggtcatttattagtagttcctgcataattgagatattgagagacaccgcaaaggccatggccactctgctgcagatgagacccaccaggggacatcaccgaggccaagactcctccttctcttgctgccttcactggcttgggaagggtgggctgaaaggccacaggatcaacactgtcctcaaactgccctccttcctcccattcatgtcctaactgctcgataattgccttgcaaatgtaactacacttgaatataaaccaaaataaaacaatatttgcctttcccatatttttacccctaccgtatttggtagttaatctggggaataaccattgaaggaaccaattagggaaagaggccacacagaaagactgagtttggggaatatataaagtttaaaaattattgaacttgaaaaactggtgtttattccatagctagtgtggtattgaggacacattttatggctcctcttctcttatttaacttgtcattcacactatgagaaacaaatagaaggaataagagaagccaaatagccctaaaccaaaggaaaataaatactatttaaaaatattccctaaagaacaacaatgtatgcaccataattctgaatagaaactaaatttcaagtgagaagcagtgtgacagaaatgaaacctttttagaaaaaaaaaagagtaagattttcttttactcaagagagtttcttgttgctgagctgtaatttccattcaaaaccactaccgctacctggatacttacatttttaagtcacagaatgcaggagagctgagacaatctcgtaattaggaaaaagtatcatttgaaaagatattaaaatcttttgatctaagtagccaattgatagaggaaataattctctgttggactgtaaaagaaatttggggtggattgatttttttgtcacagaagaatgattatattatacttgttcagtaacactttcaactctagtcattattaccaattttcccacgcagaaaacaggatgaccactggctttgcctttgtgtgtacgtgtcagaaggccagaaagagaaagggacaatcaggaaggcctgtgagatatgaaaaatggcctgatttggacaaggttcagaattggataggcatattggaaagacatgggctattctgtttttgcctaattataagtaaacagaaaaagctcatgggtattctttcattaaacacacatgtattaagcatctgctccctactggataccagggacacacaaggcatgagacacaatctttgcttccgagaagcttagatttggtagagggagatagatctgcagttaaagggtgcttgcagtgacaagtgatgtgctagacatatttgcagagggcagagtagaagtacacaggaagaggtggtcaatttgacctgacccagggaagttgaaaagatgatatggtttcttcattcagcaagtgtggcttgaacgtacctggcattgttctaggctctggggatacagtggtgaacaaaccagcagctccttcctcccatggagcttactgggggatcaggggaggagacaagcacattataaacaagtaggcaaataaatgctgaagataattataggtggtgacaagctctaaaacaaataagatggagaaatgtgattgacggtgacatggagaggaagggagatgtgctgtataggatattcagatgaaacaagggaaacacaattcctatcccataggaattttgctcatgctgcttctttggcttggagcatctccctgaaatcctaccatcatcctgttttaaaatgtagattttgttattattgagttatggtgaggccaacagatcaggagacaattaccattgaaaacatgatttgtttctgctccaataagagggcacagaccacacctccaggactgcatagggaagccccagggttggtgaggaggtagaaggagtgaggggggaaaagtggactagagtctttatagtggtatctgcaggaaggaagtgggcaaagcagggttagcaggcttatgattggctagtttgaaagtttccatgggttcacgagtgtaggggctggctctggttgtctggtacttggccctgggatgatggggacagaggactattgcctcctggagtgtagaagccacatagaggaggtgatttagagtatgggctctggattggttagtttgcatatgaaagccgtttgctctctcaaagaattggctagccctgggaggggcagtctattctcagtcagtgaaaccccagatgccagaacatggagaatacagaaataaaatgttgttaatatacatccccatcccaccctttgccaagtgaacaaaggatgctcttccttcaactctcagcatcaaacggcttctcagggaagcctttactaactttccactccaagtcaactccaagttagtcctttattaactccaagtcaaatccctgttatggacactcatagtcctatattctactctttgtagcttttacctcagttatagttttccatgtaattgtaaggttttttgatttatggccttctcttccagtagactatatataccataaggcctagggcttgcctttttttgcttatctgtgttgccaattcctgctgtagtcctggcacatggtgtgaatgtgtaggttgttgtcatggctagagccaagccagggtggatagggttgctgcaccttaggatgtgaagatcgcagtgccccggtcatggaaggctatacagtgttactgagtttggactttttccccaaagcaaataacttatcagacttatcagtgggttttaaagagatgataaatatggtagattcttgtgaaaagagaggattgagagtttgctgctggaggcaggaatggtaatttaggacactgttgcaagaagtccagacgggatgataaggaacagaacaagaaatactaaagaggaaaaagagacaggactggcgattgactagatgtaagggaggaatgtaggccagcttttgggttcttgatgtgggtgtctagatgtgactgttatctaaaagaggagatacaggagtagatgcaggctatcataaaataagctcagtttaggctgggagcggtggctcacacctgtaatcccagcactttgggaggccgaggcgggcggatcatgaggtgaggaaatcaagaccatcctggctaacacggtgaaaccccgtttccactaaaaatacagaaaattagccgggcatggtggcgggcgcctgtagtcccagctactcgggaggctgaagcaggagaatggcatgaacccgggaggcggagcttgcactgagccaagatagcaccactgcactccagccttgggcgacagagcaagattccatctcaaaaaaaaaaaataaataaataaaaagaaagaaaaaagctcagtttggactttggacatgatgagtttatgactgtgggatatccaagagacagcatcttcttataggcagttgggaaaatgaattcagagcttaggagaaagatgtgggtcagtcatatagatgtggaaggcattaacttgcaattagtttttatcttaattctatggtttttattttggccaccccctctttccctgagttaatggtgtgccttattcaagacttgaatatttaaagagaacacatgcttcattttgacctctttgcatcagtgattaatcatggtttatggatcccaaacaacaatgctcaaatatactttattgttcttgctctcccccgcaacctactgtgtactttccacgtgccaaacttttatggtaagtgcttttcatacattatctttatgccaaccctatgagcttgttgagctcttaaatttgtacttggggaaggctgggtgccgtggctcatgcctgtaatcctagcactttgggaggccaaggtgggcggatcatgaggtcaggagttcaagaccagcctgaccaatatggtgaaaccccatctctactaaaaatccaaaaattagctgggtgcgatggcacgcgcctgtggtcccagctgctcgggaggctgaggcaggagaatcacttgaacttgggaagcagaggttgcagtgagctgagatcgcaccactgcattccagcctgggcgacagagcaagactccgtctcaaaaaaaaaaaaaaaattgtacttggggaataacagagattcagtgactgacccgaggccccagccaatggtgtgtcaagctggatttgagccgagtctgcctgcctccaccgcccttgctcttctctgcctgccttggttgcctccaggtgcctgtggtggctgatggtttgtttggtcctaaatgcaactattctcttttttcaacatataaaagacttattttttaaaagtctagaagtatatatacaaaaacattaatagtgattatctctgcatggtgaaattatgaaggatttttgttttccatactttgtatttctgaattttatgaaatgagcatttattactttttataactagaaatggcactctttctataacagcagtaatttttgtttcccatccaccgtactattgttgggcatttaatgaagtttattgcttcccaccttcccccatcacgttaatggaaaatttaaaagcagcattattggtgcttattttgcttacacatggtttaaccaaaaggacaaaaagcaatggttttgcttaagactcacaaagcccatctgccccaaaaggaggagtgtgtgctatgttgtcattgccttggggtgagttttctttttccttcagctccccactttatacagttatctgctgaggtgcaaactatgcacctcagtaaggagttcttgatactctcaggtaaccagaaaggggaaaagtaggttgaaaattacttggatttatagagtgaaatggatatctgatagcattatacattcctcaagttattggaaaactattgctcataattatattaataattgtaagttaaaagtgaggggaaagtaggaaatagcccactctcattctacttgacatatgcaaattttctttcaacaactgtactgtatctctgatttttgtgggggtacagtgacaaaggtacagtggaagctgtggctctctggaggcataattgtagagccctggctatgagcttgagactgcaggtaaaatcctcccaaatttgaagcatttctgcagaaactcttcaaaaaggtgggaagaatggaatgtctgaggctgagaaaaaaacaaagaacaattacaaatcatccatcttaggtggattcaatatagaattattcaaacaggagtcttttctgtgagatttcctcatttcctgagaccttgtatataaaactctggattttagttaagacaggatgggttgttttgacttaaagacctacttagtttgaagttttggaaaaagagcggagtcagtctgtcttcaaatagtttatgtcatctaatcatgaatcgccatttacctgcccttacgttatctttagtagagaaaaagctgtaaaatatggtaagggtagaaaaagcaattgccctcattagtaaaatgtctctagaatgttgcaaagtaacatttcagcccttgaaaccagagacccctttcactccttttattaagatgtctttaaatatatgggttttaagaggagtaaaatgaggaaaaattatgaattctagaatagctgttctctatgcagaactttataattgtgatttctttttttttttatactagccctcccatttctcccaccactgtgatgaaaaccttagtgagtcaatctgaatttcttgcctgctctttctcggatttatttctaagagatcttttttcatttttattttttggcacccaggaattaaatagctttaattacttggatctgtacagacttgctgacctctttaacctcactttgttggagaaggcagtgatcgatttcttagtgaaacatctctctgaactcctgaagagccgcccagaagaagttctaacgcttccctattgcctgcttcaggaggtgctgaagagcgaccgcctgacctccctgagtgaagagcagatctggcaggtaagggcgctgtgcacggtcgcttttggcactgaaaaagcatgccgtgattggaagttaaaggactgaggaacaattaccactattttagtggctttggtcctcatggagttgttttagaagtcatgcttccttgatggacaagtgattggagaacactggcccttgaggctcagagccctcagcggactctgccgcttaactcagggaattgcaggggcaatccatgagaccctcactgtggcttcccagaacctaacgtggtcacatctgagtcaagggatgtttttttcctgataaaaattgtttcttaaacaaaatatgacaaaaaaatggattgtaaagtgatatatatgcatatttaagaccaggagaatcagagtaaatttgggcctttgctgtaaacaattcagaaacatttctttgttgcaatagagagcagcttggatctcgaatgaaatgaagctcttcttgcatggcagtggaaaaatctccatccttagttcattctgcattcattgctattttcctaagccctgccttttcgcctgacatagcattcttttcacattgtgtcgctcccttgtctagaggacaggaggatgttttgtggtttgaagttgattattcaattaaatcctcttctgctcatccccagtgactattccttgaaaaatccacttggtgtctttggggaatagtcagagagcctatcttcctcctccatattacagcctgtctatctcactctctgaagcactggctagccattttgttacttgtagggtgccatgcctccaagatttcacaatcatttgaaaaataattatatacagactaccagggaaaatttaaagtcttctattagctgattaaacagtgaatccctggtatcttatcaagtaatatttagagagtattttaattctggccaaaattgtcatataggtagctgttaattattcagtagctaactctactgactgattattttcctgatgcctttctgccttatttcattatttgtgttactttaatcagtaacttccctcttcattattgcttccaccagagggaattaaagagctgcagcgtcctgaaggccttctgggtcccaggctctctgcaaacttattgacagcaggcctgaaagaatggctattatcactgcatgtaccagatgaacaaaatgaggcttctgtgccttactcagagtcacagagcagagccagccttcaaatttaagtctgctaacacctgcccccatgtcttcaatattccacactgtcttgataaagaaaatataaggaccaaaaaaacattaaagaataaattttttgtggctccttgggtatttctggtaatgtttgttcaggcagaggttgaacaggttgacaaggatctgtttttggtagaaatttcaattatctctggctctctcttataaacacaaatcaacagaatttactttggtcaattcaaaatgggaagtagtcaaattttcttcacttcccaagggaaaaagaaagatttggaatgaatcctgcatttaattttttctaactgaattgacatctgaggctaaccatccttgtggcttctatctctttttgtggcgcagttgaaggcactgccagagattgacgtggtaatgtgcagatggctgagtgtcaagaaaattccatactatccacttaagagttatcataattgcctctctaaaggttactaatattataatgtagaattttaaaagctgctttctgctgcaggcaataatttttttaatacctggtcctcaagaaagaattaaaagactcacataaatattatcaatttaggcattcagcaggcaataagaaactgtttttgctttatcttagtaaataagtatttccctcatattcaaccccatagagaaaaatcaaatcagaccgctattttgcctcaagtatagttaagttcatcatttttgctgaggttatgctagtaatgcaatataccatggaagaatctaatattcagcccagagtagagattgggtatgccagaggattagtgtcagggtgctttatagaagtgaaacttgatggacaggctggagacagatctacagaatctcattaaattgctgaattgttcattacggaacgttctcactgtaataaagtgctcattgactttgacaaatccctatcccatgtcttaaagaagaagtgtgaagcaaaaggtgttggggaggagaaaggaaattggcacaaggtaggacaggtaatagaaaactggatggaggggggcgtgctatttgattaatatgtgcaaccagtaacttagatgagagcatggtaaacacacacacacttacgcaggtggctcttctactatgtactgataatgtcatctgggaccatcccatatttggtgaaaggtctaattttcattattcaccagatttcatgcagtctggctctgaagacctgtcataagaaccttcaaattaacctcaccgaaccaactctttttcactttttcctgctgttccttacccaagccctttccttgacaaaatgtgttgtatgcaggccacggtaatcattctgtggatctgtgaacctgtaaaataccccaagatgatgccttggaactgttcttttttttccatctgacctttctaagctttattctgagtctcttctctcacagaagtcttcttggttcctcctagacaaattttcatcccttccatggtctgaaatgacttgatctgttggttaatttcactctatatttagaggtaacatagagagttgttcacatacataccttagatggataaggacatagaagttccctaaaatatattgtttttttaaaatttagttcaattcagctcaacaatttggttttatgtttcaaggccagcaatttatcaggttccagatgaaagacaccaaattgactattgggttcaaagaaaggagactaaaactgaacaaatcagctgaaatggaaatatgggacattaggtcacttgcctttgtgacctggcaaatctctatctgtttgattttgctttcagatattagctcccaattagaacttcatttcagtagggccctgttaaatatcttctgttagattttgcatatattttcagactgatgagccagggtcttaccataggagctggggagtgcaagaaatggggagatgttggtcaaagggcacaaaactttcagttagaaaataaacaagttctagggatctaatatagagcatgggttccagggatatgttaattaatttgattgtggtaatcatttcccagtgtatatgcttatcaaatcatcatattgtacaccttgaatctaaacaatccttatctgtcaataaaatatttttaaataaataagccaaaacatggcaattcttcataaaaaaaacttagaacaacacatagaagtaattctgtatcattctcatgatcagatctgttttcatttccataggaagtgctgagtaagctctgttttcttttcaggaacatgcatttcctgcctcttctgcctttaggttctctttcaccagagtaagagggagattactgttttccatggaagtacaatttgtagaaaaagcctatatagaaaaatataacatcaattcttatacacactagcatagggagaaagtatggctctccacccatcagtatgtactgagcacctactaaatacccaaaattatgctagagtggaaagaaggcagaggacagatctgccaactccatttccctcttccaggcctcctcccaaatggagagaatcctcctgattttaaaccataagtacagctctctgaatttttattttatctccaaagtagcagaaacaagaaggatatttaaaaatgaaagaaaacagcttgtggaaataaaaatgaatatttcttgaccacctgttacatgctaggcatagtgttgggagctagattctggggtaaaatgctttacaaaaatattcagtagttaggttaaggaaatttatttcacctttatctctgagtgggaagttttgttttcctttaattattaatgtattaactgtttcttacttttagtgagaacttattattttgtaagaacagtccttttctgggtaggcgcggtggcttacgcctgtaatcccaacagtttgggaggctgaggcgggcagatcacttgaggtcaggaatttgaaaccagcctgcccaacatagtgaaaccccatctccactaaaaatacaaaaattagccaggtgtggtggcaggcacctgtaatcccagctgaggcctggaggctgagataggagaatcagttgaagcgagaggcagaggttgcagcgagtggagattgcgccactacactccagctgggatgatagaatgaaactccagctaaaaaaaaaaaaaaaaagaacagtacttttcttacttcattaacctgggggttgaggacacttcctacttgtattctgagtctgactttgcctggacttaagtagatattaagaccaaaaaatttgctggctatgtgagtggcgtcaaacaaggtaagacctcagcagggagggtttcctttattctattaggttggtgcaaaagtaattgcataaacccaagttatgtcctattttagtgtggcaaagagggaccatgtcacctgatttggggctggggcaatcctgttcatatttgtccgtgattatccatccctagaggcagaggctgtgctgtagtgtttgcattacctactgcttgcactctattaataataaataaaaacaacaatgtagagtttccatattaaaatgtattgaatggataataagacatcctactattcctacattaggctggatttattctaagaaaattgatatagaaaatgagtttggccttttaaagactgcatttttccttatatttttgttggaaatttgcttccctaagtcatactcttaataacacattcattttatatcttgagagacataagccacatattgtttagtcaacaatctcaaatgcagtggtttttttgacacgctcctcctgggcttttatgtataccacagaatcagccacgttacagtttgaattaatcattttcttcaaaaggagtcccagaagtgaacccaaacaaaaagctactatccctttacagttggaaagtagaagacactggtgatgtactcagctttcatcttttatccttcgatgataaattgacccaaatgtacctctggccaggaagaagcaaggaatttaaatagtactagatgtcaaacaatactattaaaatacttccaatttgaatatcacatcacagttttgaaaatgcatcttcatttattattgctttgttctcctgtagtacaaaagggaaaactgaggttacatatctaggaatcaaactcatgtcttctaattcttgagctatgtctactttggtctatagcttctaaatttgtaatagaagctcagaaatactcaggcgatgggcacagaggtgcatccaattaatcctatgactttaacaggaattaagaagggcttgattagctgggcacagtggcttacgcctgtaatcctagcacattgggaggttgaggcaggctgatcgcttgagcccagaagtttgagaccagcctgtgcaacatagtgagacccctgtctctacgaaaatattagctaggcattgtggcatgcacctgtagttccagctacccaaagggcaggttcacctgagcccaagaagttgaggctgcagtgtgccgtgattgcaccactgctctccagcctgggcaatagagcgagaccctgtctggaagaaaaaaaacaaaacaaaacgaaacagaaaaaagagcatgaccattctagttcccttgggtagtgcccatggattgaacaaatcatggcctctgtgcctgcctccgtgtctgtgtcatgttgctaattctaattctgttagatgacatatgcctcattcattctttcattcattccaaatagttattgagtgcctgctctacccagccatgtcctgtggggtactactattgcctgccatatgatgggtgctgggtagtcagtaatgggaagcaccaacagggtcctgctgtcatgggcctgacagtgtctgatgtggggctttccgcttgctgctctttcccacctgcccaatgccttcccagtggggactgacctgtgccaaatagcataatgatttctttgccaagttggggcacgttgaaatgatatgggtacaatggagatgacatgcttttgactggatgtttcaataccaaccagtgacccttcgccttttgttcaatgctttgcttattgttaactctcgatagttgtatgcaccctctaaacagcttcgcaaacctttgtcaatccatgtgatacagtccaagcctcaaacaaatcaggctgtgggtaaacatttaatcaaaaaattctacaagctgtgttcatgttttaatatttggaccttggtaactagaaatagaataaaatactaagaactcttatcctcaaacaaaattataatttttcatcatgttcctgcccttcttcaattctctttctttcttttttttttttttttgttgttgttgagatggagtttcactcttgttgctcaggctggagtgcaatggcacgatctcagctcaccgcaacctccgcctcccgagttcaagtgattctccagcctccgcctcccaagtagctgggattacaggcatgtgccacacacctggctaatttttttgtatttttagtagagacagggtttcaccacgttagccaggatggtctcgatctcctgacctcgtgatccacctgcctcggcctcccaaagtgctgggattacaggcgtgagccaccgtgcccggccaattctctttcatacatgcatgtgttgttactattattttcccagatagctactttctgggtatcttcataatatctcctattttttaaagttaccatttcttaaactcatcaaattcgtacatgtggtcccaacttacaaatttgtaccacttcttaattttctttctgaaactttttatagtttctcccaactacatacagtttttttctacaaatgtgatgagggtatctccatttccttcttcttagatgttagtgaagagaataaacagtggctcctttgcatcccaaataatgttttgcccagaggatgttttatcctttgaggggcccctagctggacacagagtaacactgctatttcagggattggtgctcctagttgccagagcatatatttaatctttccttctaatctatatgcggctaactcctctgtgagggtgcatcccacagtagcttgactcgtggctttgctgttgtttgtctggggtatatgcctttgcaagacgcatgacatgttcatttcagaggggctttgctccagctaatcctcagtgctagagctgtgcgttgctgagtagctgtgaggggcagtgattatcagaaattacaggagacccaacttgtattcatgtgctgctgttctcatgagttaatagttttttttctttccttctttttaaagaatgagcacaacagaacaacaaggtgatttatgagatatgacatatttatgttctctgcttctaattttcattgtgattcatgttgtttccagactgatatttttgttgttgctgctgtgagaaggaaaaagatgactgtagaatattacttacgcattggtgccctgcagtaatattgctgctaacctgggttatcagggatttaaaaataaaacccaactataagccatatatgaggtagaaaccctgaggctagcgtagaagtccatcaataataataccaacaataataattctttacaagcctagagggctttatattttaaagcatttcacacatataatttctcttgagtctctcatcacccttgttaaggttgataaggcaagtatgatccaaattttaactagtgagaaaactaaagcttccagaagttcaatagttgactcacttcacagtatagatttcaatggaggtctcactgtattctcttgaaatacaccaactctttaagaaaacagaaactcaaagtaccttatatatctcataagtcaaacgtttttatatattactctgtaatgagtgagccagaagtagacatttcctaatacattaccagttttcattttcacctgttgtgagactttgtgggaagttgcaaaaatgtctccaataaagtcgtacaggaaagtgttgctgagggtctttcttgatcagagcccagaaactgaggctctggatggtttgataaggaagaatgcttagagaattctggcagagggagggaaccatcttttattccttcaaagtacacgatggtgtagtataaagcaggaaatgaaagccgataagggaggatctctttaaaatctgaccaagagacataaattagagtaaaaaagaacctggagtgccattatttctgttgcagtgacacagactgtgtgggaaaaagtctgtaggctgttgtccctatttgagaccagagattggatggaacaaatggaaatgattgatcattccatcttcattttatgcccaatatattgaaattttagaaatgtatgcagcataaattgacagttgggtgatggtttagatatggggttcaagagagagggtgaaagatataaatttcttgaaattgataaatgttagtctctttccaacacaaatgaccctgtgagtcctttttcttcaatgttaggccagttgaatagcaatgatgttcatgctaattggctgtgtcagaccatagagatttgctattctgggagttctataggagaggatgtaaatttacttataaagtgacccagaggctctagaattatttacattctaaggagatgtcaagagaagcctcaacatttattgttgaatactgacttccttagaagtgcttctcccacccttgcctccaaaacttctgctacaaggaaaaataacaccctgattcaacacacctggaggagaaaagtggccattctgagatcataatcaggagaagcattcatacatcattcttgagctttttttatgctcataatacagagttatgcattctccatggtgaggatccaccctttcctctgaccacctcctccttgttacgtgcggtggcatgttgatgaactgcaaacctattttgatattctggtagagaaagcataaccaggaagacaaattcagggaaaaaaagtcaatgactgattctaaagttatgtatcaaagattttgtgcattgttctcctttgtctataggaagagttacaagtcagtattggtaagtggcacggtattacttatgcttcaagaacaggagctaaaaagacccccacacaccagaggctgaggacacatatcttctttgtgtgtgttcttgttgatgaggaatgcccactaccttctctggccacacaaggaaattgggtaattaaaggagtgatggatggtgcgttaaagtttaaacgttttaggaggacctatcttattaacactttaaaacaagtgagcataatatcattaactttgattaattcatttgctcttaatatagcttttaatttgtaattctacgtgaattacaatgtaatttggcattaattatactaaattgactataagtcagccaatcacaatggaaaattactcacagctgaaactaaaactaaacctctccatccagaaaggacgatgcttagttaagtggcaaacacactttaggctctttggcagtgagaatgacattggacctgctgaggactgtaatcaatttctcattctgcccactgctgggactatgtactctttggagtgaagccccatataaatccaataaagtgtaaataatgaagtaaacaaaggggttgatttatcaggtttgccaggtcccctgaagaatctttttgctcttctcatctcatgtaagttttaggcaatgtagaggggctgtgtagtgctttagaatgattaattccacaccccttggattctgggagttagaataggcacctacccaaattggcctgcttctcgtcttcatgctctgtgaaacagctgggaaatcctgttttcgaccccatgtgtagtcagtatcctgaagccactcctatttgacctatacacaaaatgccttctaggcagaaggaagtcatgccttaaaaagccaacaccacactgagagaactaaaccctcaggagatgatggagcatgtgtcattcattgataaagcttgtggaaggtgcccgggagcacacaagaagtaaagtgatctgctgaggaatgcagcccttgagaaagtgtgtgtgagagtgaggatggatttggaaaatacatgtgtttgaaccatttcccagatagctttctttgacaactgtcttctgaaaaacaaaacaaaaactctgagattttgcagaaagtcatatgcaagatttggcaatattctgcttgaagtccatttacatgtaggtagaacgacatgaattttgtacattctagatacattcctggtgagcaattggctcataaaatgaggcccggttcagaggcaacaaattttgctaaatattgcacggaaaattcaagactgttattttataggtcttctttttaccttattagttatataccccatctcatcattctcacacccaacgtagctaataaaatggcataagttttatataaaaattttgagtaaagaggttaaaagccaccttggattctgagccaacagccgtcctgtcctctgtcacttacacatatgcaggtgggattcacacagtgcacacacttgcaggtagacacgcatgcacacacacatattagatgcatattaatctttgcagctaaaaggctttcctttgttttgcagcactgacctaaatcataatactcccaccattggctcgttggtctcagcattaaagaaaatagaaagtagaagcttattttcaccactccaagcgtatatattccattcatcactaaactttttaaggatgttaatgccaatagtttgttaacagaagcagctgtatagatgcagctttatggtgtttcagttctctccaaatcctttttatgctagatttagcctggcctattgcagaatttttaattccttttccccagatattctttttgatatccacattggattggtgggttccagtccctttcctaccaattgtggttcccaccatagcatcaagttcttaagcaaaaacaactcctgtttgaggcatgccctctgatggatgagctcttttgagctcttaatgttcttactgcttttagagaactgtaaggattttggggcaaaggaactaatactgaagtaagcagagcagtgagacggggggaaaacatttacaggatattcctgcccttggttttatcttctcatcatttaacagcagcagaataaatgggtctgctaatgaaacagcactgagaggttaggtcattggaagcctttttagtcattttgtgcttttcaagagcgaatttgttagaattatgctgaatacccacttaaagcctcagctgataaccctacctgtgttttataactctgcactgtcagaactcataataagtcaaacattctttcagtggtgctcataagggagggaaaaaaaccacgcaaatttaagagtaatttcagattgtaaatgaaaaggagaggcacgactgttcatttgcaccaatcatgccttcctttcatctgctctgattaggcctggtgcggtttcatcagactcctccatcaccgagctgtcactccagccgtctgttgattgaaaacaatcaaggctctgatggcacaattattctgaccctttaactagaggctgctgtgataatgaaaggttgattatgatagtttgtgcctctttcagtttgccaagaaggttaatttgggcatcagacggatgtttaatgggcgcttgctggctacactgaggtaaatgagaacgtgcagtcttggatattgcacggatatagtttggctgtcaatcattgtcatttggagtttgtgcctcacactctggaaatcacattttattttttccttgggatttaatttattctgtgccctgaggaagttctttcactcggtgaccttcacagcagctttctctgccttttttttttcttttttcaaatggagctcaaaggcacaacacatctagaagagcattttgctttcattttcacttaaaaatggaaactttaaaaatccgtccttatcactgccttccaatagagcaaatgtttccattccgattgtgcagtgggaaagtataaacgacagggatactttagccagtttgctaatgcagcagctcacacagttgttctgccctgtttcgcacagtaaccagcaaatgcagtaaattcaaaatgggcacatatatgaaagtgaaggccccattctatcactagcatgtctcacaacagtttgtagaattcctgcttccaaacacagcatcttactccttttaccctccttcttggcaaacataggggaggggttgaggaaggaagacagagatttgtctgtggaagcactaaggttttaaaagttgcaaatttcaatttgtataaatccagcacctaatcttgcagctatttgaagtataggctaaaaacgatacagacatctaataatgctggtgtttacaatgtgcagctcacattgtgttataatgagctttgtaccgctttcatgcataccctttaaaaaagaaaaatagaggaaaagaaaaaataaaggaaaacctttatttctgtctccaagctatgcatagtggtctcatcatatattaggcacctgagagctagaatcgttttgcctttttttatttgttgtcttcattatttttttttcctccaatgaacattcagcagcatatttttacctagcctgggacattttttctcacatgtcaattggaaaacaattaagtctatagatgttaaagtgacagcatcataattattgtaattttacttcaagtgttctattttcacattatttttttcttgctttcaaaaaaccctatttgttttttaatagtaaagagagtcattaggtgatcattcagtctcacctgagaagtctccaaaaatgaattaagtcattgaatccagttgctgttttaatgcagcccttatttaatgaacagttctgtttaaaatgtttatttaaaaaataaatgagaatgggattgtgtatatatggtctcacaagattcctcactgcagtacaccacaaatgattatttttttagctctataaaatagtaaaatagacctcagggatacttcataaaattattgctttgttatgtcttgtttttggttaagcaatgggaactaaaaagataatttggagagaagtgcatcagtcaagtcaatcaatagtttttgctattagaaaagtaatgcaaagtttaattttcatattaacttgtgggatctgtgacaatgaattattttatcttataggttcgctatgtttttaaagtaatgggactcaagcaaaggccgtttcatcttaaagaaagcataactcattttgtcaaattgtttctggtctaagcctgactgagttctgagtttccccacgtctgtactttttatatcaaagtcatctccaacacagagggccttcttccctcatacacctgcatgacatgactgccactgtcctgctctcaagcagactctgtccacccagactgcacccctcaacggtgatattcccgcttgggtcctcttgcctttcattgcctgcctgtgctggccatgcttctgctaccaggctgggcctgctcatggggcccagtttctttttcctcttcagtgtggccttctctatcttcagggttcaccttgctcttcctcctaatctgataaagaatgtttcagacctgtgatttccccagattggactcctgtgttctttcattcgacattgatggttctcagtgaggctgcaatacagtctttctctcaactatcctacagattctcttttgcaacagctactaccttctactcattccttcctcctccacagtcctctcttctctcatgagtcttctgagactatcaggcggctggttctccaccacagggctatctctctacatctctgacttctttgcatgactgctgcacgctgggctctctgggccacttctcccacccgaactaagccctgcccccctgtctctgctgctttgattccttacatgcttgatttctgttttgagacttatctgacatttattgtttgtaatgatccttgtggaacccaaatcctttgatatgactacctgggcattggcccaaatcttctctgaaatttctatttgggttaaaaaaaaaaaaaatctgtgatcattgtggtgaagagggtatcttcttcgataaaaatattatttgtatgatcagcttggccaacatggtgagatcccatctctactaaaaatacaaaaattagccaggcgcggtggtgcacacctgtaatcccagctactcaggctgaggtaggagaattgcttgaacccaggaggtggaggtagcagtacgccaagattgtgccactgtactccagcctaggtgacagagtgagactctatctcaaaaaatacatatataaatatatatatataaattgtgtgtactgtactcacaggtgttacaaagtagaaatagaggattcatagttccctagttttttatactatgatgaaatgaagttagagaaggcagtgcaaaatatgctttttcaacatcagtagccagactgaaattcacctagtacaggtagtcagtggtgccatcaaatttatgtatatcctttgcagctcactgacagtgtagaccctggctccccttccccagccctaccagctggctggcagtgctccttgtcctatccccttgacagtagagtctggccctgacagtgtttagtcctgtgcttcagtttatgggttcccccatgccagtctctgtgccccatggctctaaaagatgtttaaagttacctttgactattcttttatttttatttggaggctgccaacattaaatccttaaatgcaacttgggtactttctggacatctaaactcatcatagtaccacttgtttgagggatctgactgtccctatgtcagtgacctggggcagctgcttgagcccttgaggtccatttggttataatattgaagatttgatttcagatggtgagcacatttgccagtgaacgtgctcttgtgctcttggctcattattcttttttttttttttttttttttgagacacggtcttgctctgttgcccaggctggatgcagtgacacaatcatggcttaatgaagcttcaaactcccaggcctaggtgatccctccacctcagactcccaagtagctggaccacaggcatgtgccactgcagccaagctttttttttttttttttttttggtagagacagggcctccctatgttgcccaggttagtcttgaacttctgggctcaggcaatcctcccacctcggcctcccaaagtgctgggattataggcatgagccactgcattcagccaagctcattattcttgaatcaattcatgaacaaatattcaaaggcctaatgctctcaggatgcatgtttacaaattaaacagtttttttaaaccataaaatgtataaatgtgccagcaacatttaaaacaccaatgaaatgacaacatagaaagatgattcgtgtgcgtttctgaaaaatctgtctacaaaaggcttaaacttccagatttgcaggattacctccaacaattccaaatttcattagaatattttacaggaacatatcaagacactcaaaatcaagaataagcctcgagttttatgatattaatggaagtgaatggcaaatgagaacgttgatatacactgattagaatctttctcaccaagtttctgacatataatggacacttaagaaaacgagaagtgtttgtaatgggagatccaagccaagtgatgaaagtgacttatatgctgagtattgtacaaaaacaactgggtttcagtctgtctctcccttttcattcattcattcattcatgcattcgttcatgcttctccaacgttgaatttaacaaagccacagaacttaaattactggattagaattactgagtttatttgtgtgaaatatggttaatcataagagctagtttataatctgttgtgctgccatggttttattatcactttaaatatgtgaagtatttaatactgtatagcaaatttcttatcaactatagcaatctctcaaaatttacatcactaacacacaatgttgtattacataaaaatggtctgcatgtgatggctttatcatgaatttaaaaggataattatattggggaataccttcatctcttggaggcatattgccatcatataaattctgtacattgtctaaatatcagtttaccaggcaccttcacatgtctgatcgcattcagtcttccgtagaaccctatgacataggtattatcatacttgttttgctgagtatcagtatgttgataaaactgagtatcagcatgttggtttttcataaatgcacaaatatattaggttgcagaaatgggtcttttgacatcaagtcctgtattcttttccttgtgtcagatttacctctataggcatataccaatttgtgatagaaaaaagcatcaggatttccctggccatttcagctgacttcaccctggtaatgcatccttattgcatgcagtagctaggaaacaatggggggtgttgtgacccacatgaggtcactctagtccctattgccaatgtgatacagaagggttttcttttattgaccaaattggttttctctcattttccagtgtagttatacaatataagctaaatacctcagtgaccacatgcaaagttccttcaacatctagtaggacatgttatgtaaatatgcaggagctatcattttatttagaagtctcatgtcatcaatccagtattgagtaatgctctgatgcaatcccagccatcaatgactagatggatgaatattgtcttttggctcagagactatgatcaaaccactgaagggaaattatagggtgttattctataactgtacatgtgttttgctcaaatatgaggagaccaagaatgggtttcatttttcctatggcatcattggcaagggtggtgctgttttttattgtcctgtaggacattttcgccatttaaaagttttgtatatactagatatgggatgggaatggtatatatacatataacttttattttaggtttgggagtacacgtgaaggtttcttatataggtaaactgatgtcatgggggtttgtacagattatttcatcacccagatattaagcctagtactcaatagttattttttctgctcctctccctcctcccccaccctccaccatcatgaaggtatatttacctctacgaggtaaataaatataaatataccattatatataaataaacatagaaatataaatatgcccattatatataaataaacgtatataaatgtaaatataccactgtattccctcatggagggaatggtacatttaaagacagtccagaggtaaaatatatgtgaacaatttactaaaacttgaatttatcttttttttttttttttttgagacggcgtctcgctctgtcacccaggctggagtgcagtggtgcgatctcagctcactgcaagctccgcttcccaggttcatgcgattctcctgcctcagcctcctgagcagctgggactataggcacctgccatcacacctgggtaattttttgtatttttggtagagatggggtttcaccatgttagccaggatggtctcgatctcctgaccttgtgatctgcccgccttggcctcccaaagtgctgggattacaggcgcccagccatgtataaaatcttattctgggattctaaccaatattaccttgaagcagtcaccttaataaatttgaaatttgtattctttggcacaaattttatttttacaagagatggtattattattcagtttcatgatataatctgatcaaagttgttcctagggagagtgactatgatgtaacctagttctctgcattggccccacgtgcatgtgcactttcatacatgcaaacattcacgcagacatttctgctgagcacagaattatagacaaaaaaatgtcaccttgtttttctgaaaagagatttatcaaaactctctgtgctacagaaacctgtgacttgggtactagattaattttggttgcctctaccacctctaggaaaattagagaattctactttaaaatatttttggtggatccataggtgacgtatatcctagagaaggaggagactctctcatcaactaatttattttaaaaatgagagccaaataactgatccaatgtcagccatatactcacattgcccttttaatactggctttccaaagatcagcttacactggtggctgaatctcacaagtagagaagatatcacaggttattaacctcacctcttatcctatcttgattttctcttcatcttgatataaaatttaccttttaaataaatcctcttttgttattgttataagattgagcaaagggacaactcaggtcacttttcatgcacccccactaaatatctggaacttacatgtggcaggtctgagggtagtttttgttgtggttcttccagtcctgtgtgtttatccccatttgtgggaaatagacacctttagttgcaagggcttttcgcttttggaactctgaagtatgtactttaaaacatgtgtttaaagatgattaccagagaacaaatcttatgctaaaggtgaacataataacatttaccaatctttcaatttcccaaagttttaaaggaacaatgaaataatgtattattatcatctgtgataagctgaatattgttttaaaaatctgtcaggttttttttcttacagtatatgagcctcgggcctcatcagatttggttccattgaaatatatttcttagaagaaaaaatagcctatgtgtcttacataagtctgtagtcagctataatggttaatgtgcaatctcccttgaaagatctgtcttacaaggaaaatgttgacgcagttttaattatagcactcaggtgagcactgttataatttttaatattcctccatggtaacattttcattgttctggtaaaggaaaatgctctgatgctgcgtccctagtttctggtgcttttcgattttatgggaaagttgtctttttgaactgaaacttttcatttggtctcaaggaagagaatgtaactataagatctgtcacatttatttattagtatacacttttctctctatggcagttgctattctggtttatgacaccattatttcaccttacatgattcacgttaaagaggtgagcttctgtgtagtattgcatggcaaatcgcaacacctgctcacttgcattagggaaacatcacatttttaaagaaactgtatgtaatattaaaaggataacatgctaaagttttatgtttattagaattcaaggcattataaaataatatctaaaacaatgtactttaatatagaatgatcactgaactcttccctttgagaacacaaattagaagataaagagcatgctcgatactctgtttagaaaggaaaagattcgtctatgcatcatcatccattctattaaaacacgctttcctggcttcctacttcttgttgcccaagagctcatcaacatgccctgctgtttgatggaggttcaggagtgagtttttgacttgctcctgtgcccttcctttgtctttttctgaatttgcagaagtgtggaatttgtgctgccttttgtgcactgaggggagactggtgccctggcttacctcaatgggatgacaagactggtaaggatatggacacttgtgcctcacagcgtgggattctgcaaagagaagggctccgtgtgcaccttcagcagagctatctgcaaccagattttacataggaacataataatagctgcccctggccaaggagcagaataaaggctatgagcaaaaagaccagtcattgcttactcagctcttcatgatgagctctgtgataagaacatcctttcagtgaaagacaatatttgtagaccaagacaaaaaaaaaatacttgttacttttagacaatgacatagggctttattctttgttagcattgctttaaaagatttgatcactcatctgatgagagcctgctttttaagggcacttgtatttatatatatttgcaagatataaagacagttctatggaagagtgcaataatgtttattcttgaatttgggatgtcttcataattaatgtattttctggaaatcggagaataacattttcattgttttggcattcctttggggtcatagtgtataatatatatggatatatacaagcagttggaattcaaaacatccacttctttaaaagaatcaggaattttagatatcaaaacagcagcttctgtctgagtgtgtttcacatgaacaataaaggaattagaatcacaatatgaggacttgataatgttaggaatataacttttttcatataattgatatatttctgaaatacatatgattaaattgcatattttaattgaactaggacaaaatttgtagcatttagaattatactattatgtttaggattatatatcatatattctactctgtagagtagcaatcagtagggatatgctgagaaaactaaagggaagggattatctgttctgtatatttttgggtcaaatttagttaacaagaaataatctagaactaaaatacatttaaaaaatagaccgggtgcagtggctaacacttgtaatcccagcactttaggaggccaaggcagatggatcatttgaggtcggtagtttgagaccagcctgaccaacatggtgaaaccccgtttctactaaaaatacaaaaaatagctgggtggtaatggcgcacgcttgtaatcccagctacttgggaggctgagacaggagaatcgcttgagcctgggaggcagaagtcgtagtgagctgagattgcgccactgcactccactccgggtgacagaggagaccctgtctcaaaaaaaaaaaaaattaaatgtgaaatatgtattctcataaaaagggaagcaataattcaacactcaagacatgtccttttccctcagtatttgttctttaattacaaactctttacttggtatcataaacctatggtctttatttctgaagtaatccataaatgaggctcactgaaaaatactaccaacctattttgaagcaaaacattcttatttttaaagcagaatttatttttctaatttattgaatatagaagttattttttgggctgagcgcggtggctcacacctgtaatcccagcactttgggaggcgaaggcgggcggatcacgaggtcaggagatcgagaccatcttggctaacacggtgaaaccctgtctcttactaaaaatacaaaaaattagctgggcgtggtggcaggtgcctgtagtcccagctactcgggaggctgaggcaggagaatggcgtgaatccaggaggcggagcttgcagtgagccgagatcgcgccactgcagtccggcctgggcgaaaggcaagactccatctcaaaaaaaaaaaagaagttatgtttggacttagtgcatttgcctggattttcccttgaaataattattgatggaaaaataatggcaagtagatataattaaaaaatacatggtataagttaaaaacagtttctagttctagcttttctgctaattcattgtatgacttgggttaagtcggttaacttgtctggttttgatttccatttgtaaaatttaaaagcttgagccaagtggactcagctttcttcttgctcaaatattttataatttatttgaaggtttaaaacactgcaatgcttattgctttgccaagaatctcaaatagaagtggccaacaccaaacatgtgagggaagaaaacaagggcttatgaatctaagtttagggcactgtatgctgcagtgtggagccttgagggcttataaaggccttataagaaagccataaagatgagataataaaatagaaaactgaagcctgtgatagataaataaatatgtgtgtatgtatgtgtgaataaaggatttgatactatttgtttgagagaatctgagaaatagcctaaaaaccgaattttccatttatgccacaaatatgtatagcaaactgtgggtcaggtgctgttcttagcaaatatctgaggatcaattggtttgaagttggattaagctgtagctaatgttccttttaggaaggaacaattctccattgtggtcagatgaattgggtcaggcagggtgcttgagagacctcctgttgtacatggaaatgacggtctgctgtgttgcaggtggtttaggaaatgtcttacctaatggccatgtttcctaagcactctttcgtaatgtcctcctaaactgaatctgttgtttcttttccactcttgctggcttggccaccaaaaatgctgcatgctccattttcttccccattaaatcctagagtttatggtgatagggatttcagtatgccagaataaataagatagaataggattcagcttaccctgagttgtgctttctcagtgtaatgccattattttaaaagccaccagttccaagaataatttttttcaagcttaagcaccgaaatataccacaaagctaactgttgtctttgggttttatgatgccccaatgataaatcagctttcctcttactgtagtagtctttaagctccttaaatgggctccaggattccctccaccagcatggcagtgaataatgttagatgaggttcacagcacagaggtgattttgaagtggcccattgttttgaattttctttgccattttttaattatttatttgaataaacaagagttatctgtgatttcagtggggtttctcctttagattcttatgaacgtaaaaacagagcacagtaacacttttacatttatgtgtttattattgcaaaggcaaaaatgcagagtgtttctatggcttactttatgttatcagaatcagccatcgatttatagactgtatagaaccaaggtctcaaaaaatgctacctcatccgtaatattaagctaattaagtatcttatatcataacttaagcattacttcaacttcactggatttatacctgcttaaatttaaaaaacagagtgaatttcctctgataaggcagcaatttaccatagtggatggaacagttaataaatacagcttcgtagagtaactaaattcatgacagcctgataggagaatactgttatgaatggaaatctgtccaaagccttcctattcaaagtgtggtacatggaccagtggcatatgcaacaaggactttgttggaagtgcagactcctcatcctccagtcccccacctgctgaatgagagcctacattttgaccagaaacccccgtgtaatttgtgtacatgttaagtttgtagttggtgacaagatggttagttgtaaattagattcacctttgatctggaaaaaaatataaacccaacaagtagggatgacttgtatagtctgaaaatattaataaatgataaaagttgaaagttatatgaaatctatgagaagttagaaatgttggaaagaaataagataaaaatatctcagaaaatgcaaactaatagttatgcacaaaatattctgtaatacatagtatttggagaaattgaacacagaaagcatcatgacacatgtgatgtgggatgatagtagaccacaaaccagaaattaatcagtaatagatcacagtggtcaccgttccatggctaattttattctttagagtttttcttaaaagcatagcttagttgaggcttgtgtgcttctcacgcagttagtaacactgcttgctggaaagataaagataaaccggagggtgttcagagatgggccagaagattgattatggcataggaagagctgatttatgaggagagagaaaaataattaaatgggcagcactatgctataaaaagagcctatggagacatggatatttatctaatgtctctagtgctgtttccggtagtatctatgtggatgcagaactgtaaggatataagaatgccaagaaattggttgcagagcaaagcaatatcagctagaattacttgactaaattaggaacaatagcaaatattacgtttcagaaatttttccctggtgcataagaaatgaccttgagctggatgactttatccctgagaacttttaaaaacactgtgggcaaagagtggaaaattatttatcaagttgctgaacaatctccccagaaataattggaaccccgtgtcttgaaaattccaagattagggtagagaaaatctagggtgcagcatgtgggaactgtctccacttctggcagagacctggtgattgatgagtaccatttttccatatcactcatttcttttgcaatatctttgattattgcagatattaccatacatagataattttttgtcaggttggtatcttatttagttaaaaatgctaccttctataaaagcatctagagtgtatcgcttgtttgacctctaccgtgtctgcctccttggcacctagcgacatttcctttttcatttctctcactctgtcactcattaagagatgcaattcatgacgtagcagaagtgaattcacttccacgttcacttcattcagaaaactaaaaagacaagcccaaaatgcatcttgcctttctggagccctttttcaactggatgcagaaactctgaatgtctgaaatcatctagtgccttagagagtttagtgattcttttcaccgggttgaaaacccagtttgtgtttgccaaggagcagtggtctgagaataccacatttcctcttccctccctcagtacatttcccctgatcccccagtaaaatctgttatctgaacagggaagcccagaatcctgattccatggttcaaaaaggaagtaaagcacgataaaattgaagcaggatattttccttgacagctttgcaggcgggaaccggagcacgggcaatggagctagctggctatttcggtgccggcaggggcaaactcaaaacagaagcctgctgctgttggtgtggggatggttgtggcaattcacattgttctgaattgcttatctgattgctgggccaaatgcttattctacttagtaacatttctgaagtttgtagcaaaaccttaacattataaaagaacagataaggagccatttcaaaccacaaaggaagaaaggaaagataccacagaaaagtcttggggggggggggtcttagccaaccacctgttacatctgggactgggtccagtccaggggccttccagcaacactgaggagtggccttggccagatgccttcagttgccccaggactttattctggtcccacatggtggctaagcctccatgaagggaaacagagccaacattcctttcacctgcaggaaagagagagatggcagtgttgcatcctgtcccctgcaagaggcatagctcagaagaaagtctgaggacaagaagagacagatctgcattttactcacccttctgatgtatcctaggcaggctcccagaggaagatcctgggcgggcctccagattccctgaccccttcacgggcgggaactggaatgcgggtgctggggctagccagccgcttcagtgccagcagaggtaaacttcactcactcgaacccgctgcacccaacccctcatgggacggaacatgcaggtgagtgagtgcaggacctggcaagtgcttttgggcactggcaggagcaaaactctgtgcaggccccaccacagcatctagtggggagtgcctgtagcccccaaagctccagaaggagtgttatggtacaccttcttttatctttgccatctgtggatggcttaaatattaacagctcagtggagggtcaccctcttggcacctgagttcttgtctggcgttcaggaggaatgaagtcacacaaacaagatgaagacggtaaatgtgggggattttattgccaatgaaagtgactcttagtagaaaggggagctggaaaggggatggggtgggaaggtaatcttcccctgaagtctggccatcccctgttggactcctctctgaagctatgctgtcaagctgtccctctgaagtcaagccacttctctccaactatagtctctgacatttagctgctgcttctcctcttgatgttcagtcacttctcctctctgctggctgtgtcaggggtttttatgggtacaggatgggggggtggggtggatcatgggtggttttggaaaagtcaacattccagcatgaaacaggaatgtatgttctcactttgggctgcggtgccaggcttgagggtggggccctcagtggggacccatcttcttctgcccagaatttcctgcctcctgtccctatcaaaattatttaatattctatttctttgcttcattctttcctgctaattccttcagactcacattcacattgtctgggagatctactttaatgtaagtgctgctaagaataattcatatcaaatatgttgactgagatgttagatatacttcattatgctggtgtgtgggaaggtttgccaaacttaactattaagtcacactaattaaattactttaggtgctccataaatgaattgtggttttttcattgatgattttttttttttcctgagatggagtcttgctctgttgcccaggctggagtgcaatggtgggatctcagctcactgtaagctccacctcccgggttcaagcaattctcctgcctcagcctcccgagtagctgggactacaggcacgtgccaccacgcccagctaatttttgtagtcttagtaaagacagggtttcaccatgttggccaggctggactcaaacccttgacctcttgatctgcctgcctaggcctcccaaagtgctgggattacaggcgtgagccaccatgcctggccctgatgaatttttttaattttaaaaaaaaaaaggagaatttcttaaaactaaagcaggtacattatcataaataacaaaatgaaacaatattctttattatttaataataaatatataattttatttataaaattattataacaaaattaaacaataatttttattatgtatgacaatgtacctgctttagttttaagaaattctctttgctcatatcaaaatgttataactcctttccttcttagaagagatctgaaaggaataaaaaggttaggattacattctgctattatgttcataatacaaagatgatctcctctatattctgtttttgtgcaaacgactctaacaaatttccagtatcttacatgtgcaaattacaactgtcttcaaggtaaaagttaattgagagaaaaaattaataggttagaatcttattttttcttttcttgcttcctgactgttatacctactaaagggatgtggggtgggagggggagtcttttttctttctaaatcattctgctagtgttatgttgactttctctcaagtacaccctgtggtctcagatgatcacatattttcttacgttactcatattgatacagcaccttggcttatgggttgacatatattacctgagctttgatgacacctcccaccattgacatttcctggtggtggggtgtactgagcctcttatgcatgaaacataagggaacaggctgtttcacaacagcattttcattctttgaaaatcaattactgttcaccccaaatggtatctgaagcccccatcagtgttgcttcacattgtttcttacccctacagcaatgtcttgagtgcttttgtgtctttgctgagacggaaaaaaagttcctcacatgggcttcaaaatattccagttatactgtttgtaagaaagtttgtattattacctgcctggaagaatacaggtaacctacctatatgctgttgctttctctttctttcttacctttgtgtctcctctcatctcacttccctctgtttcagctagctgtgaggtggttggaacacaactgccactaccagtacatggacgagctcctgcaatacatccgctttggcctaatggatgtggatactctccatacagttgccctgtcccacccccttgtccaagcaagtgagactgcaacagcccttgtcaacgaggccctggaataccaccagagcatctatgcacagcctgtctggcagactcgcaggaccaaaccacgattccagtcagacactctgtatatcattggtgggaaaaagcgcgaggtctgcaaggtcaaggaacttcggtacttcaatcctgttgatcaggagaatgctctcatagctgccattgccaactggagtgagctggctcccatgcctgtgggaaggagccaccattgtgtggcagtcatgggggacttcctgtttgtggcaggaggggaagttgagcatgccagtggccggacgtgtgctgtgaggactgcctgtcgctatgacccccgcagtaattcctgggcagagatagcacccatgaaaaactgccgggagcattttgtgctgggtgccatggaggaatacctctatgcagttgggggcagaaatgaactgcgccaggttctgcctacagttgagcgatattgccccaagaagaacaaatggacttttgttcagtcctttgacagatccctttcatgccatgctggatatgtggctgatggtcttctttggatatcaggtagaacatacctcatgttggatttatcaaaacacactttcattgtggtatatatttaaaagtcaagctttaatactgtggccatgtgtaattgaaagattgaaccaagcatgccattttagctaattaacattcatttattgagcacctactctagagagcaatgtaattggaaataatatgcctttctgtgactttctgagtgactaatggaataaaaattcaaggtggaaattgttggtccatcacaactgtttttttcctaccagaacttctcctgtcagctcttgattattcatggattgtattgcacagcttgtggtttatctaggtcctttgctttttctttcacccctggctacctgactagagccatttcatcaaagacaaggcaagagaagtataagcccagttaatccatttttctgggtatatcaataggtatatatccaagtaatcactatgctgtgcattgagagaagggatttaagttaccaaaacaaagttgttgttgttgctgtttcagatagggtctcactcttgttacccaggctggagtgcagtggtgccatctcgactcactgcaacctccacctctcaggctcaagtgatcctcccacctcagcttcccaaatagctgggactacaggagcacaccaccacacccagctaatttttgtaatttttgtcaaggcagggtttcactacattgcccaggctgcccttgaactcctgagctcaagcaatccaccagtcttggcctcccaaagtgttgggattgcaggcgtgagccactgtgcccagcctaaaacaaagtttgtttgtttttaattatccgtgaatggtagttacttgtgccattctaacccttcattcctatttactctcctatttttactgatggtacagtttgagctctagtttaccttttcatctcttttgaaaaccttttgattatggaaaaagtagggagactagaataatgaaccccatgtacccacaacccaaaatccacaattaactactccttgccaatcttgttttctctacacccacagacccatcacacccctctgggctgcctttttgcttatacagaaggagtctgtgaggcatatgctatcaacatcacattataaacatgtgttttcaatcttagttttgagaaaggccctaagtgttctcctttgaaaggtttttctatcaggaagaaagctgcattttctcccagttggaagatactcatattgtaatccaaatggaacttgttggatttctgtgtcatcaagcactaagaggaatagaaagggtaaaaaacttaaatattaagaataaccctgatgtttgtacttagaagaaatcattacttttaagtacacctgcaaaggcttctcagctttcctcaataatcgtctctagtgttctaacacctgctctgacaaaattctcccttgcacttctttaaattcatttggactttgactgttcttctgctgtcctcaataaccaggaagatagtcacaggctcagcttctctgagcggtgcctcagttattggcaattcactgagttttattgacagaacctagctcacatcagggtttaagtgctcaataaattaatgaatgaagggaagactaggactaaggaagcagacagatgaagtggacccaacatttactggctctataccaaagaaacattagaaacaagtatgtatgttagtatatgtagatatatttaaattaaaacctcatttatctaattactgttcctttttctttaaatgtatatttcaacagttaataaccaccaagactatattcttttagctgtgctggagaaatttcaagctaggcagcaaataagtctttgctaacagaaggaacagatctgtacttgtcttggatggcaaaacaacgatgggtttatgaaatcaatgccatttatgttttctcccaattgacattccttccattgactcatttagtttcatatattattaatatactgtattcctaaattttgcactgcattttctaagttttgtatgaatttctcataaatattttaataaatattccttgtgttttggctgtaaacctagcttgtaaaagaatgctggggtttcccttacatagtcttaaagatatgacgatttaataccttcttcagtgaggccttaagaaagcacagaagctcctcttagactcgctagatccgtcgtcctggtatcaagctgacttccctttcaatatgtgtctatatgtttccttttccattttattaaatctatcaacctattacagatccttattgctatctcactttgtttttctcctactgtgaaaggaaatacattttctttgttcttcttttgcactaatatatgctgcctctgttaaccaaacttaatgaaaacaatcacaattttctcaggtttgtttctccttactgtgtacttgagatgaaaaactcactttgctgtgtacagtacaatatctttaattggaaagaagaggaaatcgccagtgacatttctaataccttcagtcatctgcctctttcctcaggcccagcttataataaatcaattgtgaatctaaacatgaatagggaggggtgactagatttgctaatgggccccttaacaaaaatacaggtatagttcaccctgcctatcactgagttgggagtgtaacctgatttactggagcagatgaaaatgtttgaggctattccttatcctttaccaagtaatcatgtatttccaatttaattgatgggaattgaatcattggcatccttctggtattttgcaaactttgcctgaggtgggggtagtatggattatagaaggtggattttagggtcttggttctgttctctagaacacagaatgaatgtttctttagagacttgacatttccagcgtgctcactccctctccacacctctcccccattttggtccattttggggtcaggaaatcttgaaacctgtttatagtttttaaaagtatgacaagccgaaaggaatccagaaaatcctgctgcgtgtacatatccattagcatttaattaaagatgttagagtcgaattgtacaggctcctgtagcgtttgacattgtgacccaattcacaagtgttccataccattttgatttgaaaattgcagtatcaaggtaaaataagctcttaaatatcctacagctgtgtttttaaaatatatgctctctgttggaaggtatagtttgtgaactactaaaaagaacctttttttgtgtgtgagggaaaattaatcctgagctcatcatgaagaacagcttatttttttcattttcatcaaatgatagcaaaataagaggctaactgcaaagttagtgctttaaaactataaaaataagacaaatgttattgcatttactcaaaagcaatatttagtgctttcttgattctcttggtgaatgccacatccttgtaaagtatagtgctgagtcacagatacatgaaattaatttagcaaacatacttcctgccctctaggagctggcaatcaaataatttttcagatatttcattaaggaaaggacatttgttaaggcttaactccctagaagctatgtgtattttcatcttgattaaatttatatgaagtttgcattgccccattttaaataacttcaatttattcaaagctactaacaggacttgggtttttctagtattaattaaaataatgtaaaattttattaacatttaaaaatataattgccttatctttttgcagatattgttttacttacatcttgagaattgtagacaaaggccgggtgcagtggctcacgccagtaatcccagcactttgggaggccgaggcgggcggatcgcctgagattaggagttcgagaccagcctggccagcatggtgaaaccccatctctactaaaaatacaaaaattagctgggcgtggtggcgggcgcctgtaatcgcagctacttgggaggctgagacaggagaattgcttgaacccgggaggtggaggttgcagtgaggcgaggtcacaccactgcactccagcctgggcaagaaaagcgaaactgcatctcaaaaaaaaaaaaaaagaattgtagacaaaatattgggaactaacagcaggcatagcagaggctgagttgtggtgcactgagaccacagaccgtggtcacacacacacaaaacttgtgctgcatttcttatccatgatgagatgctgagctcaagttcctaacctctccaagtcctgttccgggatagtgctggagcattaaagtagcatatagtagagggaacagacttttaaacaggtaattagagggtgacagcagaagtctttccaaggtacaaaagtagtgcaaagcagggagtgactattgcagaaggcaggaaaggtagcacctaaaataattgaggaattattttaaccctggaggtgcctaacttagctgcgggtccattggctactttctattatccattaactcctccctgtcctcacacttgaacttcatggtccaatcacttcaataattatcttgtcctctgggaaacatgcagtgtttgacaaacccagtaatctgcttgttctgtccctgtacctaggtggctctacctgtgggaggaggacaattagcaggagggcttggtatgggtatattctcagcacatcacgcacagtggcactctcagccctctctatcccctactgctactctctcacccctttccttcactggctggaacttcttcactttcctcaaaaccccctcttctcagactcagagagaagatctttcctttggtttctcagagcaaatctaagtgagataataggaggaggaggcagagagtgtgacaagagagatggataagagtttgtctggaaaggggctaagggcagaagtttgggaaacactacagggatatcaaggtccaaaatatttccactgcattttttaattgggaaaattgtagtgaaagcagtttcaggaaattggaagaaggcggaaactagaatacagtagtttaaggtatgattgaaaagtgaggaaatagaaaccccaggtgcagactaccttggcaaaaagttaggataaagcctttcttagtctaatactaatgaacaagcatattttctaaacttcattccccgaatctgagcttatcagacaactttccaattaacagtctggcttcctgtatacatttagggagagaatgtgttgtttttagttgttcacatattttagttcatgtaacagcctcattttttcattataaattaataaatagcattttggctttagtaagaataaaggagattaagaaggaaagaaaggaagaaagaggggagttggttgagaaaaggaagcaagaggggagtttggctgagtagctagaagacgaaatccagaggtgaaggagggattttgtttgtttaaggatgcaagtgcaccgagcatatatattaataaggaaagagagtgaaattgaaggtgtagggaggaggggcatccatttggctggtaaacgctgagagcatttcccaggtaccaggaacagtgaagagtcctgaggatacaatattgaaaacagacagtgtactgaaaggcaaggaactgggcaggggttaggtcttgaacatgagaagggagggacccttaagcctggagggaaggagataattatgggtgtgaacctaggtaagctcacaggtgaggggcaggaacctgaggaggtttcttgtagattgattcaaatgagaaacaggtctgtcgagattgtgcctgtcaggactaagtagagggcctgaggagagtgaccttggaataagcctctgagagaaaacagagggaattaacaggttaaagaaaaataggtgttcagaatccacactaaccttggaaaccacaaaactgtagtggctctgttttcaaatttctgtcgttttatggtgctcagcagaggactgaagaaggcagatctgtggattcactcatgatgaaaggttatgagactggaatagtccagagaatcctcctggaaggagttcagcaagctaggatctcagttaggtgagaggcaagagctgaagatttgcttgagggagaaaagtgtgtgttgcgggagtaagtagtaagagaatgcccccttgttgtccctggaggcggccatgatgtgaggaagccacttgcctggtagaggttaggaggtggataacttggcacatccacttaaaagttcctagtgaattagaatgtccatgaagaattaaatctttgttgctttagatcctagcaaccagctgcccccagcagttactttttctttttttcacttgtgccccaatctttcctacctcccatctgaaagagatgaaaacaaagctactctagtattgaactgaggtggaaaacaaacagaaatgtagtattctacaatgcttgttagagagctaaatgatttaaaggaaagaaagcaatcagatcacctacattctccaaataattaacaaagctttcatcctaaactgtcttaactgtatcccgaataagttgcactttgttgatttaccctcacatcactgcccaggaaatgaggcttgaagaggttaaatgactccacagatcacacagcttatagctgacagagttagaatttgaactctgtgtctctggttctttagaccatgcttttcccaccaaaccacacaggttaccagttgtttatcatgacagtgaaggtctgcaaaatagatgcttaaattgtaaaaaagaacttccaaatggcataaaactgaaagtaaatgatacacagaagcagagtgctatctggggatttgtttagaatcaacaatcattgattgtccttaattgcttaactgtccattcttctcaggggtgagaagagacacataatgtctttctgcgattttacggttcagtttctaaaatttaaaatgtaaagagaaaggtgataaaatggaactactctaaaatacattggtgtagattagaaatttttttctgaaagaattacatactacaggagtctaatggcctttaaaattggtgttgtaaagttttgttttgttttgttttttttaatgtccaaatcgttggctacaaaactcttctcacggagagaaccccctttgtttagatgattgttttgtgtctaactagatgggtctagtaaaagacggtaaactaaatggtgagctgtattgttctactaaagaatatgtgaacaatatcatttgctttattcccaagaggagagaagatggttaaagctacgccatagaaatagggaatggctgaagaacttagctgatggtggaagggagataaaagatccaagagcacagcaaagctgggacatgaaagacagacagaggtggccttgagagtttgaccctgctgggaatgtgcaaaaatatttggaggcaggatttcaactttctacagaatgaggaatgggagttagagtgaatattattgagattataaagggcaggtgaatctaattgatatctgcattatggttgatttcacccccattttatcatttcatttatttaaaacaatacataatgcatactttacatatttctgggtcacaagtttgcacctatttgctctaaatgacataatttctattttcaaatgcagcaaccctgcctttataggtattttgtaaattagagactttgcaggttttgagtatattaagtacccatcatctgtgtgggttcctcaagtatgacagaaataatatggatactagttttaatttaatgcatggattatgtatgcttctattcaagatgctaatttagtagaaagattcttagctgtaattgtttagtattataaacatccagaaaatatggacagtctaatgtcatataaaaataggtaagtttggttttgcatttattataaatgttcctatggtattactttttttaagggctaacaatgagtgtagccctctaaatagtgactaataggaacttgcacttaatggcaggttgttctttaggtaattaaattgtaagcgtgaagttatagtctttcaagaactggagaaagtttatggaaatggtaagaaatttttataaacagctacaggattgtagcaaacttccctctgtggattgtctctatgctttgcactctagttcatctgaaacctatgaggaatgtatcatcatcactgttttgcatatgaggaagctgagcatggctgtgttaaatggcttccccaaggatatagtcatgtaggacccatgttaatgccacagcctgtcctgaaactcttcccttagactagtgtgaacctggccactgcaggtctccaagacagttgcagagaacttgagatggttttcctcaatcctgaatttgctggcagaattccaacctggagcatgctcctccaccctgcgtgtggggatcagttctttgcatcccactctgtcctggtagtgcgttagcactgcattacgacccatagacatctactcctggagtttactctatttaccaacagaggtattttttgtcgttaaaaaaaaaattagcagagccatcagacttgacccagtctgaccatgtacaatgagagcagtttttctacacactctattttatgagcactgccggcattgaccagttgttgcttttgagtagaatatgagtttgagagtcagtgatctcagtagcagagacaaaggttgcttgtttggcagtcacttgtcatctctccagtatgcactcatccatttgtcacaacattttgtggcgagttgtacagggaagcttaagaaaaatgcttttctcctgtcttgatgatagaaagcatttctcactgttggtagcatggtggtaacttttcattccttctggcagtttttaaagacttatttgactttgggggaccttgcagtatatctttaagtcacagttcaaaagtataagacagggttgctcattttcaattttggctgaaaagtctttactttcactgtggcacttcaaagttagagaaaacttggttttaaaaatggatgctgatatgagatggcatatttaatgacagatgtatctatagaaagctgttaagatgcagattatcctccctggggtgggggagggagatcaaaactgccaatctataaaatatactcgatagaggaaggcatggaatctatctttgcaagtgctttgattgcaggggacagtatagcagcatgtggcatcgtaacccagagcagacaaatcagcttgatgactttcaaagccaggaatactgctgcaggcaagggtactccagtctaggagaaattaaaacatatagagactgttattaattccatatctatttttgtatagtcaaatctgtatgcaaatccttagcatctcatttcagcagattaatctaaaagcgaagagtgttatgtgaagggaatgtaatgataaagccctgcaaatgagtaacactgctaaagaaatgtgggctgcaaactgggatgcttttttaaaatgtatcttagtattgagagaaaaatgatttttatttatatgctcatttgtaaattatttcaaaggggaaggcaagagaaccagtttccaaggtttttctttgcaatcctgacttggcaaaagttgcagcactaggtttgttaggcacctcctgtggtttaacattctagagggaatctattaatatcaaataactgggactttaatttttactcccaactagtaacttaatatctcatttctaaacattgtcatttgagtgaaaatttgtatgtaagggtaaagaatctaattactgagtgcagattaagaagaaaatgtattatagatgcatttgtggaagacagtaaataataattctgaaaagcatagagataaattgtatgccctgcttgggagaggggatgtaatagctacattctaatccattggttgtatgtttaatctataatgggcagagtctgatacatacagtagtgtaagtattttcaaatagtgtcataaaacagatagtttactacagtagatattaattatgtcccatatttctaaaacaagtagagaaacttttgaagtctttaaatgatgggtggagctttgccctcggttccatttcagttagagaagtgattgtaggcaagctggacgttaatctggtggttatggctcagatcaaaagcactagcaattattttaaccctgaagacttgtgaagtctcaagagattaaattattcttgtgtggttatgctgagaaagaattattgaacattctgtttttaatcacacaagaaagggaaggttgggagtaaaagcaaacacaaccctatatttattttgacacacatcttgactatataggcatttcagcctcagctttcttaagtgtgttttcctttcctctgatttcatttttaaaatgagatattcaatgagaaatccagagaagactttctttgagggcaggaggctcatgtctgtgttctttgtggatttctctgcagacaaagcttttgttgttctttaaaatcttaaatcttcaagcttctgagataattttaaaaatagtcctctagttaataatagccaaagccaattatatgaaagatataatctccctcctggggttgagtgagagagtaatgattggcctggataggttccttcccctttatgtatccattagttttgattgattattccagctcagttaaggattagacactaatcctctggattcttgttgacttgactcctagccatgtagttgatggtggtgacctattcaaagtatttgaactgtcaaagcaaaaactgcaccagataaggttaaacagagaaagaagactttattcaagactatagcaataggagagagagatcagaatacagtctgaaatcaattctattaagcaaagtttttaagaggatggtttttaagcactggggtgatttagtagaaaagtactgaagaacatttcagaggagcttgattaatggatgtgttgtacccatgcagttatttctgagttgacaattttggtctctgtgattaggccatctgtgtttggtgcaaattggtgtctatcacagttagggtccttgggagactgaggttgcagtgagccgaggttgcaccattgcactccagcctgggcaacaaaagcgagactctgtctcaaaaaagaaaaagttaccgtcctacattcccatagaggctgggatatagagcactatcttccttgatgattacatttcaaagggatggctctctggactttaaggaagatattattgggttataaaactggcaagcagcttttaaaatgatttacatctcaaagagggagagaaagaagttatgattacaagttttctaaagtaagtaatctaagaaaagggaggtcaaggggcctagagtcaggaagcaacctatttagtttagttaagctgggggaatgttaaggccctcttggtcagcattttaacagtgtttgttttttaaattcaaaaaattctagtaggaaactttttttagtcgggcttaattttatatctttattgaaaaattagctgcttctttgtgatactgattaaaataagaatattattcattttacaccagtgtctagaactacatgtaaggcaatatttctaaagatagatttctttggtcccatatccttgatattttattatctaacatttaatatctattggtgatattttcttactatgctgttttatgttttttttttttagagtttttccacttaatggtaaaacttaaagcaaaatgaataatttctgggttttacagggctcagtatacactacaagtatgaaaagaagtatgaggacaaataagagaaacttagctggaagtgtgatgattttttagtggttcttgattaggtgggtctcaggtctcttagatctaagcagttgtcaagagggcttcaaaagagtacaccacaatagcaattgcactgaagagccctagatttgtgctgctcagtatggtagccattagccccatgtgacttattgaatccttgaagcatggctaatctgtactgagatgcgttgtgtcaaatatacactggcttttgaagacttagtatgaaaaaaagaatatgaaatatataaaatatcttaataatttttatgttgatttcatgttgaaatgataattgtggctatactggggtatataaaatttattaaatttaatttcactgtttctttttactttttatgtggctactggaaaatttatcattgcatatgtggcttgcatatgtggctcttgttatattctattggacagcactggctttagatattttttgataagtaatatcaagagatatcaagatatcactgtgttagagtacggatgttagagctttaaaattgacaatttagtgaaggacaagaattttccatataactatgtccctggcataaactgtgtagagatttgtctatgtgtactatgttcactctcactccctaatactttgcccctcattctggccatgcagaacagcttgtcagaattggggtcctcttggtaatgtcagcatacttgttgcttgctcttaactggattgcttctgaaatgtttcttgaaaatgaaactgcttcaacaataagcttcttaattatgtcatgggctcaccatgagggtatacaaacagatcctcagcagtagctaattctcctttaattgtatctcattcttatgttggaatatcctattttttattcatgaaaagctctaacacatgttaatccattacaggtggagtaactaatacggcacaatatcagaacaggctaatggtgtatgaacctaaccaggtaagaatcatgtaagaacacctcattatcttaattaatgaattttaaaagattccagagtaattagtaattggaatgccaagtgtacacacacagatatgcatctttagcttatatagagaaaaggaagcatctgaataaactgctttttggttcctttttttgttttgttactcaaaacatttcagctcctctagttttgtgctatacagaatacatcaccctttcagagttctgcataatatagaaatgatttgaattgtcctgttgtaacgtccttctggaaggggctgccattctaggaggggatcatgcttatggtttattctaaaaaacaagtattaacttaatatagcccaaatgacctaaaacagtatctaggacaagtctaaagtagaagtatatgaagaatctgagagatgagaagtatctgaagggttttcatctaacagctgggggttgaatatgcatatggatggtgcctgtaccttcttttgtctacatttcatgtacacccaattactattttcccccaaaagaaatatttttattctcttttccatatactaaaatatggatgaaccttggcaattgcctgctgaattttgccatttctatgattttggtaatgtaaatatttttgattatgacggtattccaaaatgatttgtaggcttaatattcatcagctgaatgtaatgggatatgacacaacaggttggctttggcagtctgggttgggactggccaccaaatctatgtccctagtggactcagtgtatttggtatctttttattttagcaattacttgattctgtatttaatgaaggcatttctctctttgcaaagtgtgtttcctgatgtcattagaagctgtagatttcagagaccaaatgtccatgggtcagctgtctcaagagggatcgttaattgcagttgcttgagtttggtgcacatgtggttaaagaggaagaaggtgttaacatttctcaaatgagttctgtttcatgtttgtacacacatgctcttttaaaaaattctgctggcatattgtttacggtgggtactggcaaacatcacatctgcttgcatcttgctcagaatctcaataactctatcattcagccctggtgcttatttctcttctaggcctttgtggagagtcgataatgcctgccatctgccacagagcacattgctacctgccaacaggcaggctggggtgacctctgcttccccaccactgattagtattcacatgctagcttattaggaatgaccccaccaggcctctctgtttctttgcctttgcagcggttggtggctcacctggcaggcactgcagtgaaggaagctaaagatataatcaggggatgcaggcaggctttgcaaaccagatggcgtccatagtctggtggcaggggactggactgctaatgcaaacattgattcctaatactgtaatgggttgtttcatagaaaacacctaagaaaagcgtcctcagagttttgagttaaatacattcatgtgtaatgtattatagatattagcaaaatagctgaaaggcaggcttgactattttattaaagaagacatttgattggaaggaaattcttattatatgttcaaatgggggaacagataaatgcaagcttttcaagctgtacaaatcacttcttttcttgagtgtatctttaaaagagctagtctatatgcctattagtgagtggaccaatttttatacaaaatgtttattgttgttgtgtcttgcttcttcccttacagttttgtgaaatggtgaaattctatgtattcaaaacatcgtatgactttttttctggccgaaatccaaatttttcttggcaaaaaggaatctgggttcttcctgtatgcttagtgtttatgtagaaagaaaactgttagggttatttacctgtccattactttctttacttatctgtccattacttagttgagatttaaaattaaagtcatatttggtcttcatttaattttacaatgagagccttattttaagaaaggttgggcatactcttcccattactgagggtgaacaggaaccaaatattgaaggtttcactattccctaaagttatcatataaaaaagtcttccagcagggtgcggtggttcacacctataatcccagcactttgggaggccgaggtgggtggatcacctgaggtcaggagtttgtgaccagcctggccaacatggtgaaaccccgtcttcactaaaaatacaaaaatcagccaggtttggtggcacttgcctgtaatcccagctactcgggaggatgaggcagaagaatcgacttgaacctgggaggcggaggttgcagtgagccgagatcatgtcactgcactccagcctgggcaacagagcaagactctgtctcaaatacaaaacaaaacaaaacaaaacaaaacttagtcttccaccaaaacaaataaatgtgtgcctagaaataacctttcccaatttggcaaaagatgtgactgttaatatattaaaggaggctgataaaaggaaatgtgggtggtttgttgctgaaccaaatcttagctcttccactgatctcaggaggttaattttggaaagaacagcaaaaccattaccctagcttatctagcggcctgaggtacccaatgattatcatcacatcattttgaaaaaatgaatatgtattgaacatttttcatgtgcatttttctaagtgctttatgtgtattagctcatttaatcttcacaataggcttatcaggtaggcattattatccccattttacagatgagaaaactggcacagagatattaagtaaattgctcaagatcacatacaagttataaacccaggtagtctggatccagaaactattttcttaatcattgcaccactgtatatagtatacctagccatgtgctttcactcttaatgaatttgcatgagtaaattctctgaattgggtgagataaacatcatgaaaatttcaatgttcccctgatgtaattcaaaatgcactataaaatgcaacacaaactagaggagatgccgtgtgtaaatcgcaaaaacaattggaatatgtggctcttttgtacttgttctcatgtaagaagcccatacctttcaatatatataaacaacattcaaacagaatgttgatctattgattgataaacattagggttctcactacttatgaggcactcgttgctgttttctgacatggaggtctcctactaacagaatacacttaaatttcttttttcagaataagtggataagccgtagccccatgctgcagagaagggtctaccattccatggctgctgtacaaaggaagctttatgttcttggaggcaatgacctagactacaataatgaccggatccttgtgcgccatatagattcttacaacatagacactgaccagtggacacgttgtaatttcaacctgctgactggcaagtacctttgattaagtaaatcaggaaaagtagattcaagaagtcaccaaacttgtttcatagacatctttagggcatcactaaatattaagtgcatagttgtagaagaacctgcatttattaaccagaaaggtgtgtatcatttatgttctaacagaactggactcatttaggtagctgagcatctagtttctcagggcctatattactaccattatgcacatcctcatatggctgagaggcatgtcaagtccattatcatccatcagtgttaagatggaactctgatacaagtaggaggaaccagacactgaaggatttaataactctttacagaaggaatttattgtttacttctcactgcttttagtcttatttcttgtgagttcaggagtttaggagcatggtcttcattatttgtcactgtcaagtattgtttctgtgagtattctcctagaaatgaaacccttaagtggttctgtacacaggagtttagctgcatttttggccacaaatacccatccaagcatttaccacagagcaacattaggtatggaccttcctcatcccaaaaaaggatgaaagtaacacggtgaacaacttacccctcatgtttctttatggagtgaataacttttcccccttgtcagcttgcattgttaacatctacaagtgatcagatcccttccatgtctgctcaaataataggaaaaatcacaaactgaaaatggtaggttgggttaagacattttaatatgctgagtgggcactcaatcccttgcagctgctgctgggggaggcaacgctgggaatctaatcagaggtttagatgcttgtattgagctcctgtttttgcaaaatgatttttgaggcccactggacaaggacttagaaactctctgagttttagcggtaccttaggccctcgattctggatctgtgattctgcctgctgtaagatccagcttatttattaccccagtcaatcctgtgtcagcccatcaataaaaagagactctttcactctgtgatggcctccagggaagaatatgtggtagtgagttattctgtcttctttttgaaatgggaggggaaacctttcatcattttggcgtgtcagcatctagggattatccaggctggtcccagctcaggaactttaatataatctttaaaatgttgggtatgtaaagaaaggtagggtagcaagttgatcaatctcttctgccatttgtcttcatttggggcatgctaggggcatggctctgctttattggcttcttggggttgcagctgttactttacaaatgtaagcacttgtctaaaaagcatttgcgggtatagaagaggtgtttgcatttctataatataccttatttccaccactgtaaattaatggcatgtgacatagcatagaattcagttctacatggcttactattgctgtatttaatgctgtacttactaacttggctggctaataagtgttttggcctggttctgacctgacagattcattctctgagaaatagtgcttaatttttctgagtactgggaggcagtgattagttgctgcaaaaatcccatggagtatacaaatgtgccacaaaggaaaattgtatccctcagtggcaaaagggttaattaaaatatgtaagaaatggattttttttctttttattcaattctctttactttaggccaaaatgaatctggagttgctgtccataatgggagaatatatttagttggtggatattcaatttggacaaatgagcctctggcttgtatccaggtgagtggtagaagttccttttgaagtttgttcaagtggttcagcgaggttacattttgcaatgctgctactgaagaaagagatatttatgtttagaaagaggcttaacgtcccgttttttgtgcaactagttcagccactaaacttcatcctgtatcctaaaaatgatgcctaaataaattattgagccctattaaaaataaaaatgaggatgaattttgaaaaatatatgtaatatatattggaaactgggaaactgggatagcgttccctttctcataaaccaaaaaattctaaaaatctttggcaatagttccttcatatcccccaagctttacaaatacttcctttccacaccattgccttattttctatattacagttcattcattcccacaaatgccacctacaagggtgttcttccttcacggcagaggctgtgagcagtagtggtttatgactggtctgatagggacagcctctgtcccaaagaatagccctggtgcatcagcatatgagcagcccaggctgggcaagttgccagctgggcctttcagaagagcaatagccctcattgatagacacattcatagtattattcctattattattttacagttattaccatagttttctcttttacatgttctctgataaaatattgacatgtattagccctgacctttcttcctgacctccagaaaagtatatccttataactacttttattatctaatcgcatctttatgggaagatttttaacaactgcatcaatatctttaatagttgcagaactgttcaacctttttatttctttttcagtcacatctcataaagtacatatattttgaagaaaattccatgttgtctaagttttcaaaattgctagcatatagttgttgtgttatccttagttatatctccctttacattcataatattgtctcttcttctcttgatttgtcttgacagaggtttgtctggggaatttaaagtacttctattattcatatagatgaagttaaaaaagtcagcaagggtaaggtagatatggaaaatataattaacaagcttgtctgaatggatatgggttctgactgagcagttggaaagactgtatttttcttagcatacatggaacatttacaaaaaccagtcatgtactagggttagggttaagaaaactttagttaaaaaaattaagtattgtttagtattatgtatctctaatacaatgcaattaagttagaacttaacaaaaaaaaacccctacataactggaaataataaaacacattgctatataacttatgggttaaagaagaaatcataatggaactcaaaaaaattcccagaactgtgataataaaaacaatatacagcaaagcttgtgagatatagcttcataagttagaaaatgaaccaaaaagtaatctcaaagaaagtagaagaggagagatgataaagatgagagaaaattaataaactgggaaacaataatacaggagaaaagaattatcaaagccacacacacatgaagagccacataagactttaagggagttcactgaaggctgccttgtactggttttagttagttaatggaaagctgccttggactagagcttcgtcctgtctttcggataacaacaaatgaacaaacttttctctcaaagagtgcttctagtcttcatccaagcatgtatttggtagtccttcatagtcttttaggtttctttttattttttgcttttcagaattggtagaactcagaactgggcaacagttctctatagtgctggaacactgttttttaaatggctttgggacccttcatttgatcacttgcacaatggaagtaagtttgggtttatcatgaaataaaattgtaaattttaaatacatttatgagcatatttctactagttttagtatcagattagctcaaggaatagaaaattagtggaaatcataacataatgaggaaataaagaaaatgctgtacgtatcaagtttaggagatcagagtgctgccatagtgcacattttttccacatctcatattttgttaacagtcgtgaatgttagtttgtaagacatagaaacttaaataaaaaaaacttcgtagtcgcatcatttgttttttgtcaccaaagaatttttctgtaaatgatcactaatcatatacactaattaattgctaatgacatttggctgttttcaaacaaatctatccacaagaaatgaagaggtaaacaaatgcatattttaaaccactgaggatatttgagagtatcctcaggattatggtgattatcaaaggggattcaattatttttttaagtcaacacctgtattagtggaataagtttcacctctgagattgtacaataatatattctaatatatttgcttttaaataaaagtcagcatgatgggtatttctgtgttccagtagccattctgatgaacagaatcaatcctttggcaaatactgcgtttattcctttggctggcacactggtcctacaaagcacagacaaatttgttaatttttttttttttttttttttttcctgagagtgtcttgctctgtcacccaggctggagtgcagtggcgtgatcttggctcactgcaacttctgcctcctgggttcaagtcattctcctgcctcagcctcctgagtaactgggatttcaggcatgtgccaccatgcccagctaattttttgtattttttagtagacacggggtttcaccatgctggccaggctggtctcaaactcctgaactgcccacctcggcctcccaaagtgctgggattacaggcgtgagccactgcatctggacgatttgttattaagagcctttactattaataggtaataagtatccctataagcatatggattatcacttaaagagatgtttgaaatagaggtattcatggatagtgacatgtatctttcattttagttaatgacagctagttacaggctatattaccattcattctgaactaaagctccatttttttatgttatggatgacgatagaacaattggtttcaatacactaacagtaataaattaaattgatggttggagagaatagctacatgttcaaaagtaggccacttctttactacttaaagaacatccaacagaggcaagatgatgggagactggaataatatttatgagaaaatgcttaacagtggaaattcctaagtatgtcagtgggttgagaagtacagaagcatagtggggaaaaaatcatatgcatactaaaaatataaaggtttaaattttttgtgtcgtcagtcacaaatctgtatatttgatccaagattaatccacaaatcattaatccaagagcatggctgattaatggaagtcatacttaaatagttctgagattgttctattaacatttggaagtactaatttttttttgccctcaaaagtaccagccaataacttctcacttaactgtcccttctggaccctaatccaagctcatttaactgtgatttgtaggattcaaccacagtgggatgaagcatgtccaatgttgaaaaagcatactttatttcctgctactactctgatttagcacagactatttatccatcagaaggacaacccaaacaagagaaaagcagagatactcttaggttgagatttggacttgttagtaataaacaaacactcatggaaaataatggaaatagattactgacgaaagtgaaggtgttcttgtttatttagtgggtgtgtaaactaatgtctgtcacagaggtttgactctaatcttgtgtgccatggatgacaagtggcacataaaggagcagctgcgtaagtgtgcaagtgattagtctgtgtttctagatcacctctactgttatcttcatttactattattttttttggctggaggatacagtgccagcttggcaccacactctcccaaacgccttctttcagccagtttacaggggagtgttttggagaaaaactgccaatgcttccttttcccttctcagattaaatacattacatctgcttaacatatgcagtctctgttggcccaggaaaccagacaaaagctctctggatgattatctcattagtattttgccttctaaaaatgttttcagtcaggagggagggcacaaaatccttgctctttctgggttgcgtcttgagctcaaatactggctccaccacttgccgtgtgaccctgagaaagtcacttaattttttccggtatcaattttcttctctgtaaattgaagacaatacttaaccttatagagttgtggtaaatactaaatgacctctgatttactttttgtatttaatgaaatactagccaaaaccccaccggggttttcccttttctcatggggcgaagtagtgatacttgtcaaactaatcttgaaagattctctaggaaagtaaatgagtaagaataatcaagaaaattttgaaaataaatgaggagtcttgccttacctagtcaaaacaactgtaaatgtgacactgaaagaaaatacatcaattaacaagagaacagagaaaacgtttgtatttagtatatgagtgagttattttaaattagtagtgacagggtatattgttcaataaagagattgggacatctaatctccacttgtttgttctttcttttattctaggacttcttagtaatttcctcctttgtgaaacatggatccccaaatttcaagggcccatttcctgtaaaataatgcgttgttgaagttaaagtctttttttttcccccagacggagtatcactctgtcgcccaggctggagtgcagtggcgcgatcttggctcactgcaagctctgcctcctgggttcaagccattctcctgcctcagcctcccgagtagctgggactacaggcagccgccaccacgcctggctaattttttgtatttttagtagagacagggtttcaccatgttagccaggatggtctcgatctcctgggctcgtgatccacctgcctgactcccgaagtcctgagattacaggcatcagccaccgcgcccagcctattgcagttaaagtcttaagatttatccacacaggtgatagatgaaggcatgagagtggactagatcattaaagacgcgtacaaagaggtctgtgattgaaatattgggaaacacctacgtccaggatgcagatgaaggaaaagggactcaaggtggattgcaatatgataatgtcaatgacaaactttcatttttttaaaacaccaaatccacgggaggcaaatgtttaaatagttagagaaaagtcaaatgaaaagggatcaagatgataactgcagacttgaaagagcctaataggtttgacaaatggggcgagagcagctctcctgaagaaagaattttcctgcttcaaagattcagccaggttcagttaggagacagcaggcactgactaacagaggctgtgctatataagaagagagaggccaggcacagtggcttacacttataatcccagcacttcgggaggctgaggtggaaggattgcttgagcccaggagtttgagagcaggctgcacaacatggcgagagcccatcactacagaaaatttacagattagctaggcgtggtggtgtgcacctgtggtcctggccactcaggagggtgaggcaggaggattgcttgagcccaagagatcaaggctacagtgagcaccactgcactccagcctaggtgacagagcaagaccctgtctcaaaacaaaaacaaaaacaaaaacaacaaaaaaaccccaaaaacaaacaaaacaaacaaaaaaactccagcatgaacaggaaagaactggggaaaaccttccagaatcgactgaattttgaatttgctactaagctgtgttatattccactacctgccagacactgagctagatgtcatcaattttcacaacaaagctgcaaggtcttgttttcttcatttcacagatgaggatgtttaagccaacattatgtcagactgcctactaactagtttgggcaagttatttaacttgtctaaggcagttttcttaaatgaagtaatgctacctacctcataattgttctgaagattaaatgcttataaatatacatgtatgtatatatgtacatccaaaaacatactaacatagtgtagcatttagtaggagcttaataaatatttctagtaccatccaagcaagaaaaagaattcctaagatatggtgatggtgacataactgaatttaagttcagaatttcttttatgtatacatagctttattttgagcagtcatctttgatacacaagcttcttctcttcctcttttgtaggtactggatgtaagcagagaaggcaaagaagaagtattctatgggcctacactcccttttgcttccaatggaatagcagcatgcttccttccagctccatattttacatgccctaaccttcaaactcttcaagtgcctcatcacaggattggcaccatctgaaaagccaagccatcatgaacaggaggaaaacatagctctgactgttggatactgggcatgaaaagactcagtgctccatgcttccttgtcttgctttataggtcttatattcggataaatttaagcaaaaaatgaacaattttctaaaatacgttattgaaaactcgtcacccttctcagtgtatgtcaacattcaatatgtatgacttttattgtggtatagcttagtgccaatttaaggtatattgtgttccatgggtctttagagcattctttgtacactttttctaatcagcactgtcttaagacaacataacactgttagtaaggcaatttattggacacaatggcatcgatgatcttaaaaatatatatattctgtacttaatccctttattatttaaagccgggcttgtaatttttctttttaaaatttaacattatgcagccctgctcagtagagactcactcagcattatgacatcataaatttttaaatgccatattttattcaaggtgatacgaataataatagacatacactggaacagcagttgttgaaatacccagatttttcaccttggttactctgaccttgggtcagaacctaactttacagtgcttcagttttcccaccttttaaggaggataattactgatttccacgttaatttaaaagaacattatgaggattaggcgaacactttgtaatactttgcccaagaaaaagaaaaatgttgttactgaaattataaggtattttattgtctttagaaccttgtaattgaacagggagattatttttgaagtttaaaaattactagatagaatttggaaacatgttgtggaataaatgattctaaaaagcatgtgaaagagacacacaatgaggaaatagggagtttctcaaaatctaaacttgtacaggtatctaaacttgcctcaagtaactctcagatgtcttatttaaaatcatttagtgaaaaatgacatttaaagctaaaaaataatttagttgtactaattatggtaccataaagtgctttgacataaatttgaacctagaattggcagttctaataaaagtttttccactttgttaaaggttatgtcaatcttgagtgcttgtggaattcttcaccaccaatacatattttattactatctcttttaataatgcataggaattcttttttagactagtttttgggtttgctttgtctataacaaaaaataaatacaacaacttaataatcacatttgaaaacaaatttaacaagtataatgtgagtttttcttttttcctaacttcctcaggacctaggtcacctttattaaaaggaagaattcactcttttttccttggcagtttaatcattcaggaatccctctcttaaaggaaattgttattttattcatgtaacctttttttgtaatcaaaagtgaataaaaacgatctttttgtcttacag

SEQ ID NO: 103 - DNA, 12192 bp, Homo sapiens
gtcatttccggggtcggggtatataagcggggcgcgagggcgctgctgctgccaccgctcctgccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaaggtgagcgagcgcggggagctcgcgggagagggttccgggcgcccctgcccaccttgaggtccgggcaccgcgcggcgccccgcacccctccacacttcccttcgggcgcggcgagttttcagcaccgcggacagcgcctccgcctcccgcctgaccctgcagtgtggcctccgcctgggacccacaagacacttgggcctgactcccaaccccccggggcaactcccccttgtgcccaccccttgtctgggcttggcgcctcggttgcatcagggccagtgccggttgcgcggtggccggccaaggtcactgcggggaggtgggagcatggctgctcgcaaccctccacccctcttcccctttcatctcacgctccccgcctttctgcccttgacttctacttctccatatcatccctcacaatccccttcctccatctcttcccccgccccccccacctctggggtctctctccccttcgtctgtctcccacccgtcccactgtgcagctcttggccttgtttgatggcgctccccgctccaaagcacacccgctccagagcaagagtttccaaagggggagggggaggacctctcagtgcagcctctggggaccaccccactgtgggcagcaaccagggaagggaaacaaaatcagccctagcctctctttttggtgggggcagttttgaggggtggcattgggtgaacgggccccagtgagcccggtcagaaaggactggcctccacttggagcagaggagtgaccccagcactctcttcttcttcccagtcactgcgctccctgtgaacagccctatgaataaaggggataccgaggtaagaaggggtgctggggatgaggggtaggaggctccagtggacacttcacagccagttcttgggcagctgcaggagtaagttcggcataaagccaagagccagcactgcggctgctgagcctggggacagcttgcaaaagaagatatcaaagattgcttgctttccctgctgtcctgctgtggggacttccccagcttcctctgagctgcacatgcagcggaagaggcctgcatcttacctgctgggccgaggtgcctggcttcaggctgtcttgaacactctgaatccagtaggctccccaggggctggtgggggtggcttctctgtagttgtagttgtccacagacctgtaaaaatggcctttgcctgcctggctctggcctccccgctttgctctttctccctgaaaggctctgccagtaacaacccacacccagcaggctctccagccctggctgtcccaaaggaacacaagcaaaacatcttgatcatggctcctgcacccacggtcccaccaataggggctagttgtggaggtcacccaggaaagggccttaggagacactagtaggggtttctctggcagcaagagacacaccacgctgggtgtgtacttggaattcattcatggctgagctggggctgttttttccaggctctagtgctcatccaaatctctgacttgagggtcagagaaatttctactccccaccttcccagaaactattctcttccactagacaccacagttaaaatccaaaccatccaagagattccaacctctgtttgctcaattatatttcctatgttttagttgcagataggacagaatttaaacctctaccactcattctagctgtgtgaccttgggaaaattccttaatttctctgagctccgcctttttctccttttccttgaggggaggtgtaaagagtaggaatcatggatgtgaattgcctagcacataataggtcctcagtaaatgggcacttttattcctagagctgccttcttgatctccccatccctctccagaccctctacccaattcctgcctcccagaaaatgccctctcgaacaggtggttatctgatattcccaatgcaaggtccggggttgcagggagatacagggtacaggctgctgtgctctccttgctagatcccttatgggagacaccctggtcaccatattatacccagcagcctgtggtcaggggcaccagagcagctggctaagacctgaagattctatacgaggttgttgtgactacatgcattatacagcacttgccagtttgccatcttggatccttggaccggttgccttggcatcccgtagacacagcctcccaccccctcactccctgccggtgttgcctgatgcctgtctgacacctcctgctctctactcagctctaggctgtggaagcagggctggagttgtgaacccctccctgggcgtgctgacactccatgcttgaaagagtgtttttccatctgtacctcattaccctgggagagcagttgggaaggtattctcactcccgttttacaaatgaggacactgaggctcagagaggttaagtcacttctccaagatcacacagctaggataccacattacggtgggcaccatcatcaaagatcactcatttatcagatgcctaattatccacagcacctttgcaggcacaggataagactttcagaggcgtggctgtggttgacctgggatatgctcccaggtgtagtcaatgtgtgctcacatgccgcccagggattcacccatcccatgatgaacatggagtgagaatatgaagctgtgactccttgcatacgacaacaccatgggtgtttggagacagtaacctacatcctatttccaaacagggtagagccagggaaggtctttgtctcctctgggcagtccagaaggacttcctggaggacctgacctttgggcatcttcacgatcagagcacttttgtaagacatcattttagtgccctgaggcagttttctcatgtttagagaaatagcacttggggatgagaaggtaccaggtaccattccctacaccccattctcactatgatccaccttggaggggaacctgctggccatgtggttggagtggctgacacatggtaagcactgtgttaagggttttctattatcattgctatcactgtctggctaagaaagcagagctgtgtccctgagccagggatcatggactcccaaagacaaaagcaaataccctctgtcctcactagaaattcaccctagagcctccagggactgagccccatgctcaaaccagccccaacctgcccctgcactgtgttcccaggtgatgaaatgcatcgttgaggtcatctccgacacactttccaagcccagccccatgcctgtcagccaggaatgttttgagacactccgaggaggtatgagctggaggctaggggtgagggctgctgcctgctgggctgggaggctaggacatgggtgtgtggcttttggtggaattaatgatttaactcaacagtcactgactgagtgcccgtcatgtccaggcactgcaccagggtccaaggtgtacagacagttgaaggggttgtagcccaggtgcttacagactggcagaggggatgcatatgaacacagttaactagaactctgggcaaaataaaaccagggctgaaacagcaagcccccagactgtgagctccctatggacaaagattttgtgtgctgtatcccagtgcctagaacagcctctggcctctgcagacaccctctagatgtgtgatgaataaaggaatgttatgggtggacaggagaaggacgaaatctttccaggcaaccagtcaagtttttactaactgctggatagagccagcagcatttcggttgggctttaaaagaaacattggaaaccgatgagtggaaaaatgaagacagggttgtccaggtgtggtagacagtgtgaacacaggcatggagatgggaacctgttgtatttaaagagaccccactcatcctcaggggttgccaccctttggctaaggtctggctgctggggcagtggctgacttctctgatgtagtaggaaactgacacataccttggaaaggaggtaatttcaaaagtgttatctgaagacccaatcttgctgccaccaccctggttttgagtttccagagtaaattccttgtgctcagctgaaaatattgatggtaatctctttctcggctgttctctggaaaccacccatgatgactcttcttcattgcagatgaacggatcctttccattctgagacatcagaatttactgaaggagctccaagacctcgctctccaaggtattttccagccactgcacttgactctgggtaaattccagtaactgagagtcagaaaatctggtggaagattcagcaagttcctctctgggactgtcatttccttttaattataaagcggaaaagcaggatccgccgtgccacctggctcaatctgttattgatattgttaaagaaatcaaggcccagagaggttgagtgacttgtccaaggtcacacagtgaatagagacatgccaggtgcagcttccctaaaacccacggcctctgcagttcagtcattttaggaaatacctttatgaagtagtgagccactcgtcactgatgatattcaagccaagcctggacaggatactggagtggagggttaagctgccatcttcccacagttagcctctatgcccagccccccagctccttccaggcttgatgcaaagcacggccctagccttgcaagtcaggaaacctgagtttggccctgcacctgccccggctgacttcctgtgggaagcggccgtttccaccagggcaggaccactggtggtggtgtgtctctccatgagaacagggcattacagcatgaatccagcatctgcttcccaacgaagcgagagtgtttttcagggctgggcttgtgtctggggtggggtgggggtacgaaggctgctctggcttcaggatgggccccactctgaggcctttgggacagaccaggccatgtgtgagaacagagagggctttggggaggaggcacgtaaacacagccacgtcagtaggattcctgtggccctttccaagctaacacactgttcttcctcccactcatgagccagcctgggcagcaagcacccacctcctactgttgttggagggggcagggagtgctgggcacagctgggactattattacctggatagttatgtcatcatcagtgaccttggactagtgttttgttttgtttttaactaagcattaaatattttattacaattgataactttaaaattaaatattgaatgactaactgattacatttaaataattaaatagactgtcaacagagactattataggagaatgtgtcctgaaacatctctattcacatgcacgtgtgtatcccgtataagcagtatccaatatatgtatatatgactattttccattaacagattcctggatgtatttctgtccatccgtctatccgtccactccctcttgggctcccataacatcttctgtgtgcctctgtcttagcatttaccacacagcaaccctattttctagacaagcacccaactcttggagagcccaagttgcccatggagctaggaaatagccagaaggggactggaacccacgttgcctgagaccagggctgggcatgctccctggcccacagctgcccaggaaagcccattgttggggaagaaatgagctgggctaactgaggggccaacatcaggaataaggcacaggtgtggggacagtcagaggaggcagcggcggcggggggagaggggtctctgggtcatggctgcaggcgccaaccctgggctcagatgtaggcacagggcttggccttctccccgggcctggactcagcgtccaaggttagcagagcttgcctgaatcaagagctgtcaccattactgcctgctgcagggttcctggagctaccagccaggtcctgaggggttccccacccccaactcctgcccagccaggtcctgaggggttccccacccccaactcctgcccagccaggtcctgaggggttccccacccccaactcctgcccctgggatccttgctccatttgagcctttcttgctgtgtggccacagcacgcttgctctggcctcccagggagaagctgagtctggcgaggcagggtggctgcctgagggcccagctgagagaggtgagggacgccaacccttcaccgctccccaagctcacgccccatcagtgtctcattgggcaggccctgaacatgatgtgcccagcttacagatggggaaatggaggtcttcactcttatagacaaatatgccacagctgcacccaatgggacttttccctccttttctcataccaggcgccaaggagagggcacatcagcagaagaaacacagcggttttgaagatgaactctcagaggttcttgagaaccagagcagccaggccgagctgaaaggtctgtcccagccggtctggccggaggtggggaagggagggtggcagtgggaacagtggctatgatggacccagggttccagtgagtcgggagccccacccataatcccttatttccctctctctacaaatggggaaactgctgctcagagagactaggtcccttgcccaaggtgagtggcatgaccaggggtttcgatctggtcctgcctcacaccaaagccctcgctcggtcccgtctgcccagaagaggggctggcactctagggcaggagatctctggcatggcaggtggacagcttcaactctgggtctacccagtggccactgtagcagagcccccacccccagtgcctgtcctcctgggaagtggtggggcctcagaatagccaggatgcaggaggaccacagacagagtaggtgtgaaacgtgaaatgaacccagatcatctttcttgaaaccaaagagcttctaggagtctaagaggtcatgccttaggtcagtgcgacactctgagccatcctcccttcccggggagagccacaaactggccccgtggcgcttctgctctccatgtagaagatgggccggtaaggccggtgtccaggagctggatcctggtgtctcccatctggggctgaaagggaaagcccgcaagtgaagcccaggtgcccccactttggttgaagctttaatgaggcaggcagccatgtgtcagtgcaaagagatcccgagcttgtcatttggaggcttgggttccaggctcagctctgctgcccgcaaactgtgagatggacaggtcatcttacctttctgcagatcattttgggtttctgtgaaataggcataggagcacctttcaccagagtcctggtgaagctcagatggtggaatgtacttgggagcactttgttcagtggttatcattctaatgacgggaggaattttcacttgttcaaaggctgtctttaaggcagccacaataaaataccttttaatgaaaccctaaaatattgcagaattgagccctttcacaggatgctgaagacagagaagccccacatggaggggagaatgaagttgcagtcatggtgcctcttacacagagaggttaagcaacttgcccaagatcacacagctgacattaattttcagttcaggctttatctcctggattaatcttaaggtctggttttttgtttttgttctttgaataataacctgttttaaaagtcaggattaaaaagaaagaaacaaatccagctgtgctcagatcaagcctggacatggacagaggggtaaccctaatcgttgtcctgggctgggctcgctggaagccaagaaacataatgagtaacatctgaaattagcctgtggggaggccccacacgtggcccagtcctcagggcctgacttggctgtgctgtgtctgcagaggcggtggaagagccatcatccaaggatgttatggagaaaagagaggattccaaggaggcagagaaaagtggtgaagccacagacggagccaggccccaggccctcccggagcccatgcaggagtccaaggctgaggggaacaatcaggcccctggggaggaagaggaggaggaggaggaggccaccaacacccaccctccagccagcctccccagccagaaatacccaggcccacaggccgagggggacagtgagggcctctctcagggtctggtggacagagagaagggcctgagtgcagagccagggtggcaggcaaagagagaagaggaggaggaggaggaggaggaggctgaggctggagaggaggctgtccccgaggaagaaggccccactgtagtgctgaacccccacccgagccttggctacaaggagatccggaaaggcgagagtacgtatgatggcgaagacctcaacgaacgtgtctgggagagggggatgggtgggaggagagccttctccataacctcattccaccttcataacaaccctgaaaggtaggtattagctccatttcccaggtggacaaatgaggctcagagaggttaagtaatttgcccaaggtcacacagctaatttgtagcaaaagctgaggttctaccccagatttatctgactccaaaaccatgcatttcccactattccacatagcctccccccaccaaccccagaagctaggggtgggtgatgggtgggctggctttgggaacagagaccatggcaggagcgcacaggctgatctgggaacagtgtcagcttcaactacggtttaggagaggccctggctcccgctgcgggcctgtcagggtctttcctcactctccagctgccgggcttctggggtgaggatgaggggaagaggcaggctccagctaacccacccctctgagccgagagggtcttgcaaagcctggcatcaagaaggtttttcccgctaagcgtcatcactgtggagaggctgggctgtggccgcagcagaggcccccagggagtggcagagactgggaaaatggtggtcccccacccattctcctgctcttgcccaccacctgctccaggtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagctgcgacgaggctggaggccatcctcccgggaggacagccttgaggcgggcctgcccctccaggtccgaggctaccccgaggagaagaaagaggaggagggcagcgcaaaccgcagaccagaggttggtatggggcgggagccagctctgtgccaggccacggagcagcagggggcagccgcacccagacacactgcccctgccccactgaggggacagggcccccccgccgaagtctggggatggagagatgctcagaccgggggctctcagggtgggagaacaccccagctcacagggggcacccagcaaagctggctgggagatgggaggagctcaggtcagcctgtggcagcgggggaggcgctgagtggggacgttgtccagaaggcagtagggtgccctggaaaaaccatgcggtgggtctgaccgtgtcccctcctggcccccaggcagcccaggcacagcctcctcccaggctcaggccctgcctctggcccatgagggtaacggggcagggcaggggcagggccaagggatctcttgcctgtggggagtgggtgggagccacaccggatgtgagctggaagacctgggctctgcctcctcttggctgcgtggacttgggagggtcactcccctccccgagcctcatcagttccatttatgaagtaggggtaaggagtctcctctgcccacgtcattaccatgattggaacacacaaaggctttgaaaaccagggcccctggggaagacaaatggggcgtggggacacagcccacaggagcaggggggagttggggtccctggcagctaggcggctgggatacctggttcaagcctagtgtccaggtaggaacccaggctctgtgggaaggctgacacctgtccgcagccctgaccccaaggctcttctctgcccacctagaagagggtgtggccccttcactgggcccccgaccccctctctgggcctggcagtctgagaggaagaaggctccatgttggcagctgtagcgggagagggcatctgcccacgtgcctgggagcccagggcgaggggctgaggacaaagctggagagaatgggggcccagaggtgccaccagcttcctttctccacaagcagagggagctctggaccgcagggcagagaaactggacccctgaggcatatggagaggatggggtgggggcctcctcaacacagcccaagggtcttcttagaaacccgagcctcgcagagcacctgccccagggcctcctccaagactaaggggctgtagagtctatttccacggcctgcaatgtcggggtccctgggccaggatgccctcggcagcctcaaatctggcagtgaccccgggaaaatgacccctcccaggtcaaaggaggcagccttccctgcgctcctgctctaagtcttgaggttgtgctcttgtgggtgtccaagttctgaggcctgaaagcttctgcagacgggcatagaacagggctcagaggaggggtccctgcttccctaaacttgggtagccagagttcgggatcctctcacaatcaggaccagggatcaaagcccagccctaggcaggctgatgtggggcagctcccccagcatgtagccctgtctcaggccccacattcccctcaggtgggaaggctgcagaagacagacccggaagtcccaggctggcctcaccctgggtcctggcaaccatgggctaggccgagggaagggggctcttcagggcactgtaagctttgttttccatgtgccctaaaagaacagactcccacctgtgcggaaccatttgagaggaagtggggcctggataagaggccaccaagagcagtgtggggacagggcccccggcatcagccaccttcttgtgcataatgatcccgagagcagtacagtaagctcattatcactgtctccatgatggatgagggtacagagagacaaagccacctgtccgaggccacacagctaacccagcgcctttctggcttactgtgccttccatgccactggccaggctggcccgagtgaaccccaatgtctctcctaggaccaggagctggagagcctgtcggccattgaagcagagctggagaaagtggcccaccagctgcaggcactacggcggggctgagacaccggctggcagggctggccccagggcaccctgtggccctggctctgctgtccccttggcaggtcctggccagatggcccggatgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctctttcctctg

SEQ ID NO: 104 - DNA, 83544 bp, Homo sapiens
ctccttggcggtgcctggagcccgggcgcaccccaccgctcccgggacctgttgggggctggcccgaaccgtcgtcgaagggagccgctcggccacccccgacgttcctcgccccgcccgacgttccctcaagtggccgaaccagccggacgagccaaactcgccgggcctcccggcggcagcaggtggccccgtccttccagggagggccctgcgccccgcggcgctccggagccctctcggccgcccccgccaggcgggatggaggcggatggggacggagaggagctggcccggctgcgctcagtcttcgccgcctgcgacgcgaaccgctcggggcgcctggagcgcgaggagttccgggcactgtgcacggagctgcgggtgcggccggccgacgccgaggcagtattccagcggctggacgccgaccgtgacggcgccatcaccttccaggagttcgcgcgtggcttcctcgggtccctccgcggggggcggcgccgggactggggtcctctggatcccgcgcccgccgtgtctgaggcggggccggagacacacgacagcgaggaggacgaaggcgacgaggacgcggcggcggcgctggccacctcgtgcggcccggcgagtcccggccgggcttggcaggatttccaggcgcgacttggggacgaagccaagttcattcccaggtgcgagtgtgagctgggggcgggaggttattctggcgcttcctgcttgcttcttcccacttacttgcaggtgtgcagacccaatggcccccccccctagtcttctctgtgagttgcttgtcttccttcacctactcgctttgacttttccaagatccgctagagttaagaaaaaggagtcagagagtcagcgtttggggagaaagttttacgtgctgaatcctgagcctgcaaagggcggcgtgttcattacaggagctctcctgaaatctgcagctgctggcgccccgcgcgagtttaggcgcgcgcgccacatctcaccgcgtcctggttacgtcaccttctaccccaggccttaggctctcaccccagggctggggcccgggctgtttgccaatttggcgtcctctgtaatagttttctgatttgtcgttttcctaagactatagaaaaggaaactttgttgggcttttacattgctggacacaaatattgattgatgtacctgctaggcattttacagagttcacgcatttaattttcataacatccctagaaggtaggctagcttatttctgaacttagacctagaaattagacagacgttaagggacttgcccagttaaacagcagagatttgacccaaattttgtgaactgaaaaactcactttttatgtgacggaataaaatgataaaatgacacagtatattctctgctcttactgctctgacagaaataacgtgtcaagtcacggacttaattatcaggaggtaaggggatgcctgcaggtgggatttcagggcctggagggagagaggctcagattttctttttgagtttcgtttgcatttgtccatgccttggtgtggtgggtgtctccagctgctatttttcacttcatgccccagcgatacacacatttcagtgctgttaagtgtttttctgctttatgtttggattttagctgaaattttgctgagctctggctgtcgttattaagacgctctgaaaggcatcattttggttggcagtttgcacatctgagacagaacattgaaaaggaagtatccctggaaggttgtcagtgtgcttgttcattggaagccctcacttccttctcctcccaacttctccctccagcttggaaagtaaggggaatattgggcatggagagtgactcactgccatagaagggttgtgtagagaaagtgggtgtgtaacgatcttttctgttatttacaaatgagttactccccaaccagggaagtagcaaaatttaaacactgctacaacctatactctttatttgagtcatctttcatctgtaacttagtttgggtgcagctagttaaaaaaagtaagaattttaggaatgaggcagggtgagtccacatcatattggatatgatgtatgcatacatgtggatctgtttttcacagttgtctagtctcagcaacaaatatttcacacacaaccttaaatgattgaaatgacctgggtcagtgtacaaaccaggaattaatattattggtggaattattattatcatgttgcctttccaaattcttcagagattactacatttaatgggcaccggtgtcacctggtagacttgtgtcctaagcctcacctcctgatgtgagattaacaagtacaatatttgtcttcctctcatgttcaagtggaagagatctaaactgagttgctgcatcagattgttaccatggcagccatccgctgttttggtaaattggattaattctacttcacttcctcatacagctgttgaccttttcttccttccatccaaatgtgatttaaacacttttttgttattgataatgctgtcggcattatttcagccaaatgtattccataagcattaccaattgcctgccatatgccaaatactggcttaggtactgtcctaggttgctggggacaaagagaaggatagtatgtagttcatgccctcaagatgctcatggtgtggatgaaacatttttccagcaacttcatcgaagaacatttaaaggcaaagaacatttgtaggaaactccctgtattgtggacatagcccaacagacggctgcaagcaagaattttctttgaagtcttgagcttttctttaaaaagtgattaagttgttcatctttgtacacaatattttgggacttgttttcatataaaatagagtttcttctgaagggagaattgtctttctaggaaggtgtgccattccaacttgtggctttgtttcccacctggcactcaatcttatccctggggacagtctgccccagggctatcctggggagtgttcacatccagtttgagaggaacggatattaaataggaaaatgtttggttcctataaaggcaaagcatgacactgttgattttcatttaaagaatctttcaagcaaaatattaagcaattttgggttaaactcgccagtcatcagtaatcgtgatgttagagggaagataatattgcatcatgaagggatgaaagtagcttttgggatatgtgtcattgttgagttcattttctcttagaaaattgagggactttttgttttgaaggctgaggaaggagtgtccaaggagttgtgtgaccgggtaagctgagcctggcagatatgaagggtctgcaaggtcaggatgggccttgaccacttcctggtcagtttgataaggtcagccaacaggtgaaggcagcaggacagtgtgatttagttacataagagaatttgggaggacaggtgctaccaggccaagaaaagtcctggaagtaggaagaaaatgtgtgggtgttgagggtggaggggcagggcagagagccaacttataatgtagccttgccagtttctgatgcctgggtcattgtcttggtgaaagggagtttcatactcaggagatactcagtaaatgtttgccaaatgaatagaataaatcagtattctttgattcttgtttcatatatctgcattttgagagagagtgtagttcatgctgtgagcattttctccacttcttttgcaggttctctcacttttttttttttttttcagttactgttgtgagccagtcttggtgttcaaagattgccaagagaaggaaataggctgtgtgtgtgtgtgtgtgtgtgtgtgtgtgtgtgtattgagcatttgatggatggctgagagcagggatgaaggcctcttctctgacctctagtcagagctgaaacttttcagttttttctcaactcccatttgcagcaattttgagtgttatctgtgaattgattcatgctgataaattaacttagaaaaccccacattctcacaaacaggaatgtgagggtgcagctggcactggaaccactgagggtctgtgagtgggcacaggtatcccaaaagtatccaaaggagggacagcctcaggtcaggtacctgagggtgtggcaggtatagtgatgggtgacctgccaggcagtgctaggctaggatttgttgagacgtcaaaatcagcaccgttagctgtttcacatggtttgcgatgtttctacatgcacgatgtcgaaggggattcttttatttggtaatttaaaaacaaatttaattgagaggaaccaaaactttccatatgtgaattgtatagagattggcaaaacggcttaccttattaaactcaagaggaaaggctcacccattggacagcaatcccatttaattgggaaatttttaaaaacaagtagctgccagtaggcagaggcgaagtttcagtattggtgagggttgcttctccatttccctttcttgggttctagtttagcccttttcagaatgattgccttgttttgtaatagtgtagttgcttcacagctcccttaatttacatgaaacggtgcttgacaagatagaaaagggagaggagagacagaggcaaagaaagacataaatacggccgggcgcggtggctcacgcctgtaatcccagcactttgggaggccgaggcgggcggatcacgaggtcaggagatggagaccatcctggctaacacggtgaaaccccgtctctactaaaaatacaaaaaattagccgggcgtggtagcgggcacctgtagtcccagctactcgggaggctgaggcaggagaatggtgtgaacccgggaggcggagcttgcagtgagccgagatcgcgccactgcactccagcctgggcgacagagcgagactccttctcaaaaaaaaaaaaaaaaaaaaaaaaaaaagacataaatacatcaggagtgagccggagagcaagagagaaggccagagatagagtggcagagggggacatgttgagagggagtgaaacacagagctcagatggaggggaaaggaagagagactgatggattccatcttgcctcagtttctcctctttccacttagtagaaaggtggccctgagtcaccttgagatgagagaggtaaatcagctcttttctctttgatctcagctcttgagtatcttccacatgtgagcatcttggtgctttgggatgtgtttgtggtatttaaagacgaatatatatatatatatatatatatatgtatatatgaatatatgtatatatgaatatgtatatatggatatatatatgtatgtattttttcatgctcatggccagtaatgtctggttctcatccaagaagagaagatgtgttctagctttgcaacatggtggtgggctacacccaagtcctagatgaggttcaagggtgcttttgactgtattgggtatttaccttgagtaccagatttgggatctatcattgtgcttggcataggttttatggaagtttctttaccttttctggattctgaaccgggatcctaacatctgtgtctctgtttatgtctgtatctgtatctccttgttttctaactgttgctattctgtagctttttgctttttctctttaatgtgtcctctgtcacaattatgtgtatcattactctgctgagtgggagaaacctgtctcttgataactacagctcattattggtgtatacaaatgctactgatttttctacattgatttttgtatcctgagaattaactgaattcgtttatcaaagcttaggagtcttttataggagtctttagggttttctagatataagattatattgtcagccaacagagataatttgacttcctgttttccaatttggatgggtttatttctttctcttgcctgattgctctggctaggacttccagtactatattgagaaggagtggtgagagcgggcatccttgccttgctccagattgtagggggaatgaacctttgatccttcctcctgggccttttgtgaatctgtgcatgccttaggttttatgagctctacttgctgggtggtggccacttctggttctgatatttgaatttaatctcaaggtagtaatttctttttggctttcagattttggaaaggtattttggacttctagtccttagaaggctctcagtgttagccatctgagcagtggcctgctgtgaccctcagaattcactgattgctcagagctttgctctcagaatttgaagaaagatgatttattctgtccttctggtttgtgcaaaaagaaaaaggcttaaaaagaaaaagtcttaaaacttagtgttaccagggagactgtactcccagaactacagactcttctctagcttttcctcaaacctgaacttgtgatttattcttctccaaaactactgttaaattcagttacactacccctatctctttaagcgtgtacaaatcttcatctgtttcttattttctgcccaggttatccaatcttttttcatttgtacaatgaaagtagccgtatcatatggggaaaggttagtgtgccatggtgattccaagtgtgttttgaatcctttttctctcctaagagggtatacacagtatgccttcttgcttcatgtatcacttattacaatttaggtagcacttgagtgcagtatgtagtcagaagagggaaatgggaagagaatatttattctgagtgttcagggctgcctcacctgactgtattagtctcatatgaggttgtaaaatggaaagtaaacacttgtctgtctcccagagggaagttctaatggtggaatttatctatgacacataggatttctttagaattattttgtcaaacaaacaagttcattgcttcaacttgtaaatattcagggtcttccaaacgataactgcttttgtcagagtaattataagaagagtgaattttaacccttaaggccttagtctatatgtcttataaaaacaggatatacagctccagtagtgcaaatgtttctttgattctttctctagttcacccaatattgacattgcccttgacatctcactaggcactatatatatacacctgaccctgaccttgtttctcaccttcttaaatactcaggagtttctaacacctgaaggacctgggatgtggaataatgaatgggaaaattcctcctggctcaccaaaacaccactcattctggactatggatgtttcacatcgaatgtttctcaaattgggagccatagacccttcggggtccttacatatatctttgggagttttaggagaccaaatattcttattttcattttggcaataatgtaaaataaattgatgtgagctcattccaaatcacctgcattacagatttggatgacttttgtattacagatttggctacacaatttcaaaacctgcatttgtgttcgtgaggcatctcataacactgtgtgcattgtcatgggctaaaaaggaaggcagagaaacactttggacaatcgaggagggaggagccaagatggccgaataggaacagctccggtctacagctcccagcgtgagcgacgcagaagacgggtgatttctgcatttccatctgaggtaccgggttcatctcactacggagtgcgagacagtgggcgcaggccagtgtgtgcgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacaagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagcctggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagatggagatctgagaacgggcagactgcctcctcaagtgggtccctgacccctgacccccaagcagcctaactgggaggcaccccccaacaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaaagcagagcacctctcctcctccaaaggaacgcagttcctcaccagcaacagaacaaagctggatggaaaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacgagcaaatgctgagagattttgtcaccaccaggcctgccctaaaagagctcctgaaggaagtgctaaacatggaaaggatcaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaaattggataaagagtcaggacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagatacaaagaaggccattacataatggtaaagggatcaattcaacaagaggagctaactatcctaaatatttatgcacccaatacaggggcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctttgaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacacattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacaccctcccaagactaaaccacgaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcattagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaacagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacgaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaacaaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactcaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggagaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggaagggatagcattgggagatatacctaatggtagatgacacgttagtgcgtgcagcgcaccagcatggcacatgtatacatatgtaactaacctgcacaatgtgcacatgtaccctaaaacttagagtataataaaaaaaaaaaaaaaaaaaaaaaggaaggcagaaaggtgggctgtgcattgagccatgtgttcacataatctgaaggtgactgacaacagagtgctggattttctgtggtctaaatagaaaagtgatgggagaatgggcttttgatcatagaaatgtgttcaagatagccatgtatgagccagtcccgcacggacattgactgtggagatgtagcttggaaaactgcatccccgtcaggttagctgactattgctaattctgatgtcattgattttgtaaatgtgtgtcgattttagaaatgtactgatgctgttggtacaaggaagtttatatctgatttatgtttgttcatagttaagtgtaatatgttataagcaatgtttaagtcaactctggaattcacaggattctttttttttttttttttggagacggagtctcactctgtcaccctggctggagtgcagtggtgtgatctcagctcactgcaacctttgcctcccgggttcaagcaattctcctgcctcagcctcccgagtagctgggattacagacatgcactaccacacccggctaatttttgtatttttagtacagatagtactgtgttggccatgctggtctcgaactcctggactcaggtgatccgccttcctcggcctcccaaagtgttgggatgacaggcgtgagccactgcacacagcctcacaggagtctttaataaggtctacatgttaatcaagtatgagaaatattctaatgggacttgaaatcctcaagaactatataggacggaaaacataagtgtttcatttctcaatgtgtatttatctcctctgtcatttaaattgagggcataacactatggaaaaagtaaatgttaaatctcccaatcctaaacaaggaacgtctgtgttattttcccacagaagaaactcttctcgccctttttcctatttttcattcattcattcattcattcatttactcattcattccttcacttaaacttttttttttgtatccactgtatgcccaggactgcacgaggcactgagtacttagaaatagtctcctgccaaaagtccaagttgcttggctggtttccctctattcagaaggtgatgacatcagtgaggatataaagtagcaagaatcacgaggtagatggcctgggtccagatctcagtggtggtcagaaatcaaacagaccagctacactcagggagtttccacccctctaccacagagaagtgacgccttcatgccttcttttgcaaggttgaattgtgccaaaactttcttttgtagtccagcatcaataggactgccggtccctgtcagatgacctccaagctccttccgctcttactacactgtgggctgtgattgatggaggagggtttacaaacgtggaggcctccagagccaggcaggtaatgctgacccagtgatgtggagtctacggccagtaagagcctctgctttatatgctgggaggaaagccacttctcagctcagccacttttcagctctggacagcagctgccatgcacgatgcaggtccaaatgttgacagtgatgctgggttttaagtgcaaatttccaattttgcatagctaaagagacagtatttccagtgtgcaacctgtgaatgtgccctggttaattcaaatgttaggtttgatctcattttgaagatccctgttgattcgagcatgttgttccatgacatcctaacttagaactttaatggtgttacttatttcccttctaagtttgtgggatacccttttgacccaatgacagtttatctttactttcttgtttgctcttagatgttattgtactttacagagttatctcactcaggctcaacagatgttgttgtataatattttctacttccaggttatgctgccctaatgggtatgtcctaggggaggagggctaagctgtgaatgcattgggatgtccaggatacctatcactccgatatttttctttctcttcatctgaagctggaagtacttggctgtcacagtttttaagatgtgtgaaaagtcaattggaatgaaatgatttgtaataaaaaataagggaatttagttataagaggtcatattttctggtattgtagtattgttttctttcattgttggaattctttgtcccttaggcaaaagttgtattttagggctaagaaatttgaacagccacgaaagctgtgtgtctgggttacttttcctctttttctttttcgttttttctttttttgttttgttttggagtagtctcataacaggttcagtcaagctttgttccttaaatgttctcacatgtatctgtccttgtcttccatttttaagtgaccaggcagaaacacccaaggtaatggcatgttctgagagccccttcccatcacgtgcacaccaagagcagccactatcttcaatttcaatttttaaaattttgttttggggtgtcttctgggaatgttcagccttgatgccctctgtgatcatttacaactgtaaaagtatggcacatgctcagatggccatttcatcataatagtatctttgatcaattatgtattttaaatgtctagatagaaagcaaaaaagtatgaaaggagttatttattctgaaatccgaatgcagtggtgaaagtatcacctattgttagctccctgtatctacctggtgcaaggatgaagggtttatgggaggtttaggcagcatttcctgatttgttgcccatctgcctagcatggtgatctctgccatttcatcccctgggatgacacagtcgtctcataattcttgcttctatcaaacagaattacagtctgctctgagctgaggtggaagaattcatgaagagccaacccacatttgtttagaaaatccattttaggatactcctgtgtcatgttttctgatgggaatgctgtaaactagtgttagtgtttgtagtgcaaaatactttttcttttcctccttggggatctcttggtatcgcatgtacttcaaactggcagatatggtttgcttggggatgctaatgaatgaattacagtgtaggcatttctgcttgaacacagtgtatacattccagaaaagcctagtgttctgcaaacatacacaaggcatatggaaaaaaaagtaggaatggtgcagacaactcgatatctatacttctataatgagaatactcaaataagcagtaataatcctaataaaatactagcacagtaaaaaaagtcatgcgagattcttaatagacatagaaatacagtagttcagaatacctgtgggtatcttaaaaatgataactattgggtactaggcttagtacctgggtgatgatgaaataatctgtataacagagcctcatgacacgagtttacctatgtaacaaacctgcacatgtacccctgagcttaaaataagagttaaaaaataatctgaaaaagtgtttaaacatgaaaatataggattttgcagggttttttttttttttccgaaggtgaaggaagcttaatggaggtgtagggttgtggctgcttagttagtggagcaaggacaaaatgcacaaggatctgagagaacccagacaacacaggtggacagtctgtgctaacagtacaaccacagtgcgaaacagcatcaggtccacactgcattcctctgtagcctgctgtgtgcagctgttaatggacttgcatttcagtggctgttacttgggggcacactgggaaaagtcatttctgctttagcatacttcatttactgacctagggagtgagctaactgatggtgcaggtacctgcattatggcagagaagtcctaaaaaaacatcttgagtccagaactcatgggaagctccagcaaggcacaaagacagaaatgaatgtcagattgattctgtgaacacagattcaaggttttgtgttggtctaaaaggataatgcatcacctctctcctaagagattatagcaaatgagctgtcttcaggataataaaagtgctttagtccacaaaagttcagaaatccattaggttgttagagtcctaatgaccctggctaaaatgaaaatatgatgggatagctgagcacttggagccttgggaagtgacctgccctgttgaatgatatttaaaattaaggttcttatcagtaacaattaaagttcttattcagctcttttcatcagtcctagcatacattcactgtgaagctggtacattggtctacattgattagccccaatgaaagtgcagtgatttaagacacttgtattagttagagttctccagagaaacagaaccaataagatgtgtgtatgtgtacatacatgtacatacacacagacacacatataaaatgtatgtgttatatatataccatatgtacacacatatctctttacatattatttagaaagagagagattgagatatattaattttagggaattgactcgtgtgactgtggaggctggtaagtccaaactctgcagggcaggatggcaggctggagacccagggaggggttgaagttgcagtcccggtgaaaaggtcatctgctagcagaattccctcttcctcctgggagatcagtctttgttctgttaaggtctttactgaatggatgagactcacctacccacattatggagggtaaactgctttactcgaagtctactgatttaagtgttaatctcatgtacagagtaccttcacagcaacatactcacatgtttaagcaaatatctggctaccgtggcctagacaagttgacataaataaaattcaccatcatagccactaagaaagtttttcaaatattctcagttttgagatcacagagcgtttttgaatgcttctagcttgtaagtaacagaaaattcaaactatttgaatcaggaaaaattcctatacatatattatattcccccaccttccaaatgcctaaacactccacaacaaagtaccaaatttctatgtcaactttaaagttattaattttttttttatttcccaagaaaaggcttgccctacatctgcttatggctctgagatgcccctctgggaggtcttattattcagccttgttcctacccctctgtcttcaccctacaatcccactcttcatcaaaatactcataacttcaaactgagcacctcacagaagatacatcttggatttgggcagccatagccgtccagcaagccacacaaacattttgctttgctggactttcctgggcaaattcactgctttctggcttcccttcttcttctccttccttctcactccttccttccctcctttctgcagatgctctgtgaaaggaagacattgtgccaagaagtccaaaggctgacattttaatgaggaacaggaagaaattttttccagtaggaatgggttctatctgctatgcccaactactagtttttgtccccgagttggaagttactaacagggatgtaatagagagcacagggaagccagaagtattccatcaggtataggtcctaaagcagccacaagagagctgctagattcattattccgttcccagcagctcagcgggcactggtgttaaatcacgtcttctctctgctagtcaagggcgtttctagaagtgcaaactcttaggtcccaccgcagactcactgaagcatctgcattttaacagaatccctgaatagtttgtgtgtgtaataaactttgctgagaaaatgagaagcgagagtgtgggatgtggccacatctgctgggcagatgctttcaaagaggcagaaaagacccagaaaaaaaaatgctgaactgaggtagaagagataaacttcgctgacttcaaaattttgcctgggggtgcttctggttatttgatatctgaattttgagatgttcatgactgagtttaccttgaggatacagtcatttatgctccatcaagtattctgtatattttgtgaatgtattcttcaaagacaaaaccacatgcaaaaaaagcacacagaacgttaagtgtacagcttgctgagttttcagatggaatgcttgaataaatcagaatgcaggtgaagaaacagaacattttactacattgcagaagcccagggtccccccccccaatcactgcagacccctctttccagagaagttattgtcctttgcttctgttttgatgttacatacataggttcatacaatgcatttggcttctttcagtcaccatgatgtttgtgagcttgtagtttaaaacttttattttcactgatgtagtctattccacagtgtgaaaataccgcaattgatttatccagtttactaaaaatgtccatttggataatttctgtgtcatggatgtcacacatagtactgcagtgatcatctgtcacaagtcttttggtaagcatatggacatgggcaacacattggtcagaaaaattgtttgcaaaatcactgaagctttccgtgctaactcagggtcatcatatgaagtctagctttatcccgggaggtagtagaatgatatccccagggatttgtggagatggtggttcagcttagcattttaagttaccgtgtggagtgtttgtccttgccgtcaggctgccaaatgacattttactattctcagtacttccttccttcctgggtcttttgtctgttgaagttttggaaaacaaattatcagatacattagaattgtgttttaaaagcactgtttgaatgtagattatttctaaaccaagcaggggtgtctcagaggctgtttttctttttttttctgactttccaacctccttttggattcttcttagtcagatacctgagtttcagatagctggagtgctgccatcattttgaaattataatattatttgtagttttactcctgttccatttttattcatacattaactcctttttcaattttgtttattttggagattcctcaagtagatgctgtagttctaaattatctttttagaaattcagccacttagagagataagcacaaaacatggagttatattattttgaatacaaataagaagtaggtgcccagccaggagtgggcatggttcatgctgaatgaatccactggagtctgtcagtcacttcatatgttggtcactgaaattatttttaatcctttctcttttgagtcttaggggaatgcttaaaaaactacacaccaagataaacaaatactactgctttgtggattctccttgtccactcaagcaaattattgtaataactttatgacaactttctatatagttcttgcatttaaagcaacaattaggcatttattcctattttctttagtagcttttgtattcattttgctgcccagagggtatgttattatccaagcaggtgagagaggagtgcagctcagaccacagaactggaaaccaagggaatgttaaaggtttgggataaaaaaatataaactgagataaatgtaaatatacagcttactgaaattgcttttccttatctgatgaaccagtgagttaagatgatgactcaattaagggaagactggtttttcttttcttgacttttcttgggggttgaggtcagcctctgttggcagatggtgtttgcagatctgaaggctgtttgctcttttagtgaactgtggctttgggaacacaaaagtggaccagtggcaggacaactgatccttgaataatgtgccaaagtcggattttaatgagatttttggctacctttttttaaaaacacacttcagaaaatcacccttccgttctgcagaaaatcaaatgaaaaaataattaaactttccagcaggttgctgggaaagcagtggagtggacagatgatgggcagtggggtctgtctcaggaggcttctgctttgtggagaatgtaccccaagcaccatggagtgagaccgggagcctctcaaagggtcttacttcactgttgaaatgtcaaattagagatgtcagcaacattttatttcaaaggggaaatgtgtttaagaaattcataagaaaatctctacaactaattttacttggtttgatacttttgatctatttttgtatgttttcataaaacagactgggacactgttattgatttatctttgtgtttgatggttgggtagcaaggtaggtaggtaaaaatcagtgattcttaaaattaaaagtagattataaaactcggtgacatgtcttttgggacactaaacaaataatatcacatatataaatagttttaacataattcaaagatgtcatagacaataatttcatgcttaattacattaactgtcatagaaaactaatgtaacctttgaaataggcttttaaaaaggccagagcaccgggcacggtggcgcatgcctgtaatcccagcactttgggaggcccaggcgggtggatcacctgaggtcaggagttcaagaccagcctgaataacatgttgaaactctatctctactaaatacaaaaaaattagccaggcatggtggcgcgtgcctgtaatcccagccacttgggaggctgaggcgggagaatcgtttgaacccaggaggcagaggttgcagtgagccgagatcgtgccattgcactccagcctgggcgacaagagtgaaactctgtctcaaaaaatatatatataaaataaaataaaaaggccaaagcaggttgtgtagaattctaacaaattttcttgccagtgttatgtatatttgagcataaggtttatttaactgtaaacaaaacgtgatgaggaaccaaacagttatctttccatgataccaataataattcagaattaaatgccaactatttaataatcagtggtaggtattcaatatataatcagtgctaattcaggaaatatatttgctattgaatgaacaagtagaatgcacttatatattccagaatgtactgatttcgaaagagaaattgttctttactggtattcatgattctgtagtatattaataaatcatttggagattttagaatgacaagcaaatccttatcttttgtagaagctatggtgagttatctatgtatgcaatatgttgtctttgttgatcgccatagaatcatgtaatttaatttatttttggaactcacatatatgttattaacaaatataaataatattttgttaaaaatgcccccacatttattattgaagtatattcaaaatatattcaagatttgatacattggtttagccattcagctgatgttgagattgcagcaacctcagcccacaaaaacacaaacctgaggtggagtgtattcatccatttttgtactgctttgaagaaatacctgagactgggtaatttataaagaaaaagaggtttaagggactcacagttccacatggctgggaggcgagggaggagcaaaggcacatcttacatggctgaaggcaagagagtgtgtgtaggggaacggccctttataaaaccatcagatctcatgagacttattcactatcactagaacagcaccaaaaaacctgcccccgtgattcagttaccttccatcaggtacctcccatgacacatgggaattatgggagctacagttaagatgagatttggctggggacagagccaaaccatatcatggaacaagataaaggggcctttgcatgtcagaaatagttccagataccagcaagacagacagtttcttgagttggacttattttcagctttcttagcatctgttatatggtaaatagtgggcgcatccccattgaaaacaatgtgaaaggagaaagggaaaaaatagtgaagaaggcagcagcacgctgaagactggtgcatgctggtgcgtgtaaagttcagatggaatctgctgtgctttctagaatctcctactttctcactgtgttcagcaggagagaccctttttatcttggcaatcatatttcccatagttagtcctctccctaaccctgtgcaggcaaggcttagctgctcactccttcacactgttgccttctttgtcctctctgagtcagagttctgagcctgtcgcagatccagtataaaactccaccttctccacatcagttcacgttgagcccttcttctccagacctcctgcctccttccttcattcattaatggagaagctgctgcaggtcaaacctgtaggtgccgggtgctacaggggatatgagactgatagggtaactgggaaggtaaaacagccacagaaaactcaatacacagaactcagataaagagtggcaggggataggaggggagggatttccctgtgactggagtattcagggccgactttcagaggtgacttttgggaaagccttgactgatttgtagcatttggcttctagatagcatatatgaaaggcttagattctgatcaaagactgagattaaaatatactttgaaaagggagggaagaatttgtttctcaacttttgcaatctcaaaaattgaaaaaacaaaacaaaaaaaccagaacagtgatgtgaaatcagtcaagaaaacatgcttcatctgaactttgtctccttgttgaaaagttacatattttgtattgagccttctacaaaatacttgaggacactgagcacctaaggatggaaaaagagtgaagaaaatgagacagaaaactagagtggccatagaattgattccctaaaccaggacttgtttgagaataaaatgaggataactaatatactttaaattatataattttatcaaaacactattttattatctgacaaattgtttttattatatagtggtcctatgtactagttctagtcaaaaattttaaaaataaagttatttgtaaaatatataaaaggtttacgtacattgaagcaaaaattcttatcacttatgtgaatattaaaaagtgcatgtgcaaaatagtactggaatatattcacgtattttaatgttaattctatatctatctctaatgccagaattagtggtacttttctgaagaatacatcttcgttcaatgtggtcgtattcttaattttttctataatattgcttgtaatctttagagttatggtttcattttttgactattaaatttgaaattgttgacatcagcagttgactcttctgtgtagatcataattttttaattaagaagacactctcaagtgttgaactataattgtagagtaaattctaagtggaggatatcgtaaattcttttttgtcttggtattgacatgtaaatgttaacatatgtgaataattcagtccacgattgtcacaggttctatgtctttacctcctttcaaaatactttctttaacaaatactttgacaaatttattaacatttataagacaagacttaccaagttgtgttcgtttatgattctttaaatgttttccaatacttagatacatcaaaattataggacttctcaattccatcctattgttacagaatataaatttaatcaagataggaagaccctcaaaagatctttctcatgagttcagatattccaaataataattacagaatttcatttgtacatttgaactcttatcattgaatttgtttaattccttagtgtcttcctgttttcaggcttacttttcaattaatttcagtctgcaaaaagcttcaaaaatagatggtagcttttatatggttcctaatgttgagtgatttgattaaagttttccaactgattttgaacaaaatgtaatgaaagcttagaagactagtttacaaaaaaaaaaaaaaaaaataggacatttacaatgatttgctaagtagttcttcaaaggctcaaagatttccaaaatctgaatggtgataagccacaatgagagaaaatgactattgcaaaaatgttgagataatgtaattatgtgtgtcaatatatttgaaattttgacaacatttcagtctacagaatattaaagtgtatttggattcagttatatgtgccaccaattccagtgtgtttctacttcacagatttcttaatttggtaaaaatataatttttactacaatgctttattcttttatttttcatggaatttgtaatagcgttcgtaataagattgtatgttctatctttgacagaatgaacttcctgaacgttgattccattcagtggatggggaaaaaaacaaaccagtgctggaattgatgcaactgtttatttttttttttgaagcatctcattgcattgatataaaactagcctcatttacctttttgaagttcttcttctgctagtgcaggcaatatacacagctctcatttcactctttgcatttgtacaagataatctgtaataaaaatttgtgcagaattaatttggaacaagtctcttgacctaagaaaaaagtcatgtttcacaggtggtatgtaagtaagccttctgcagctgcatgagtaaaattgtagactctgaagaatatggttgtcttaaaagacatagttcctgttgctcttcaggagatttatattttctggttttcatgtggctaatgataccactgtatgtagggcaccatggtatcactttagggcaccatggtgcaccatggtggaggataatactgagaagctttttttaaaaaaaaacaaaaacaaaaaaacgaagatggtatagtgttcccgtgtaacctgtactcacttttccttatttattaatatcttgctttggtgtagtacaattgttacaattaatgaactgattattgattcactattattaactaaagtccatattcggatttcctcagtttttccctaaagtcccttttttgttgttgttccagcatccatttaggacaccacgttccattttgttgtcatgtctccttatgctccttttggctatgacagttaaccatttggagcagttatgcatttatctactttcgaggttgttgctgccagaagagtttactgcgaaatgtaaaagcattgccatccaataaaataactagatatacacttaaaccatataaaaaaggtcaactcactgtagcaagagcatccgaggtactctccattgctctgaggcaggcctatccaacttctgttttctgtacatatttcatgtgcactatgcttgtaattttccaatttcccactgacttgaccacacggctgcctggcagcattttgcacatcttgcagataggagcacaactggctgactttccaggtggttggccgaggcagctgcttccaatctttctccaccaccatctgagtcctgaaggagttttctgtctgcagcttctcttgtccaagcttaatttgttttatcagtgaatgtgagtgttctgcttcctgcccctgaaaggaaagttttagttacattgtgtctggaaaaggtcaggaaaggagagatgggtttattcctgattatcttctgatttagccacatattattctatcttttcactgcatggatgtctcacacactaacaggtgaaagtggagatacaacaaattcaccctggattgttttaatgcaactgttaataagcttaaatgtacagttggtacacagtttaataataggtaatacatgttaatgcaacttgttgattaaaatgaaagggaaattctagttagatgcttcatgtggacaggatacaggacaacgaacataaactgggactgtcctaaatctgggaaggtgacagatgtcacctaaagagaaattttacataaaaattgatattgtattccttttttgcttctcagctcctttttttttgccaaagtagaaatatttttttccatgaaaaataactataatatacctacttgcgctaacactactagattatgcctacatttaacttcactcaggttaagttgatagaagagaaatacggggagagcaaatgtgcactgcaaggcaagtgctcttaaataaagagctgcatattcttacatatacatgtacacacgtatagcacatacatactgtaatgtcaacagaatgaacttctgtatatgaaaaagtttgatctggacctggggcacgatgtgaataaaagcctgttcatctgagtgtggaagggtgaggtctgcattgccccatgcacattgctatgctcagggccttatgttaatagatggtaacgggtcagcacagcaaggctcatctatccctctgcctgttagtgtaaataaaattttattgaaacacagccaaacttattcatttatgcattgtctaggctgctttcacactgcagtgatagggctaaatagttgcagcagagatagtatgtcctgcaaagccaaaagtattttctacctggtgcttcacagaaaagatattatgtacccagggactataacttttgcagactgaccttgaacatgacctaatttaattgtcccttttcagttcccagagtactgccacgcgtaagacatttctgtccatggagctcccatactacaagattttcttcctttgaccctttttgaaacaccacccagacatggacaggagacaaccatctacttctttttaacccagttggggagtggagttaagaataataatggatggaaacagtggctggcacttactgattaccaacattgtaccatgcactgtacctcacagctaccctttgctacccttaggtggtaggttatacccactttatggttgaagaagctgaagctggagaggtgaagtgtttggctctgagtcataaagcagatgtggtggaggaagcatttaaatctacccaggtcattccacttatcctgtgctgtattcatttatgactgcagaagccccagttgttttgaggctgtgcctgcagtaaagcgtcagcatgatgcttcctgctgtttctatcctcctgcctccattggtgaactcccagtaactaaatatcagtgattgaaaataggaagcaatttgtaatctggattgttcctagacattgaatggatctagttaactctctcatcttccagggaatttccgttttaatatcttttggggaatgttataaaaatagatacttaggtaagtaatatttctcaagatgacacaaacccagaaagaattttacctgcaggagatgtgtgtggttaaggggccctgggtgaggcatttctggtttaaaatgtagattagaaactcctctgatcagacaacagcaaaactgaagccagagaagcctcagcccctggaccaggttgtctttccaagtctgctggttgctgtggccaagttgaggagaccattgtttgttttctctagattggagagctggatagccattctgtatgcagactgagaccacagccagtcgtaagcaactctattagtgggaagaggtcatcctgtctagaaagcaagacttaaactttagaaagggaattaatatttttctgttctagtagcatagctggatttggcccttagaatttattttctagttaatttggggtttattctggaagcatgcatactatgtaataaaaatacgtttttagaagagtactttttatttaactcatatgggagaaaaaggataaacctttgcacttactgactagacaagtgtgattcgttcagggcatcgaacgaagtaggctaactggtattacattagtaagaacataatccttgttcttacccaaaaagagaaataattatactaccagattttagttgtctataatttacctattctagagtaaaagctggtgacaactcctgaagttctacatttctggattaaatgataatggtcttagatttatttttatctctgcacatttatttcaaaatcttttgtttaattccttgcttcagccaaaactgtgaaaatgcaaactcgatcatgtcatctcttgctttaaatcttgccatggcttcccatcctttcgggacatccccgccgacccccttcagtgcgctttcggtccttgaggatgtgctcatcgggctcctgctaacttctccagctccagctctcctgcctgacgctgtgcacagcctgtggctattgatgcctgtaagagaccaccccctattgcaccccctttctgcctagttgacatctatgcatacttcagggaataccccaaggactggtcatgttcacctgttctatgctgtcagtgcatcttgtacttattcctcacagaacttttcagtcatagtcagtcctgtgagctttatgcaggaaggaatttggttggcttcctagcattttcaagatctctcatggcgccccttggattgcatgcatgttttcatgtctcatgttcagatgctaggatcttagcatcagtgttcttgtggcattccttagtatagaatgatgaagacattggcatttattactgtgtgctttcgtttacaaaaactgggttctagatgcataaaacatacggtttgagtaatttagctccctattttaatgcttaaatcagcatgacttgggatctaaaggccagttttcctaagcaccctactggatcactgtgtttcttaatgtggagtgaagttgtctgtacttaactggttcccagagatgtcctgagatcagtggtgtccaagcattctacataccagccctactgcattccagatatataaacataaatatatatgtaatcttctgagtaaaatgttaatcttatgaaaatgggtgcgtgacctttaaaaagttttatacatcttaggtatacctgttttctcttcaagtacgtataatttccctctcagcttcaatgggaatatttgctatttaaggttcttatttcccagggatcatttaaaaattttaagttgtgaagttttcatcagtaattagccattgctactgtcgttcatacaaatcatcatataatttattgaacaagaagataaatgacatctaaaacattgataattcaaggtacatttttctctaattgcatttcacttgatatcttcagacacaaattaggtatattagtgttggttgctctctcagcacagatgcagagacttcttttgtcttgactgactaatgcttatgacttgatccttaatctttctttccctagtgtttgccaagtacacctgtaaacagatctgcatggtatttgagagtgcaagtgtaattgctttagatgaggccctgggtccttgatgaattcaaaatgctttcaagccttgtcactacttgtcacccttctcagcactcacttgtgccaactgggtcaggcccagaagaaaacagagttgtgtgtgtggccattgtatcgtttctgcttgtttaacctttgacgtcagaaggtaggacacgggaagaggccagtaactactacactcttgtgagggaacaaaaattatcttggcaccaagtaatggtgccaagtttattgagttgagaaatccacaggtatttagctgcccaggagaggcacagaatataaatcttacgtagagggaccaggtactatcttttgctatgatgaagtattttttgttttgttgtgtttttccttttcctatcaggtgtgagaattgccaagagtgttatgttacagtctcttggcataccccagaaggtgcatcatttccacagtatagaccaagcgaagcacacaggcagatgggggcagggatggaaggtgggactgtgcccactgcatgtaatagtccttcccccagatagctttaagtaaactaaattgtagaaggttatctcatttttatcttattcatgctttcattcttttaaggagtcctcttgtaacgtgggtaatccttgtagcaataaaacatgtcctcttccaaagtaattttttaaaaatcttgttatattacattttcctaaatggaggtatgtacttaagacccctgaaaactggcttagcacttacttttggtgtgaagagctagttcttccctagagagcccaactctggagccaggtggattgagtgggaatcctagctctgctaaagggacgtacttgcctaagtctcctcctcagtaaataggatactagtgataacatcttcatagagttgtcatgagaattaaatgaataatatatgtaaaggcttaaatcagcacctggactacatatataaggtgatcaataaatatctactttggtatctgaatgcttcaagatagccttttgttcccttctaaaaaagagtgggtagtgattgttaagacttacccgctcataaatgttttattacatacttaatatgtgaagctatcaagtaaggaggtaaggaagtatgttaatagggaagaagatgataaaatacccaaataggaaaccataatgccaactttctaagcttaagctgactgtaacaaagaactggctttgtaacaaagaacaagtcttactggcttcatgcaatgcaaacatttttttcttacgtatctgacagatcaaggtggtcaggtagctctcctgagcagttttccaccatgtggtgattcagggatccaagcacattctatcacgaggcttagccatattggagtttttcacttcggtgatgaggatgagggagaaagtgggagagagtgaaaagagggagaaaggtggaaaagggagaaagaaggagaaggtggaaaggagagagagagaaattgagaaagtgagaaagaaagaaaaaagaaagaaaatgtgctgaagattttgtaagcgattttagaggtcaagcctagaggtggcaaacacataccatttctgtacccactccgttttctagaactagtcacatgactccaacctaccagccaagggttctggggaatcagatctccctgtgtgccctgtaatgcaaagcaagatagttgagtttccgtggtggagtcctggcacaacagttaaccatgtgacatattttctgttagtggcagacatttcctgtaattattctatttgtatgcttcactgtaaactatttttgaaattctctgtaatgaattccagaaccaacacatgacccaagaatttacaaatcattatgtttctttctcattttagaaatttgcaaaaagtgagggaatctactgagatgtgtacttctgaacattttgatgttgtacagatagccagcaaacaaggactctaggtgacagtatcttttttttttttttgtgacggagtctcactctgtcacccaggctggagtgcagtaacatgatcttggctcaccgcaatctctgcctcctgggttcaagcaattctcctgtctcagcctcccgagtagctgggactacaggcgcccaccaccacgcctggctaatttctgtatttttagtagagatagggtttcaccatattggtcaggctggtctcgaactcctgacctcaggtgatctacccaccaaagtgctgggattacaggcgtgagccaccacatccccccactcggtgacagtatcttaatgacaccctgacaggcagggttctattaaagagcaggtttttatgctttttaccttcctggtagtcagtaaatgacaaaggcaaagaagttaatgatccattgaaattatgtcagacaatctaagagtagagatttttctttcactgccccgtaataaatatggcttactattgcaaccagaatttgtactcagctctgatgggaaagataatggcagttttctgtgtcttataccaccaaataaagagacttactactgcaggtttattaataatattttccttgagcaattcttttgaatcatgattggcctctgtacagatcaagcagtttgtttataagaacaagcctggggccaggcgtgttggcacacgcctgtaatcccagcactttgggagggcgaggtgggtggatcacctgaggtcaggagtttgagaccagcatggtctcagagacatggtgaaaccccgtccctactaaaaatacaaaaaaaaaaaaaaaaaattagtttggtgtggtggtgggctcctgtaatctcagctactcaggaggctgaggtaggagaatcgcttgaacctgggaggcggaggttgcagtgagccaagattgcgccactgcactccagcctgggtgacagagcgagactcagtttcaaaaaaaaaaaaaaaaagaaggcaagtctgggagagtttacagccacatggacacaccttggggccaggcttaactaagcttcagagttaatgtgtaccttacgtttttcagtgtttccttggtctgtggattgattttgaatcccatttcttctgccagagtttagctatttaacacatagggaagcagtatgattttatggttgatcaggtggcccacagcttgagactgagtttgaatccttattctgccacttaaccaccatgttaccatgggccctatatggtatttgtttgctagggctgcctaggtatttgtggtaacaagcatcacaaactgggtggcttaaacaacacaagtttattttctcacagttctggaggctagaagtctgatatgactgtatcagcagggttggtttcttctggggcctgtctccttgacttgcagatggctgtcttttcctgtgtctttacatgatcttctctgtgtgtatgtctgggttcctatctctttttataaggtgaccagtaagattggattaggagctattctaatgaccgcattttaacttatttacctctttaaagacccatttccaaatatagtcacattctgaagtactgggataataaaggtacttcatgatgttgtggtgagcatttgaagagaggatgcatatacatttccttacacattaccaggaatatggtgactactcgctacgtataactatttttattacaattataaattgtattctatctgactgtcttcttttccaattgtgagatggctgtctgcatggcttttcagttactgaggcctaggattattgtcatctttcttgcgccctcatagcatcttaaaatgctgccttcaacagagtaatagggcaaaagcccaaggaatgttgatcaagtgggtgggtatgaattttgtgctcaggatttctgagtggtcttctgtggctgttgctttggtgtcacaccatagatggctgtgaaatgctctcagacttcttggttcctggagtggcctgcccaaaaactagacgagcacctggagaagagtaatctctccatgtcaggggcaggagacagaagttgttgtgcattgtcaggggagaaactgtaaaatcacagaaccagatcaccaaacataagaattatccaaacgttggaggtgatttttaaatcaggcagtgtgtcaaagtgattggctttcctgcaattattagctatccccaacatttctggacttaatgagaattgatagaattatttgatgctggtattatggtaagttatcatctcatgcccaaagaattgactgttctcaaaatttttggtatttcttgtttcaactggtataaatgttctttgctttaaaaagtgttgctactgtcacaacccggtcacagcctttgttaaatactagcaagcagggatccactaggatcagaagaagaaggccagattgcagtctctgatataagctgtccaaggaggccaatatgcagcccatcaatccggagaagcatggatacgctggggaatagtgggcttattaagtctacacctggctatagcatccatccatagcagatgagttacacaggcttcattaactagacacaaagggtatattattcatacatcatgctacattcctgtcggtgaatcagctcttaaactgtgagtcacggacaccaccaccctcaccaactagttcctttatcctctttcagatcagctactgaatctggttaatttttcttttgaaatacctctgaaaatgtttatcttttagtaaaagattttaaataataactatgaggactgtcacaaataaatagtgtgatacaataagaaatatgtagttggtctttgtcccatcttcctggaatacagctcctaaaacctttggaatctccagaatgatgagtgtcttttgtatggtagtgagaaggctggtagctggggacccctagaccttcaggatgggggctgaacatgattaagattaagaaagactgacgtgattagaaggttggaactttcagccccatccctgacctctggggaggagagagaagctgaagattgaggtaatcaccattggccagtgatgtaatctctcatgtctgtgcagtgcaatcaccataaaacccccaaaacaatagtgtttggagaactgctgggttgatgaacatactgaggagctgggagggtgttgttctgtgcacccacactctgcttccataccttgcccaaagcatctcttccatttggccatcctgagttatattctttatgataaactggtaaacctaagtcaagtgttttcctgagttctgtgagccatttaagcaaagtatggaactgaagagggggtcacgggaacccctgatttataggtgattggtcagaagtgtacgtggcaacctggaacttgtgactggtatctaagtggggagcagtcttgtgggactgatctcttaacctgtggggtctgtgctgactctgggtagtgtcagaatgaaattggattgttggacactcagttggtatctgaaatgttggagaattggttggtatgaggaaaaaatccacacatttggtgtcaagagaattgtgactgacatcaatgcaaatatatataaaaatgtgaatttatatgaagttacttttagctgaccgtaacataataggtatattcattgctgtggtttggctgtgtccccactcagatctcatcttgaatggttatccccataatccccatgtgtctagggagagagctgttgggaggtgcttggatcatgtgggcggtttcccccgtactgttctcgtgatagtgaaagagttctcaggagatctgatggtttaaggaggagctcttcctccttcactcctcactcttctctctcctgtcaccatgtgaagaagatccttgcttccccttctgccatgtttgtaagtttcctgaggcctcccagtcatgtggaactgtgagtcagttaaaagctcttttatgtataaattacccagtcttgggtatttctttatagcagtgtgaaaatggactaatacacccactgttatgacgataaaggctgaaacatgtcttatcaggggtggatgaaacatggaattaagtaactgatttaatgttacctaatttttctgtaaatttatatatctttctattaaaattaaaaaatacacagcaggaacaacaacaaaatccttccttattagtcccttgctgtgcattttcactgtcctcgcaggccccatctcctattgtggggaaaaatccaaccatatctcctgactgctgtcttcccttccttccgttcattctgtgattgctggtttttctttccttagttcttcatttatgtttctctttcttaaaagccccctgcagagttgcctttaaaattttataattggtttaatttttatttatttatttggcagagaagagcaagttagtaccttgtaccaaaacatcaaccttgtggagccaagattaattcagccatatgaacatgttataaagaacttcatccgtgagatcagacttcaaagcacagaaatggaaaatttggccattgcggtgaagaggtattgaagtccttcctttataagtggcctgtgggtgctttaacttgctctctgacctgggtggcaaatggactgaactgcattgtcacactatgatataggtggacttcctgagcctgaggagtctagagctttcaaaattaagccagcaatggagaagtaggtcagctaccaatcaatcagtagatcatcatgatcctattatataaactcttcaggatcaatgatgacttgatacagaacaattaagagatttatcttacatccagctgcttaaaacacacaggaaacttttatctagagaagtagatggaacactatttgaagcctggccttgttacctacatgtatgagactttgtgagcaggttacttaatttccctgagtctcaattcctgcaactgcaaaatgaggatgaatatcttcacgtcctccaggtgttaagacttagtggatgatgtcatgggtgagccctgcacactgcccaccacatggtgggtgctcagcagtgctgctttgactctctctactctctagccctcctcacttggccctccccctttgaactgaaagccaaagaactattaaactcttactctaatacagtccatttaagccatagctagcttacataggatatctttttggtgttaacagctatgtcatgcaaaaaaaacaatttatatgtgttgcagtccaaacgtcagcctctttgccccctggaaaaactgcattcctttagcatgtattgggaaagagagggcattgtgcttgtcacagttcttgtgtgttgtgccacacggatgctccttgctgtcgtgtgctccaccaagagctcccaagacgctgtgcaccctgctggtttctgcctggagcttatagatgcagcccttttaataggaggctgccctgtctacataggggcgggtgacttgtcttcaattctgctgtctctttatccttcccatccacatgatgctgaaactgtctagttgaacctttggttcattacgatgtagaaaagaaaatattttaaattcttggtatgaaataggacctttcttatcgtcctggagtcaagccaaggttgatctattcacaagggatttcttatgaacatttttagtacttgactgaccatttttctctcaaattagccttctaggggccttccaggaggataaagggtggtcctcagaactccagagtctgtagagcattctggagtgtgggtcagagtcccagagttggtctcctttgagatgggacaggcagacacacacattgattcttcagagcatccaataagtattaaaacagacaaactcataggtacacacataggtacacatacacagacccacacagagatatgtgggtacacatgcatacacatgccccccatctaaagataataccatgtaaacctatgaggaaaaaaacagactggcatgcttgatgttctcattaccagctaggctgctttttcatggtggagtgagtacatcatattaatttgagctgtgttggtgtccccatccactcccttctgtgctgctggagggatccagagccagcctctatgctgagctgaagtctcctaaagcctcctttcttagctaccaaagacctcaggaagtgtttaaatggctacttgtaaaccattccttgcatgcttagccatccatcctcactgctatttttaattgggggagggttttggccattttgttctgcactgcacctgaagaaggggttcccagtgtcctggagggagccccggactaggtcacagtgggcagacatttcaccagaaattggaaattgctggggcaagcactctgtgattatgcatcaccctgatttacaaaagaagaaaaatgttgctcagaagtgaaaagggcagagagagtccattacggagcagtcccagatgcttgggattggatagctagaagaagtaggtgggaaattatcataacagagggagaaaggatatgtgccttagccatttacagtcccagagttgaccaaaaaaccgccagacattgctatggagatacacagtttctagacttcaaatagcaggtatttataagcagaaatgaactgacttcccaagcttggttaacataacctcggacaggctataagatgaggaagaagtaaataggaacagaagataataatgttactgaaaattttactttggggtctttttcctcccataatacttccttggagttttatgtggaagttgaaccaatgcatgaataaattgtgttgtgtgagggagtaaataagtcaaaagcaggtaagttgctatagcagagacccatcaaactagaagacagaaaatcttatatttaagccctgtcatttattaatagcatgtcatttgtccgaatgaatcacctctaaagctcatggtttagatgcaaatcaatgtgctctgtctccatagagatgtgatttataattgcactcctaacagaaacataatttttctaaaaggtaaccttatctacattctagaactttaggggacaaataagaataatgattgagatctttttttcccttctcactttaacatataacattgtgagttttatatagtgaaatttcaaaattatatataaccatcactttgccacagagttctttttttaatccagggttgtaactcagtcatgagagcaaaaaaaaattcagaatttattgagagcctcccagcactttgatatctttactgtttgccacaatctagtttaatatcattttatccaatttattaatttatttaatatagtcaggtaccacatcacaatgttttggtcaataaaggattacctaaatgacagtggtcccataagaatataatcctatacttttactgtatctattctgtgtttagatacataaataccattgtgttacagttacttccagtattcagtacagtcccatgctgttcaggtttccagcctaggagcaatatgctattccatatagcctaggtgtgaagtaggctttaccagctgggttggtgtaaatactctttatgatgcttacacaatgacaaaaatctcctaaagacacatttctcataatgtatactagttgttaaggaatgcataactgtatctagttttaaaatcattttacaccaaaatggtcgaattgccaatctcattttattatgtagaaggaatgggaaatcattttgaatggggtgtttctcttcatctgtaatatatagggcttaacgtagatgaatctgaagtttctcttcatgtttcaagttcaagagtataatgaaaaggtgtgcatccttttgaatttcagagcccaggacaaggcagctatgcagttgagtgagttggaagaggaaatggatcagaggattcaggctgcagaacataagacacggaaagacgtgagtttctgggttggccattcattcagcagatctttatgaggtggtttctacggagagggcccaggcactcttctgggtgtcatgcaggggtacagcaagtccaggtttctgcagagtctcccagcaaaggaatttttactggtggtggtttttggggatggggtaagaagaagtagaaataataaataagcaaagcaaataagttcagatagtgacaagtgcagtaaagaaataacatgtgccatagtgactgggggaggaggctgcttaggttgggggtaagaggcctctttgaaggggtaacatcagagatgaggccttaggagaaggcagaggcagccttcatagagaaggtggcttgactttccatacctgtgtctgcccacacctgctgcccactttaaatctagattagagtgaaattaaaattctgtcttcaaactttggtgttttataatggaatacagtcatcacttggtacccaaggggattggttccaggactcccctgcaaccccgcataccaaaatctgcatgctcaagtttttatataaatggtgtatatttacatacaacctatgtatatcctctagtatactttaaatcatctctggattacttataatacctaatatttaacacaatgtaaatgctttgtaaagagctgttacactgtatttttatctgcatcacttttactgcttaaaatattttcggtctttagtggttgaattcgcagatgcagaacttgtggatatgaagggctgattgtatgcctttattcagcattataggaaccatttaaagttgaaagtgatatgttaccttcagtgatttccattgaagaaataatttttttataaaatatttttgggtgattaatgtttattgaaaacagaaaatagacaatgctaggttaaaacttccacttttgtttattaatttgccctgttaacactgagtggcagcaaaataatgtacaagtggcctgaacattggcatctgggagaccttagtttgcatcctggcccagattgtatctaggtggcattgggaaaataacccaacctctgagcctttgttattccatctctaaaatgggataatgcaacctacctgccttcacaggggttagacatgatgatctatataaagtgcctagcacggtgcctgcaatgtagtggctgcaccctggttgttactgtcctgctttttcctgtggctctgtgtattcctgattccttttagattcttcaccttaaatggctttaccacatatatgccctggggtgtctttgttgtcctatcttcttataaaaagtttaataagaagctggacgtcattttcaaccacataaatggtttaaggttcatggtccagcttcagagcaatggataaccccttcttcagctagcactttccttttggtaaaaaggaaagagtgaaatcatttttctgcctttttttctctccatctgctgtgtttaatctgtgcacaaattcattcatcaaacacttatcaagcacgtgttattctgtcatcatatctcattgcttcttccagataaatgcctcccaaatttgttgctggtaatggggatattaccatggcccccaccttttagaatttcatgttttgttaattacaggatcttctttagtttccttggcttcagtccggtagtggcaaacccatgcatccacagcatcatttctctattccacagcaatgacacatgtggcctgtcagtcaccacatacatgtggtctccacacctcagcacgccagtccaggacgtcactgccagctgagcagctttggcactgcgaggaaacttgtttgcctgtccatcctagtgtccgcctcacacctttctaaacacagcctctctggaataatgtgcccaggccagtctaagatttttccctcatttccttccattccacatggctcccctcggctccccagggttcttcgcccccagccctggcccagtggcctcactgtgcctgaccctgctttggctccagctgttttctttgtcttgatgattatctcttcactcctttccttcttcccaaattctgcaaagctcagaggaaccctcactttcttcttgatgccctgccctgctcctgtagccacattcacctcttcctgtccttgactcctatggcatatatagcatatattgcattacttcagttagtatttttttttaactgtaacagctttatgaaggtataactggcaggcaataaactgcatataaagtacagtatatgtgaagtttggacatatgtatgcaccatgaaaccattcccacaggcaagatcatgggcataactatccaccctcgaagtttcttcatgccccttgaaggcataacaagccttccttcctcctttctttgcccctttttgccagataatcattgttctattttctgtcgctgtagattagtttgaagttttcagaactgtatagaagtggaatcatgcaatatatgctatttcttctctggcgttttccactcaacataattgttttgagacttatccgtgtaattaatagtttgttctttttcattgccaagtagtattctattacgtaggggtaccacagtgtttagccattcatctgtagaaggacatttgagttatttccagttgttggctattgcaaattaaggtgccatgaatatgcatgtacaagtctttatagaggcatatacttttattcctcttgagtaaattcctggagtggaatgggttgatcatctatgtagatgaatgtggatttttgtaagatactgcaaacctgatttccagagtggttgtacagttgtatgattcaatcagcagtgtatgagagtcccattctttcagcattctaatcggtgtgtagaggaatctcactgtggttttaacttgcatctctctaatgactagttgtgtggaggatcttttcgtgggtttatctgccatgtgtatatatatatattttttgctgaagtatcttattaaaaatctttggctcattacaaatacagttttttttaaaaaattactatgttttgagagttcttttatattctgaatgcaagtcttttatcagatacctgatctataaatattttcacccacaccgtgacctgtcttttcattctcctaacagtaagagtataaatttttaattttttatggaccatactttttttcatggaccatacttttcatgtgatctttaaaaatctttaactcaagattttcccctgtgttttcttctataagctttattgttttaggttaaattcaggatccattttgtatttggtgccaagatatggatcaatgttcatattttttttatgtagatatccaattgttcccacacctttattaaacaagactaaccattttccactgaattgcctctgcactttatccaaaatcagtttattctatttgtgtaggtttatttctgggctctctgttctgttccattgattgatttgtctattgttatgccaatattacattgtcttgatacctattggtttataatgtcttgatacctgttggtttataagtcttgatacctattggtttatagtatgtcttcatacctattggtttataataagtcttgaaatcaactagtattagttcttcttcaactttgtgcttttttaaaagttgttttgcctattttaattgctttagttttcaaagaatcagcctttcaatttcttttaaaaaaaaaagcaaacaaaaactaaaagtctgcagggagtttgactgaacttcattgcgtctatagatcaatttggagagaattgacaacagtattgaaaatatgatttctctctctatgtcttctttcagcaatgttttgtgttattcactgtacagatcttgtacatcttagatatactcagtatgtcatagtttgatgatactgtaaatagtatttctaaaaatttcaatttctgattgttcattgtgaatgtatagaaatacatttgatttttgagattggtctcgtattctgtagcattgcttacattgtttatatgcagtgcctttttgttggtagattttgtcattttctaggatgattatgaaatatattaataaaaacattttatttttctttccaatttgaatgaagctttttatttttcttgccttattgcactggtaagaagaataaaggagatgagaacattgaatgtgatgttagtagtgtagtgttcacagatgcctttataaatgcagtagagtcccttctgttcctagttggctgagtattattgttgttgctgttgttttagtcaggaatggatgttggattttctcaaatactttttctgtctcatgatcatgtttttttcttttttagaatgttaatgtggcaaattacattgattgatttttgaatattaaaacaaacttgcacttgagctaggccctaattagttatgatgtattatcctttctatagattgttgaattcagtttgctaaattttacttaatatttttgcattcatatgtggaagagatattggtttgtacttttaatgcttttgtcttattttggcgtcaggcaaattctggtctcctagaatgagttgggacgtattccctccattccagtttactggaagtttgtgaagagttgatctgaaccactaccatttctcacctgcattactgtaacaatctcttatctgatctctcagcatctacctgtcgcaggttgggaatgaaataggctagtgatcatttcctttattgaactctggataaagtacttctttttttttttgagacagagtctcgctctgtcgcccaggctggagtgctgtggcgcgatctcggctcactgcaggctccacctcccgggttcacgccattctcctgcctcagcctcccgagtagctgggacaacaggcgcctgccaccacacccggctaatttctttctttttttttttttttttttttagtagagacgaggtttcaccgtgttagccaggatggtctcagtctcctgacctcgtgatccacccgcctcggcctcccagagtgttgggattacagtcatgagccaccatgcctggcctggataaagtatttctaaaccctaaaatgtttatgtttggttttgtggctgtggatctaatgaagggacttgcagtcaagtccattttgaggccaggaaggctgcctcattagcacctcattgtgaggcctctgtgtcttcatccacatgtgaggcaggcagaaattgttgcctcacctgtaaagctggatgaagtcaagatagccccttttaaaaacgttacctttagggaagatgttgcttttctgccaagcatttcacatggattatttaatttatatggattaattaatttaatcctcacagtagttaaaaagaaaatggaggcatggataagtttagcaacttgcccagctccacagccaatgagtgggcagtaagacacgctacctctggcaggtattcagatgtgggagcatgctgcagagaggccctaccttactctctagcagactgacttcctgtcacatctccctgttttttctttttttgtattatttcctgaaattgcctttttctgtcttctctgctagaatgcctgagaacatcagttttattatccccctctctgtccccatgtccccagtcccttagaaccattggtaggtgataagcgaatatttgtacactgaattttactggctgtcaacataaaactatttgaatactgaaggtaaaatataaaattgtatcatttattaaaagaaaagtaaatttagagatgtttcagccagtgggagcttctgaatggcaatcccctgacctggggtgccttactgccattctctgctccagaagaacttgaagggacacccccgagaagtaccaggccacagggaggcactttgcatagaaatttgcagtgatgtaattgggatttagataagacatcatctctagggaaaagggttcacccaggatgccttcttgagtcctgatgacatgataggattccggtcactgtgccatgtcttttaactaattatagcaataattacttaattgattgatgtgctatggtctctatcacaatgtgagtaatagtcttagaggtgtcactcccgggtgaggtgtgtatgtaggttgtgggatcctgctcttctttcagttttgtaggtttcagttccaaaattgtggtacatctgaagtcaattggtttccttctgatatcctttctcaccttccctgtgtaggagaactgaagtcagccttaatttgacacaaaatgtttctcacctgtggggttttgaaggttaagagggtgaacttatttaaatgaacaacatatttttttttcttttaggaaaaacgcaaagctgaggaagccctcagtgacctcagacgtcagtatgaaactgaagtaggagatctgcaggtgaccattaaaaagctaagaaaggtaggcatgtggcagctggacttgtaggaacagcctcagcatctcagggtatctaagccattaacaaccaaaaacatttggaatcctattgaagtggcggatagatcagatttcagatttgttttgagactgagtcttgctctgtcacccaggctggagtgcagtggcaagatcttggctcactgcaacctccgcctcctggattcaaatgattctcctgtctcagcctcctgagtagctgggattataggcatgcaccaccatgcccagctaatttttgtgtttttagtagaggcgggtttcaccatgtcggccaggctggtctcaaactcctgacctcaggtgatccacccacttcagcctcccaaagtgttgggattacaggcgtgagccactgtgcccagcctgaaagaccttttaagggcccctgagttcctcttctgtttccaggggccacctgtcttttgcatagatttaataattattttctgatcccttcaaccattgtccataaaacttcagtttgctttccttggtcttcaccagcttagtactctcaagtcccttgtgtctggtagactgcatgcttcatgactgtttttcttggtcatgtcaaatatccccgtgtccctacccctagcttattgcaaagtgcatggtaagtattcagggaatatttattaaatgaaatgaatattgctcttctaagtagaaaattccagatctagggtaccctgatcaccaagagtcactagtttttgaagaagagcagaacttgttgaagtgtgagcaaagatgtgattagtttgtttgtttgtttgtttaatgtggttggtttttggcttttcctctatttggtttctaatgagcaggttgttttactcagtaatactctggcagttgtttaacaggtggctctatagtgggtggaggggaagggagggatgtgtatcatttgttgatttccatggtataaatactcctgtcattactgatttcatgctaccaagttgatgttactgaatttaaggttgagaagagatgcttaaagcagactctcacctgctggtacaggctggctccggcactgtactagacacacttcttggatctgtttttgtttttcccataactaatggggatgtgttagctaaaatgaaaatggataattaaaaaaggatcatccttgctgggcatggtggctcatgtctgtaaacctaatactttggaaagctgaggcaggaggattgcttgtgctcaggaggtcaagaccagcctgggtgacatagttgagatcccaccactgcaaaaataaataaataaataaattttaaaaattaactgcatgtggtagcacatgcctgtagtcccagtgactcaggaggctggggtggaaggatcacttgaagctgggagaggaaggctgcagtgagccatgattatgtcagtatcttaaaaaaaaataaaaaatcatctctgaaagtggtgatgagactaagtggcaattagctatattttgtattttatacactattgcaatttaaacctctgggatgattaagaattctccccagtagcctccttagaaaatgaatatcaatttgaaccttatatctaattttcaaaagttattaggccatgcatactatgcttacattacagaattgaacagacgaatcttctgtttatgctagagccacaaattcactgagtcactgccctgacttatttctgtggcttcccaaatctttaaaggaatgtctacaagaagagatgcagcgactgatgaggcccaagtggtctgaacagtaagaaagcccatgtgtcaggagacctgaatccttgtcaaaactgtacccatttttccctgaagcacctcggatagttcacatcatctttctgatttttagtttctgatctataaaatgcaattattaaaaaactgtctttcctaaccataatgactgacattttattgactttgcagttcactaagctctttttcatgatttaaaaaatcaaattcttaaactttctctgaggaaggtataaatatcctacttttagagatgaggactgagttccagggaggttaactaacttgttcagagtcacacagctaataactgatgaagccatcttactacacagtttgtgctttctcacttattccagacttcctgcatgcctgatgtggttgttatgcaaaacagcaagatgtttatttgagagtgcattaagggctatagtttacaaatttgttacaattgccactaactgtgtccttgattctgagaaactcattttttcccgatggtttttcttctctgaagtcaaaatgcgtgtttaaatcgatggcttttctcagtcagagtcagcctcgtggcagtcatgacgttgttatgtaaacactatccctttatagcatctggcaaggtgaagaaggtccagaatcaaagcacttagacttcgtgaaatgtgggatccattttgatcagtgcataaacattccaataatgaataccaacagatccctaccattcccagaggatgtaagctgtttgtaggaaaggcattttgttgttgttgttgttgttgttgttctccaggttataaatgtgtggaaccaatttagtctggtaattgtaacgagtttgtagttgcaatagaaatgagtcaaccagcaagcaaagctcatgtagaaatgagttaatcatcaagcaaagcttaaatgtaggtatatataatcaagtgtgtttgtgtctctagcttcctgttatactcagattttattgattttagttatttaataagcatttcttaaactcaccatgaagaaaacataggtgaatctgacactaattctgctcttaaaaaatcttgctctgtagcagggaaggtaagacatttctaaataattgtaatacagaatggaaagtgttaaatgcagataatacgaaggagaataaaaagatccagattctaatgtagcataactgaaaaaagcaagaactggattgcttaatagttgaatgatttccaaaaaaggcttttcagctgtttccaaaaaagttcatttcacaacaaaacccctttttcaaatgtttaaattatttagaacaaaatttcaaatccttatggattttatgtagtttaatgatttatgaagttgcataatgttgaaaattggtgacttctagaattctcatatgtatattcaaggatagtcctaaacttaaccaaagcaattcaaagtgagtttgtaagcacacaacttttatttggtctttcagctcgaagaacaatcaaaacgcgtaagtcaaaaggaagatgtggctgcattgaaaaaacaaatttatgatttatcaatggtaagaattaccttttcacttacagaaatgcacttcctgttagaccacatcctcatgctcttatttcagtgttccaggaagagcagcttaaagggaagttaatactgtagttagaaaaagtccttaaaataactttgatcaaagatactatttatgcaggcttttccctcaataatatgccacttattgtgaaagcttttacttatttttcatacaaagtaataaagacctagtgcttacattttatgtaacacagttaaccctgtgttcttccaacatcagctctggtctgtattcctggcttagtgatgaggatattagtgccttgccccttcctccaagttttttttttttctgtcgcttttccatcttacgccagccacatctacttttagtactaacaaaattggtaacatttacatatcttctgttatgagttttatttagtttggttttagattaactctcaaatttgaaagcagataaagagcattttctttcttatgattctaaatattttcactgcagagctaagaaatgagtgaggcttgcatttctttctctccatttattatctctgatccacttagaaggttcccagcttcatggtcaaatgaattcctagttccagatttttccacatcttagtaggctttgtatttggataatgacattcttgtagagttatttgtttttcttggattttctggttgatttttttggtttcttcttgcaaaaagcactaccattttcatgatatcactgataccttaagacttatttagtctttccaatgcatgaaatttgtttagtttttctccttgaaaatattaattttggagtctataaaatttcagttttttttttttttttttttttttttgagatggagtcttgctctgtcaccaggctggactacagtggcacgatcttggctcactgcaacctccatctcctgggttcaagtgattctcctgcctcagcctcccaagtagctggaactatagatgcgcaccaccacgccccgctaaatttttgagttttaatagagacagggtttcaccgtgttggccagggtggtctcaatctcttgacctcatgatcacccgctttggcctcccaaagtgctgggattataggcgtgagccaccgcacctggcaaaatttcagttcttattggactgattgttttttaaacttgccacccatatgttctgcaatttcttttcactaggcctttcactgaattgcagcattttgcatattacaattttttgggaggagagggtttcatcctcatttcggcatagcacatcctcaagaaacttcttcagaaagaacatgtgagagagaaattttctgtttttgaatatttgagaatgtctacattccccctcacaatttattaagtttgtttagataaataggcttttttgggactcctctgtgatttattaatttaattatttctaggtaccattttttttcaactacctggcagttgttggtgatctgttcatattttaaaatgaaggactagcttggtcacttaaggtagctggtgtaggatcctgtgggacggtgtgaacagatatgctcacctgaaggcctttctcccgagagagtgtcttccaaggagctctgtgtgtgaagctggcaggggaccccagttaccggtgtgagtggggcagggatattcagagagaagccttagctttttttacaggagccacttagttttaaaaagataatctctgccttgtcttcagaatccactctggctctctgctgttacttgctagggtaagatagggaatgggcttggtgggaagggtggcttactatacagttttaatctctctttccaaccccatatctggttctgtctttctggggttcggcccggtcacttgtctccttctggattctgtgtcaaaaccttaaacacacttcctctaatcttccatttccccactctgttccctttggcaacacatttccatcagtttccactttctagaagtgcatttaagtcacttgaatgctctgggctgctcttccattcttttaactgttattggttcatttcctttggcatttcattttagtgaggttttggaaggggaaaaagacaaattcatgtgctccatccaccatcttgaacgaatgtctccaatattattttaagaaaatacagaaattttcaaatcacactggtttatttttaagtgtaaaacttaaaatattaagtgatggaatttatttgtaaaaagtagccagtgtacctggtaataggtactgttgattccacaaaatgtttatcaataattttaaagcgctcattaaataaagcaagcattcgaatggttggtgtcagttaatttgccaataatgtgttgaaatacatcatgataaacccttgactgttgtagtttggtgtcaaatatcaagcataaaaaaatgaagaatgactttgagggttttgatttttgacactttattaatttatattgatttcaaattaccttgaattgacaaatagttgtttgaacactgagattttgaagagttgtggaagggtgagagtggtgtgggagggtgacaggacactttacttcatttctcccaggcagaggaaaatctgaatctaatgacccccacttttcattttatccaggaaaaccagaaagttaagaaagaccttttagaagcacagacaaacatagcctttcttcagagtgagttagatgctttgaaaagtgattatgctgatcagagtctgaatactgaaaggtatgaactttgcattttatttgttagtttgagtagaatattgagatgatcatccaggcaaaagaagctcagctatggaataatgaagagttagtaactttgctaatatcttctttactttctaatgattttattttcagtatcaggtttcctagtgttttttatgtttttaattttttaagcaaatagaataattattgtctgttttggctagtgcagggcttaataaatgtttgaattaactgggagctaaaagaatataccacagtgtcaagggttagtacttattaaagtgttttgaagtcaggaatcctggccataaaacataagaaagggaaaagtaggcaagtctattttcgtgtgtgttagttttgcagtatggtgttaataccataaaacctaatacacatacatacattcacagacacgtatttatatataaggaacatagacatgtatatttttatatggatggtaaatataaaatgcatagatatgtgtatatgtgtgtatcccctaggacatgtacacttgggaaaaatatctttttttgggtttgtttgcaaactttaatcagaattaaggtcttacaagagaaaacagtgaaatattatcgtttactacatacaagtctctgaactagataaggagttatgagtggagagtatatatatatttataatctcaaaacacagagcccacgtcatatatatatatatatatatatatatatatatatatatatatatgatgagaacttcaaatttagttgggaaaaaaagcaaaaagattatagggtttaacaacagaagagctaaaaaatatcagaagtagtgccactaacgtagtcatggtttgggttaattgctgtgtgatcacagaaaaggttttgttttagttcagaagaggtgaagaactgtattgaagaggtgatgctggaggtgagcctaggtagaaagatagctctgtgctgggaaaggggagagaggcagccaggatggcaacatcagcaactcagagctggtggcactgctgcctgccaggcactgtcctggtccttcgcaagcattaactgatccagtccacagaacatctggtgagacagggaccttcattatgtccattttacagatgggaaaagagagtctcagagatgttccaggtaaggcagtaaccaaagcagggaccagaacatagggaaggatacggcttggggaaaggtggtcagaccacagggcagaaagagacattttgaatagaaaagcaaaagtttaaaaaaaaaattaaaaagtttaaaagctagtttaaggttatcatagaaggcccccgaattttggtttaaggaacttaaattcctatagacaattaggaaatgtgtacttttatcatccagggagcagatggacaggttattgtgaaccaaacttgatagcctgggcattttgggaagctagtgatgaggtttgtatgctcaggggaataggggctggaggagagggccagtgttctgagcagtttggggaagaagccagagcttccatcataaagcaacagagggattgccacagaatgagtgtctcacgagcttagcaagcctggttctttggggatctctgtggtttaggtaaggagaggagggagagcaggagtagtgtgagatggaaagaggaaggaatcacaggaaaggagaaaatagatggagttgggattatataaggctttagatgagcagggaaggttcagaggattgaaggcacagtttctgagacacccttagaagagactcaggaggttcagccctcgtggagaacagagctgggtcagcgagcatggggatggaagagctggtggttgctgagatgggctgaggaggagaagctctaggcttgtgatgtcggaggcggggcagagactcacaggagaaagcacaggatgtgagtgtgtttgtggagtcgcagaaggagaggaggctgctgaggccacagaggcccagagcaggagcacgggaaagatagaaaactgtggccaaggacactcgtctttgaaaaaggtgggaaagggtctgggagggtaggtatacgtgaggcaggacttgacacctaattctcactcaaacataaaatacaattttacagggatctggaaataatccgagcatacacagaagatcgaaatagtcttgagaggcaaattgaaatactccagtaagtccgcagatcaaatgctcattacatttacatttcacttgttttttagttaataaaagacataacacatagaacgtgagttgccatgttctgaacactgggtttgcaggtcagtgggtgtttcttctcagggtgtgcacttggcatctcctcttagctttctgatgcttataatcctaaataaattattcagatgtgggaatagagtataaatctctaaacatcttgggaagtcaggggatatgtccagtgtgtctttattatgcctctataaagaaaaatggccctgagcactcagctttctctgagttctgtaccgtgagtttttttttttttttttgagacagagtcttgccctgtcacccaggctgaagtgcagtggtgcaatctcggctcactgcaagctctgcttcctgggttcatgccattcttctgcctcagcctcctgagtagctgggactacaggcacccgccaccaggcccagctaatttttgtatttttttagtagagacggcattttaccttgttagccaggatggtctcgatctcctgactttgtgatcctcccgcctcggcctcccaaagtgctgggatgacaggcatgagccaccacgcccggcccgtaccctgagtttttgaggcttctcttgttagtggggccacagggttctgcctccacaattctttctcagtttgttttgtttacttagaagtatatttttcttaggtttttttccctctccccaagtagaaatatacccactctgtcagctttatgactaggttatagcagttccatcctctgaaggtcttccccacaaaacctacccctctccttcccctttcttttctacccatgctgcattgtcttctggtttcagttcccctcaatgaagtcaggtcaggtttgacctttttttttttcaccatttttgaatgcttattaagtctcacctgtggcagttgtagagttcatgtatttcagtaatccttcaagttattttatttattcattcattcaacagatttgtcagcacctcttacaggccaggtatgccaggagcaaaggatagagtgggaagtgggtgaaaaatctctttccccttatggggctagtttaggggaagaagacagaaatggatcaataatcatagaaataaatataaaaggccaaacaagagagatgcagcaaaagaaaggtacatgtcccctaaggggagcattggcctatcaaagaaggtcaaggaagtgttctggaggaagtgaggattgagctaagatgcgaagggtgaaccagccttaagctggggaaggttagccactctgtggtgtaggagctgtggaatcatagctttgctgtacaagagggcgctgaagctctgacagcttgaatgacttctgttaagtcatatggaaataagagttaggatttgaacccagacctgactgagatcatcacccaagtgtttacctgctacacgacggtacctggtggaacagtgccaggctgtgcatagaatgcaggagctgccaggagcatgaagcctgatataacacactgcgttcatccctgacctctgaaatgtggtaactggctggccaggttcaggcatttagggagctttgaaagacctgcatgaaatctgttcaatcagcggggctaccttaaggaagagtgagttccacagcatagacagttgattcctgcaaggccctgagacctttaaagagagaggagtaatcaatttagttcttgtactttaagtaatgaattatctcagtttttgaggtttgaagggaagtggtggaaagttgcagaagatgataagctattccacattctgaatgttacagctagaaaagaaagtgatgacagtgacccccaatgatactttccttgtctctctttctgcttgtttctttaccctgcagaacagctaaccggaagctacatgacagtaatgatggccttagaagtgcccttgaaaacagttatagcaagttcaacagatctttggtatgccacatagttttaccatgtatttcattctttctagtggtggagtattttggtgttgatgaaaataatgtaatttcttaaaggagagcctcaagtaagtccttataataatgagaagatctttccataaaataaaacgaggcagcatttttccaaattaaaaaatatgctactcctctgaagaaataagtgtctcaatgttaaccaactctttttatagatgttctaggaatctagagataggtgtgtaagatgggatctttggcctgaaagagtttagacttgtgagtattctttatgccagtgagatgctcagaatgggagccttggatttcaaaccctcctacagaaatcagcttagctcatttggaactttaaggacctctcccagactgcatttgtcataagacctcttatcccacttttggaagtcagcttcatgtgtaagattccagggtcgtattgggatatggaggagtcagtcactaagccaaattatggttcaagaagagacacattcaaggaagttgagttgcaggatcctggcaaagtggggaaccatagtactcctttatggaatatgcagtagggtttggacgtaagataggatgaggaggagagcgtactatggcagtcatcttcgttgcaatgtttcccttgattttttgctcacatttgctcaggtagtgtaacaaacttttagttacattagaagtttgagtagtgtgctacagttttaaaaaatgggtttgtgtgtacctatgtgtatataaaatgtttacatgaaaattacatgaactaacaaatgattacttctatattacagcatataaataatatctcaccagggaatacaatttctagaagcagtcccaaattcattggtcattcccctcaacctctaggctatgacaggtatgttaactcgtcttaactttctgttcaagttcagaatcacagttaaaaggaaagtaaatttccttggaggtggattaaaataatagaatatactttggtcactaatttatattttctatgatgttaaaagttctgaaacatgaatcatgtaaaaattaaaagtgtttcagagagggcaaagttatttcctgaagatgttatgagttagttttatatatgctcatcattacctcatctctaatcatgtcttgtttcttagaagcagactcaataagagatgtttcagggaaaccagcagaattatagtatatgatgctgcagtgtttctggtatataatgttgaaactattggcatgatctgtaaatatttaatagctcagcataatattatatgagctatgttgcagaaaagggaaactctcaaagcaaatataaatatcactagtagatccttgtaaaatagctactgtattgaaggagtcacagaggcttgccaaaagttagaatttagccttgtgtttaatcaaatgaactgaaatattaggccttttattacttgagacctagtaatcacttagagattacatgagtgtatgtgtatgtttatacacatatgtccagtgttgctagttaatttagtaatatgtcaaaaatttgaaattagaagtgaaagcataaacaaaaagtttccgactctctatttctttgtgactttcagattcacgttcatccccttttcatttgggtacttttgataaaaagaataatgtacttaacatcctggtgttagaaatggtcaggttgccatttaggaagacctgttacgaaggcttattggtgatcatttctaagaaaattgtatcaggtttaagtggtttctactgttcactgattagctcaataaaaaaatttaatggcttgatttatagatggctgactattctgttattgagaaataatcgatttttaaaaatgtgtaggtgtgatgtcatttttgactaatatttaaaactgattctaagcaaattggggggaaaggtatacaactgaaaagtatttcagaaatttcaccatgattcattttggaaagattagacaccatgaaagcctcataagaactggagtagagctcatcaacgaaagattctaggggacaaagtcatcacgtccccagcatgtttgagtgacgtagcactcatgtgcctacctccttgagctgtaatgagaggccaccgtagcctcaacaccatgccccttctgggtgtgtgtgggggggtgattattttgacataagaagataacattttattttctttttgatgctaatataaaaatgtaataaaagcatgttgtacatcagattagatgtacaataaaattgtattgtttttatagctttatttggttttaactttaaaatttattttggctttgttcttcgcaagaactctaacaaagatttaatttgttttgtacttttacatagttaattataatgaaattattgagtgttggcaagatggttgactttgaaaaggatatgcagttcaattgagtttgagaaagtttgacctgtacctatgtttttatttttacttttaaaaattttcaacttttatttaagattcagggggtacatgcacagatttgttacatgagtatattgcataatgctgagtgtgcctatattttcaatttagagtctagatgtttattcaggtgaattcttaattcagaacttgatgttttctttgctccttgtcaaaatacaagtaggcttaaaataaatcataaccagtaatgaagacatggaactgaagtagtttgtagtatattataattagaatggttttcttatgtgctttatagatggacctaaaatcagtttcagaaggagagttttataaataatgcaataatatattggcaatatattttcattgttattgttattaatagtatatattaacaataaataaatattaaaatatattaacaatatattttattgttattgttattaacagtatattaacacacacacgcacacatgcacacacgtagctagctatatagattgagttatgatataaaattcttggctcagaataaagactttgtaattgagcagtattgagagagagaaagttagttacatcatctttttaattaattttaaacatttgctaatggcataaaaatacttttgacttctcagatttacatggctcacacttaattatattaagcttaccttctctcatctaagcatatccacttcttgtttctcatatctgaagacctatgtatcgtgcccattctccctttccaatgattcgtgtaagcaaattggtagggtggtgcccagggtgtagtgggtggtaaataagtcataaccataattggtaaacttagattcttatggaaatcaaatggaaaagctaaagtaaacaggaatgtatacagtttcttatgattctcttatttgatgtgaatttctccctcacttataaaatcttcagagtttcactaatggtaagatctatagaagtcaggagttccagcctttatctgaggcacctccctccctatgaaacgtctcccagaggggtgtttccagacggtgtgtcaacatttagtggcagaaaacttacgtgtcaaatcatacattccagtcatgtttctaattgcttatttttatcagatgtttctaattgcctatcattttttgccatgttgattagaaatatgacacccagaaaagcttatcttattttgtcttgtgcaacctgagaggatgtggtcttcttcatgtatcagctcttcaagtatttgaagagagaaaccattaagagttaagttgagtacactgaatcttatttttcagctctgagggtcttgagtctgacattgtggttgccttttctgtttgggctctcagcagcccttttaagtagagatgttatccagaaatggacacaatgttcagaatatggtctgaccaccttagagtaaaaaagctcatatattctgcatacatttttatgaatacaacttgcgattgtgtttatgtcttaggtactctaattctttttgtatcaggaaataaagaacattatttttttaatggctttgtttgttaagtgtttgatgtaaggttctttatcttaactgattgctgcatagaatgaactgatggtgctttgagcattttatttcccctaatgcctaatcatgaaataacactgcggctcttagccacagtcggcctacttgattccatctaatggcatgtggtctattgcctgtatgttcttgagcatttccagccctcaggtaaattggtcttcccctttattaccaggtcatcccgctcttcctatgtggatgaggactgtgactccctggccctctgtgatcctctgcagaggacaaattgtgaagttgacagcctgcctgaaagctgcttcgacagcggcttgtctaccttgagagatcccaatgagtatgactcagaagtggaatacaagcaccagaggggatttcagaggtcacacggggtgcaggagagctttggaggtgatgcttcagacacagatgtaagccccagaaaccactgctctcctaggccttctacgtgattgaaatctgtcaccttatttgccttctatctgtcatggaaatctgttttaaaggtcatagatgtaaagcatagttagtaaaatgctttttcctccacagagttagggagaaattctcatagattgccattcagtgtcactctattccctaatattaatagcattgactgttgatttagctgcatagttttcttctttttaatccataatgtatacattttagactttgtattttaactgctgacattttttaatttaactgctgacattttaaaaaaaataggttcctgacataagggatgaagagacatttggtttagaagatgtggcttccgtcttagactggaagccccaagggtctgttagtgaaggcagcattgttagttcatcaagaaagcccatctcagcactctcgccccaggtaggtggtctccgagacactcctattcatgaacactgcttattttctgtgcagtgttacttattaggatgaaaactggcaataccgttatcattcactgtggcttttccccccagacagacctggtagatgacaacgctaaatcttttagctcacagaaggcttacaagattgtacttgctggggacgctgcagtggggaagtctagtttcctcatgagactttgcaagaatgaatttcgagaaaatataagcgccaccctgggtatggctcgtatttcggttgataatgggaaaatgaccttccttagcttgattttctcttcttcagggattacatacacagatgctcagttaacagttttctctttctctgtgtatgcacacatatataaatgtgtgtgtgtgtgtgtgtgtgtgtgtgtgtgtgtgtgtgtgtgtgtgtgtgtctcctagtctatggaaaggtctttcttgttttggccaaggcctgcttttaggaaaggaagattaaaatgacagagatatctggctgggtgcggtggttcatgcctgtaatcccagcactttgggaggccgagccaggcagatcacttgaggtcaggagttcaagaccagcctggccaacatggcgaaaccccatctctaccaaaaatacaaaaattagttgggcatgctggtgggtgctggttgtcccagcaactcgggaggctgaggctggagagtcgcttgaacctgggaggcggaggttgcagtgagccgagatcacaccactgcacttcagcctgggtgatagagtgagaccctgccacaaaaaaaaaaaaagagagatatctgcttagccaatcagatgaattgaatcaaatttagatcctgagatatcagattcatttattcagcatgtatttcctgagtcccactaaaaacaagatgctgttgtaggtacaaacgatacaccatgaagaaggctgacaatcccagcctgcactgcacttacatcccagtggagggaaaaggtacaaaaaagaagtttagggagaggtgcggttttacgcagggtggccaggaaaaccctttctgctgaagtatttgatgttgacaaagtgacaatatggattgccactttgtcattatggtcaaaatcatagccagatatatgatccgttacccaccttcacaacagaacaatagaacaagtagtatcctgatttcccaaatttgcataatagtaaaaggagttgaagatatgcaaattatcatttatttttcttcttcgtctaaagagttcttattttgatcacccgaaatgttagaacagactgattgtcctcttcacatgagtgtctttgtaaatttatggttctctgatacactcttcaacattaacaaagctgaaagtttacttcaatttgattcataaaaagactacatacagtatttggttcagttgtcagagaccatgatgcatgtaaatgtgtgtgtgcactaacgtgtgtatatatacacacgcatatgtatacatgtttagatatacatacatttatacatatatacctacatatacatatacatacatgcatatacacaaaacacgtatctgcacctacacacatacatacacacacgtatacacctgcacattcatgcatgcccactcatacacacatgtacacacacccacacacacacacacacaaatatgactgagttcatccagtcatcagggaaaataaaacagatttttcccttggctcataaattaaatcattccccaagtcagccaacctgcagatggtgcctctgcacacacgtgtggtctgacttgtcattcctatttgaaggtcactctccttaaaggtcatgttcattcctccctccctggctgagctgtgtattattggcttttgcttcatctaaagaaggcttgaaagtaaaaagccaatggaattatttacatcgtgctctccactctcacattccttttcaggagttgatttccaaatgaaaaccctcattgtggatggagaacgaacagttctgcagctctgggatacagctggtcaggagaggcaagtgcattccgcagcgctatgggatatcctgggtttgcattaacaagccttgcaggccacttgatgttcttcatactcaaaattctataattataacatactttataattatatgcataattacatgtataattataaaatgtattataactttaaaatgcttatattctcgcacatctccttcatttacctatgactcctgtgagaagaggatctttaagcttcttttgagctgatgttcagttgagacagagagtgccctttgctaacatgagaggcagcatttttgagtgcagtgacagcctgaggaactccctggctatagaacaataaatgatggagaagagaaccagtcagctccccttgattaagggcagaggcacaaaccgcatagcagacttgcatttggtgatggcactttaccttgcattcattaccgataagcagagcattaagcacagattttaatcttgtttaactccttcggaacaaaatccattcaattgttcaacccgtaagtatggggtgcctgcctctgtaccaggcattattcagcatgctgagattcagtggtgaacagacaggcacaaatacctgcccccatggtgctcatattctctagcagattgggaatttcaacatataaaaaatatttgtggttgacatgactgtatttaaaatacttataaaatattgcactgggtttcaagttagggcatgtgtgttgaggtgttctcttcccaaggtgaatctcctgacccccatgtatgtaaagtcctggtatgttacagcgttccacactggtagttcctccatccacccacaatactccctaaccaccaccaccaccaaaaataagtattctctagttcgtatctccttccagcctcctctgtgtcccacatgtgggttctggtagcttgttgctgaggttgaaatttttggaaactgtgctctcaacctttccctggttgtgctctggggattgtagacattcttggggttgtttggtagagagaaggattggattttctaagtcggtcacccagattctcatcatgttacctttcattgggtcattcgagacctttgaaatgcctatgtctcagtcatatattgcagttagagtcttctcaactggtgttgattttagaagaggagaaaaaaatgagcataaaagagaagaagaatgaggcaacacaaactgactgatgatgtggttttctctttctcagattcagaagtattgccaagtcttacttcagaaaggcagatggtgttttgctgctgtatgatgttacatgtgagaaaagctttcttaacatacgagaatgggtagatatgattgaggtaagaaatcataatggagaaacagaaaattacacgaggaagttttaggccatcttggaaaatgctgtctctcttctttgtcagaatgaacttgattaggaaccattgatccaagccatcaggaagaattggatgctacaggcagaactggcagcattcatctcttcctcaggatttgggcacatttccctgaagccaaggacactaatgaagggagctttggggaataaaacttctaggttttcttatagataaaatcagaatcccatcgtaagcaagtaaaaatccaggtagcctaggaagaagttattacaaacaaggagatggtgtggttggttgtgtagtgtagttgggggcatgtgggggcatccacgggcatgggaagtacaggtgaaacaccacctggatatgagcgtgcgtcaagtttcaaattgtatgggagctctcttctcttctcaaccttattctggtagtgatttgggatctttagatgtctcaaggtactaccgaaataccagttgatattttaaacatgggcatagcttctgtgctttctgtggttaaataagatgatgtctttcacctaaggaacattcctgtcctctggtttcatggtaaataatttttaaaagtaaatgattttgaccccatttagcatgctgccaacagttactaacataacactacagttccagctatggttcagcatgctctcttgaaaaataaacttttcaactaagtatattaatacaacttttcaactaagtatattacctgtaatttaagaaggcattaaattgcagtagtggctgaacagaggactggttgctgtctgatctcaatttagcttctggcattattgttctctttctaactaaagaagtagtgtgagaaatgactgattgcaattggcagtaagactttgacagtgataaataaatatgcactctgttctaccaacttatcatggcttaaaatgattgtaaacacagtgaaagtgtgtttacatttatgtaacatttttacttcacaaaatttcccatgttatagtcatctctctagcatctgagaaatgaaataagaaaacatattatcctaagtttttatgagaaacttgaggcatagaaagcataggtagctcttgcttagagttatttagtggttaggaatagaataggggctcaaaccgaacctcctgattgaacagtggttgctgttttgatatagcaccagtgtgagcagaagattacttgaagaagcctctgatatcaagaaggaatcccaaggactataattccagcactttgggtagtcaaggcaggcagatggtttgagccgaggagtttgagatcagtctgggcaacatagtgagaccccatctgtacaaaaaatacaaaaattacccaggcatgttagtatggacctctagtcccagctgcttgggaggctgaggtgggaggatcacctgagccctaggaggtcgaggctgaagtaagccgtgattgtgctactgcactccagcctgagtgacagagcgagacccccatctcaaataaaaaggaatcccaaggtataattagtgcatagaggagcaatggctactcaagtgaacaaatggagatccctgggatggagcaataagtccagagaataacagataaccctaactcatccatactagtgtttaaaatccacagcaaaactgttttattgttgacattttggattagtctttatttaaaatctttgggttatgctcaagaaaaggaggcacaaaaggcaagatcagccacagtgaaataacccttatgtagagtggcccactgccataatttgcaaagcaacttcacacgttgtcatcttttccgccattggtatcacgttttcctatggtctgaaaaggaagaaaactatagaagagatgaattcttaagtttgttatggatgaaaaattacatactactaatggcatttgactttcaccttagaaaaagaatgagcacagtgaagtttctccatggcttactgtttctaatttgaggaactcctacagggacagtttatatggccactgtaaatatgggcggaaatgaatggtgtgatcattggggtaagccagaggattgagaagctgtagactgtcagcggtgaacagaccctctgaattaataattgatatacttcaatggaaaactgctgagttaaaaaatcttgtaatagaattatggataaagtaaaattatagccatttgtttatctgtcatgaatattttattgatcgaatatttgggtaaaagctgaatggagatacttgagatgtaatatctcttcccagttttaacacattcaaaactattttttgaggatctgcccggttcctgtgtagtagtctaggttctcgggatatatctgttaagaaaacagagccctgtccttatggagcttgtgttccagtgggggagacagatgaaaagcagcaaacatagatcaataaatgaaatgatatggtagaaggtgataatgttatacaaacaaaacgagagcaggttaaaaggcctgacgataaggaagtgggctgtggttttcttcaaggtagcctcactgggaaggacatatttaagtcaagacttgaaggaggtgccctttacctctgtggctttgagaagtcatttagatgcctggattcttgggcttactgaaatgaatatttgactaataactttcaagtgatgccccttgcatcctgaggtcatcaaagaacacaattaacgagcgcattaatgagcgaaacagctaattttggagagggccattcattccctttcctttgattttattacactctggagccttcagtccaaggaaagttgcctgaagagaaaggaagtcaatgatgatttcatgttgaggcacgttttttgatcctgtatcaggaatagccccaaacccaatgagtacgcaggtatctttagtcactgcaaagagtaatttccacatgttttcatcagggctgccacttctcttatttaggaaccagaaacttgtgtttctgtgctagtcaggttgtcttcttgtattctcatcatagcctgctgaggtgggaaatgccttcattcagtccttcattttacagacaaggagactggagcggaaagctgcagagacttgcctgacctcacacagccagtgggtccagctggtggagggctgggtctcagacttgcctctgccacactcatctcacattctgtgagcttcactgtgactgtgggaccctgtgacaattgcataggctgacatgggaggcttatcttagaatccattactttgaaagattggtacttgactctttcttagaaaaatgttgaccttcaggacttttatattttgcttttgttgtaaaccagagagcagtgagtgtggaacttccaaactccctttttgtttcattatagttgaaaaattactgtgtgttttataactgtaataatgaacttggcttgtgatcactattgtttaaaataacagttgtagaaaattatgtgggcagcacagccaaatatgattctgtggtcatgccttttgagtttatattggcttgtagtgctctgtgtgctggagataagaaattaacagatatgtgtttcctttgccataaaactgattaatcccagtgccttttagtcttttcattaacctaaggatggggcattatatagaggcaagcgttatggagttagtttggatccaggccctgacccttataccttcttatttaacctctctgaatttcagttttctcttctgtgaatgggaaaatgtatggctgtttttagagatactttgaggtttaaagatatcctctatataggatttggcacaaaggaggcaaagggaaaatggtaattgctgttgctgttgttctgtggtcatcgtaatgtgtccagtgtttgatgtgtgccccattttttttttcttcctggtaggatgcagcccatgagactgttcccattatgctggtaggaaacaaggctgacattcgtgacactgctgctacagagggacaaaaatgtgtcccagggcactttggagagaaactggccatggtaagagtgaggatgcctcagaattagaagagaacatggggtttaatggctttgaagtcggtggcctttcacttttgtctacctttgcttgagaggtcctttgacaaacctcccccgtctgaggcatctgtccttaacacaggcaaaactgccatgactcccacctcttttatgccaaggattaagtcccttgggaaaataaaacaatcacataatcattttctcccattgagtatcattgacagaaaggaacccaaataatcccatcatcttcctcctccctctcacctagttcctagaaaccttctctagtcctggaatccaagtaaaggaagaaaatagtgtcctattttgaaaagatggctttggtttcagagggttataatgccaaaggcagaagaaggtacagtgtctcacctgtgtggaagggaattggatgacttcttttcttctctaagatttgtgtttagttgatataaaaaatcattcccatatacaaatgcatatgcattttggggtatgcatttgtatataggaataaactcattcctattcagattgttgtcatgggcagtgtttattctcccatcagtgtcatctgtcatcatgtcagaatgctacctagctctgttatgacctgtcttacccatacaagtagtcagatgcactttgggtcaaataaattaatattgcagcagtctgatttgatgttgatagtgttgtctgtcgtcagcaccaggaaaggactactctgtagcatacgtatgtgaacttcaaaaagaagtttcagttttaatattttaagctggaataatcgttcttgttttaaaatttagaactgcaaaccaaatgtgataaatgtcaaaactaggcaatgaaatgcagaagagattcactcaacccatatttattggtatccaccatgtaacaaacacttcattgtgtgctgggccaagagcagagaacaaagcaaacagtccttgccctcgtattgtttactgtctgagggagacagatgttaaactcatgaaatccacatgctagacatggtctcacacagatactttgaaatctagttattcttggctgcctgccagctttattccctctccatgatttcgcagagttcccaaagtttgcttccttatgcatctcttgacctccacagtcctgcatcctcaaaggcagtctctgtttcaccccatatcatcctggatgtagaagtcaacaccagcactgatggtttctaccagaaatgcatttactttgtggtgtttgcagattttctatggatttgtgggcttacgagtaaaggtcccattgtggcatttttccccatttcctggcttttctcattctccctgttctagagcaagtgtcacctccttcccttgtcccacacaggactgtttaacccacacctaggcccacaacacttagttctcctttattaagagaaaatgtctccagctagtcagacaggcacacaaaaataacttgagcaattataattgtggcaattgctgtgcatgaggatcgcagagtgctatgaaagtttatgatgggaagtcctaatacaaacttttcagggttaggaatgactgaatcttaactgcaaggaaggattacctaaaaatcccaaaagtaggtaggtgtcagactggtggagggtggagggaacctaggtgatgagaagagtaggtgcaaaggtcccaaggtgggaaggctttgcggacactggagaattagaggaaggccagggaaactgcagctctgtgagtgagtgggggatgagtgaggtgggaggtgaagctcagagcttgcctggggccacgtgaagctgggcctcattggccatggaaaagcattttcacattacctaaagacaaacaggaggcattgaaaggtttgaagcaggagagtgacatgatatcatatgcactatggctgggaggttgaataatagagaactagaacgtgtccattggtttcagcaaacgtggaggctgctggatccagaagggaaaagttagcgggaaggagggtgtgttagctgctggccaaagggaaacagactcttgatggacatttaattcctgagtggttaccttgaactcatttttatctgtctcggaatatttgataaagaacatttggtagcatgtgttttgactgttggaaataaaaaccttcaaacatgaaatattctatttttttaatgtaaagtaaaagtcctccaactaggaacttttcctggagtaactatgcttaaaccattttctttgtaagtactggaactctgaattcagtttcttagctattagttactcttagcatgctcagtaggaacatatttttattttactgattttaaaagctaaaatttcaggaaactcaatgaagggcttcatttaattgtgtgtatttcttttttacagacgtatggggcattattctgtgaaacaagtgccaaagatggttctaacatagtggaggctgttctgcaccttgctcggtaaagtttgggaaaatggatgtaggattgaattttcgcttgttgcatatgacacatttcttgtccataatgtgcagatagaatatatgcgggaaaacactctcttatctgtcagtcatggtgggagaaataaatatgtggatattataaaaactggcaacgttgctgtcaacactggcaaaatatctttactaccaaacaaaagaggtgcatctgaggtgtcattgacatttctgaaaaatgtcaccacaaagctaatagttgacgtgtatgaatcatttccaggaagcagattttatacacaagggactattatgaatacaactgtctattatgatattttcccgggcaaaaggggaaaaagaaacaaagcaatttgtatgttatgccagttagaaacactttgtcagaattattacccaggtaattattaagctaaggcaatagtgttaataataaataacattttggatgtacaatagaatgaaaatggcatcattaaagaacttggatataaatgtatgtgttttaatccttgaagtaattcttaggaaataacattctacattagatttttccctcctacctggttttctgctataaatgaaaagattattctttactggcctagagggattaaatatcacaaaaaggaaaaaaatcaaaatgtgcaatacaaatttcagagcaatcatctttaattgcagacaaagttaaaatataactttaggcatgtcattctttttctgattatttgtaaggttttataagaatcttaattttagtatgataattggccttttctgctagtaaatattgatagttaaaatactttgcaatatctttaatgctgtttttcaattaatgacttagggccgggtgcagtggcccacacctttaattccagcagatcccattggtttcagcaacatggaggctgctggatccaggaaggaaaagttagcaggaaggaggatgtgttagttgctggccaagaggaaacagattcttgatggacattaattcctgagtgattatttttatcatttttatgagaggcaaggctggaggatcacttgaacccaggagtttgaaactagcctgggcaacatagtgagaccttgtatctatttaaaaaaagatatacacacacacacacacgcacacatgcacacatacatatacatatatacattaatgacttggcatttatagtgcttaataaattagagttctattaatagaatgtttggactagggctacaggataaactgttgccctcacttaagagaatcaggaaatggactttgggagtcctgcttggcattagtttgtggcagggttggcagatgccctgtattcacactcaagagtcttcgaacatttccctctttgacatcagtccaggagagagagtcacctccccctacaacactggaaatcatttttgtttaaagcaaaaacagtgctaaccttgaatgtgacctagcacattttttccttttgcattaggctgttttgtgcatctctataaaggaatacccgagactgcaatttataaagaaaataggttcaattggctcatggttctgcagtctttacaggaaacttagcactggcatctgcttggcctctggtgagatctcagggagcgtttactcctggtggaaggtgacggggagccagcgtgtcacatgacgagggagcaaggagaggggaggggctactctcttttaaacaaccagatctcctgtgaactcagagcgagaactcactcatcaccaagggatggagctatgccattcatgagagagccacccgcttgattcaatacctcccacgaggccccacctctaacaccgaaggtcagatttccacatgagatttggaggggacaaacatccaaaccatttcatcttttaaaagaaaaaaaaagtgaatatttgaacacatatacattcaactaaattagatgggttattttgtgtgtttttttgtatgtttgtttgtttttggctgtgaatagtaggagaatcatggactaatatcacatttgtgcaaaaagagtcagagtaaaacttttatctgtcgggttgaataacagattccacgcacttatgggtgcacagggaacaccagctattttggctcaacaagctacattcagtaaagaggggagagttcagtaaaatgcagaatttgacttcactaaagatcaaataactgttggattgtcaggtttttacttttcaaatggttgtgttggtgtttcattcataagttgctgggaacagctggatggaagtgatatagttgctggcacagatggcagtggggaaggatctgcaggtctttggagcatccctggtatgccttagccttggtcagcggaacactgcattgctgctcccatgcagcagtaacagatgcagcagatcaagccttgcatgtggttactagctgctccccagcatattggaggattatggtgtcaggaggctcaaagtccattcttaaatctgtttctaaatagctatgaggtcttgaacaagtccctgtatttcttttggcaactctaatctgtaaaatgagggaggggcctaaaggaaatgatctcaaaggtcctttctaattctaagagcctgtgactctgtatatgacagtctgtactccactgaatatcttaatcattgtttaatgctcagttgtcttatggggtcatattaaagttatatggctccaaagtgccccggtgaagagtcgattctctttattatgtcataaagatgggagaggctgtaagtttcctgtgcctttctccccatctgctcctgtgtggcatgttgggtcagccacgtgttggccctgcttacaatgaagcttcgacactagcttgtgtgtgtttacttaaaacacctggtttgcaaaagaattttgataactaggttatttcagctgcataatggataggttatagttattttaaaaagctttagacaagtaaagaaataagataagcttcttgcgaatcatttatcatagaggtttttgttttattgttattgcattatggcctggctttgggcttctagtgatgttagtgatgtgttaaatataaaaattataaataaagcaaacatatgaagaccttaattgctttatacttagccttcggattggcttttcaaagtactcaacccttaaatggaaatgttatagtctccacaggtaaaattaccatttgttgaagttttacaaccttgggaaatttatgtataatgcaaaacatatatgttctcaatttagatttcatagggtgagatcatataatgtcataaaactaggagaaggtatgggtttgcactgtctcaaacaatttatttttaaagggaggccataaatatttggttaacaacctgaactactctgcattttcttagaaaatctttcaatcccaggaagagtttctcctaggaatgcaatttctatatagtgctgataggtcatcgttcataaccattgtcccattagtaagtaaattttccatcaccagaaccacaggctttaaacattttgcagtagattcaagttcaagaggcatttaattatcaactgcctgaaattggagaaaaacacaaaaaacttaggctgatgtatcagttcagcatcagagctgagcccattgggtgtaaatctgtccataagactgagtcaattaaactgcagttgttaagcgtatggtagattttggtgagccctaattttcccagccttaaatctgttttagatgtttggaattgtatctttataatttccttaaagtggagcatgcctgcatttttggctgaaggccagatgaaaatgtgggtatatactttcccccttaatatttgctttcaggttcaataatgtctgcattattggcacttaacacgtgcatagccccatgctatgttcaatagagacatcaagggatttaaagactggccttgtaatttaacattacagaaaagaacatgacaatatatgaccaggcagccatatggtacgtagctgatagaggccattggatctacaagaagagagagatgtgaattgttcagtgaagatgctatggttattgtacccattttacagaagaggaaattggaaattagaatacttaatctgcttgctcagtgacacagctagtaagtggcaatgtgaggactcttcaccaccaacctggatcactggcttgctgtttaaatgttggtaatctcagggtctctgactgtcctctctttcttttcactctctgtctgtctaatgtcttccatccacacagcttctggaaccatctctacctggtaacttccagtttttgtatttttaacccctcacgtctttttaaaattccataagcatagagtgaacccccaccggaaacgccatagccatggtgactctgcatatccaaatcctggtgtgttcatgtggctttaagcttgttcctcagtctgtattccctttctctggaatctaccaaaattataattaaacaatagtcacctggagtcagtcttgattccttttctctcttgcttcaccccttgcctccagtggcttctgaaggtcatctttcagtctcttttgaatccatgcatttttctcgctttctccctttttctgctttggttcaggcctcaaaattccctacctgggctagtgcaagaatttctgcctcagggtttctccaatatcagttcatcctctactgtggaatcaggtaatctttataaataaagatccagttaatatttactttcttgcgtccaaccccacattggtgtcttactgaaaacacagagtcccagctccttagcatgtggctgatagcccatcacagcctgatatggtttggctgtgtccccacccaaatctcaacttgaattgtatctctcagaattcccatgtgttgtgggaaggaccccgggggaggtaattgagtcatgggggccgatctttcctctgctattctcgtgatagtgaataagtctcacgagatctgatgggattatcagcggtttccacttttgcttctctctcgtttttctcttgctgccaccatgtaagaagtgtcttttgcctccccccatgattctgaggcctccccagctacgtggaactctaagtccaattaaacctcttttcgttcccacttttgagtgtttttatcagcagcgtgaaaacgaactaatacacagcctgacctttctggttgaatttctatctctttttcccaaatgaatgataatctgtagacacagcaaacttcatccaatcaggccaagctcttatgcctctgcctttctgcatgctgttccctgcatctggaatctccttttctgttctttcaaaaggtctctccaatgtcaaaagtctctatgaagccccatttccgtgaagcccacaacacatctgtgggcacagagtgcatctgtggtagctgctgtctcaggaccatgaaattatttatttagacatctgactctcccttaaagctcagtagctgaaggtcccagagcctggcataagttgggcatttattcaatgacagaacgaccaagattttgcatttggaagttgtgttactcttccgttgtccttgtaatgaactcccacagatgtagaggcttaaataatgcaaatttattatctgacaattttggaggtcagaaacctgaaatgagtcttcccgggtgttagggtttgaattgtgtctcctctttcttctcctgagtctctgttgcctcatctgtgaggtgaggatagtactactcacccatctcctgtcgggtgtgtgtgtctggggtatatatcaaatatgaaaaacatgtatattgcatttaccagctgtcctatagctagaatcagtttatttttttccctgctgagatgtcttctttccaattcacagtgcagtggatttcgaaaggtaggatttatcagcaccttctgcagctaagctggccagtttggtagccactagccactcacaatgtggctaatccagttcagatgtgctgtatgcattcaatatagactggattttgaaggccttctacacattatctcattaatagtgtttttattgaccacatgccgaaatgacaatatttttgctatactgggctaaataaaatatattaataaaattaattttacctatttctttttaccttttaaaaatctggctactaaataattcaaactgacatatatggatcccattgtatttctgttgagcagtgtggctctgctggagagacacagattcccgctagtttcagttaagtgcttcatcataaaccatcccaaaacttggttgcccaaaacaacaaccaatttttatttctcacagttggcagaggtggctggatgtcagccggaaagtttcttgactgcttttgcatgagtatctcctatgtttgcagtcagatggccaccggggctgtggctcgggctggatgtcagccaccagggtgcttctcgtggcttcactccacgtggcatctcagtccccagggccactctggtggcctctctccattgaggaaccctggactccttgaaccctggacttcaaagggggtagagattgctgcagccccgcattataaacacttgggtttagaagccacagaataccatttcctccatattctattggtcaaagcaggtggagaaccagctctgaccaagagggtaggggatcaaaccttcacctcttgatgggagaggcatcaggcactgacaaggaagggcagaattatttggggccatcttagggaggcactcatctcgctggcagagatagccgttcagcttgtctaaggtgagacttctggtcttcatatttcacaagcatccccagtggctacacctggaaggatacttccttagggggttttcataagatcttggagagtaagacattttttcgtgagtcttgcctctagcagttaatactggaagaagcttacgatgacagaaagggatggtggtaaatccattgttacctccatgatcatgtataattaaagaacggttataaaatcaccattgcttttgttaagctcagcaaccattacatgaagctggaaacctggttccagagtgttaaggagcaagctgtgtgtatcgcaggttctgcagcatcctgaaacctcaggagagagtgaggggagaagggtgtgtgtgtgtgtgtgtgtgtgtgtgtgtgtgtgtgtgtgtgtgtgtggcctggtactcagaaaacaggtgctggagccagcctgtgtggttttaatcccacttctgtagtcatgtgacctaagggaactgtcttaacctctttttgccctcatttcctcacatacaaaatggggcacagcaaatttatatggttcttatgaagattaagtcaagacctataaagcattaaaacaatgtctataaggccgtgcagacactcagcatggctatttttatttctacagaaccatctgtggcttagtttttatacctcagtaatcctctctctctctctctctctctctctctgtctctctctatctctgtctcagagaagtgaaaaagagaactgacaaggatgacagcagatccattaccaatctaaccgggaccaattccaaaaagtcaccacagatgaagaattgttgcaatggctaaatcccaaacatccttggcctgtgaagtcttcatttccagaatactgaatttgtgtgacttatttggctcttaacagagtggcacatcctactgacactgtcctatggagagttacagtgcaggaaacctgaacccagctctcaggtccctctggaactttggctcttctttgttttgtctcagtgagtgatttgggccctctggctaaatagactagtcatgtccttacaggtcttaaaagataacatgtaaatgtttttaaaatggtaaaaaaaaagaaaagaaaagaaatcacatgctcagatcaaagctgtagaggaaactgacataattagattcatgtggtagctgaattaggttacccacaaagtcagcatttaaatatttgatactaaagttctagtaagaagggattctcatcctagctttgctgttaactggccttgtgaccttggacatgtcacaagcccatgtcggatctgtttcttcatctgtaaaatgtgcagcttgccctcaaaggccttgcagcccttggcacctcagattctgtgggaagcagtaggacagagagtgtggtggcccacagttaataatagaactatggttattcctgctttttaatattggagtattgatttttctcacttctgaaataaggacagaatttgattaaaaaatggaaacagaaatatctattttttatgtataaagaaacatgtttgagacaaaaatagttgtatataaaaggatatttcataatctcagaatagttacaaagctcactgcttgaatttggtgttaaaaattctaatggaaacatgtaaagccacatactactgaaagcacaatgcccaggaaagttgtcactcttcacttaagggagtggttgccaggggctgagaaagggaggatggggagtgactgctaataggtatgtggtttctttgggcgatgatgagaatgttctggaattggaatagtggtgatagttgtataactgtttgaatgtactaggaaccactgaattgtatactttgaaagggtgaattttatggttgtgaattatctcactaaaaaaaatgctagtacttagagtgatgtaacattttgcaaaattttcattttcgtatccctgctgatttcaaaccttcccatggtttagaagcataacctgtaatgtaatgcaagtcccctaactccctggttgctaacattaacttccttaagtaataatcaatgaaagaaattctatgcatggttttgaaataatatccttgaaagaggaatcaccattaggaaaggtgagtcagggtcctttgtttaatgtgactagtggctcatcatcaccagtgacctggttgggcctactctccttccagaacctgcattgcttcccagacctccccactgagatgcctctaagagccaaaggagtcaacacttgagcctagggtgggctacaacaaaagattctaatttaccttgcttcatctaggtccaggccccaagtagcttgctgaaggaacttaaaaagtagctgttatttattgtattgtataagctaaaaacatttatttttgttgaatcgaaacaattccatgtagcaatcttttttctgttcacggtgtttgtgatagaaccttaaattccgcaagcatcagttttttgaaaaaatgggaattgaccggatagttacaggcaaagattataaatagctacaacatcatttaacttttataaacatgccttctctctattgaagacatctgatatttttgctggaaagttggatctatcctcagtaactctgccatgaattcctgtttcctggttccagaaaaagaaaagattacatttctgatcataaagaatgtcttgcatatgggaaatttttcaaaataaggggggtattatttatgtggcatgggaaaacttttgccatggctgtttgtcttagtggcatcttttgatgacattggatcagatatatgtagatgctgatatatgggacacatgtttaggttttggtgcagttgcacaaaactgtgttagtttatatgttactgtgttgcctttatttattctctccaaagtgtctctttatatttgttttacaatctgtgaaagagtataccataatacagaagtattttcatagtctttacctctggattgtcctgtcagtatagccacgttgatgagattacaccagtgcctttgatggtcaaccaatcatctttaagtatttgagccctgataaatattttggtaacataatccaaattagagacttagagctctggttagcaatcatgtttaaagagaagcttcttaaagctctgtatgctgggagattcatgattattaccaacgttttgatttcatgaaggtgttctcaaatttaaagcacattttcagtaagaacaaaaatatttaatgtttttatcttagacttgatacatttgcatattactatggaagttattcaccttgtccctgtttttctttaagatattttaaaatcatagttatactacagtccttttttaaatgtatcctgatacattgtaaaatattttaatttcattgtggaaaataatgttggataaggagatatttttcactgttaacttttagcccatgcattttcataatttatttttttcacttgctgctttatatgacatatgtgacatttgattatttaacacttgatgtgatctgcataaacccaagttgcacaaccctcctgctgaagataaaattgaggttaaagataaagatttattttcatatttgtacagtgatcggcttcagtgatggtttttgtgggcatttattgtgtgtgtgtaagaaatttcatatgtatatattaagtaggcctctgagtattgaataattgttttatgattttgatttatatggtttacattttcattgtgtgggccatatttcgtttatactgtttatttctcttcaaaccttaataattataccataaagtgtaatttttatagcaatgcaaatgtctaaggaactacaaatattttctacgttgtaaattcaataaagcttgcttcctttggcctttt

SEQ ID NO: 105 - DNA, 834659 bp, Homo sapiens
gccggggaaggacagacggacggcgcttcctccttcggcgagcggttcccgggcacctcggcttggcccgggcgcgagtggagcgcgcctggctggccgccggcctcctgaaggtcccgttgcgtaccccctgggctggatatgttcatgttcacgtgaagatggatttactgtacggtctcgtgtggctgctgacagtcctcctggaggggatctctggccaaggagtgtacggtgagtggaatcgcgacgctatcgtgaccttgtgattcttaggcaagataggctggtgagcgaaaatgcacgactcgcgccgttccggggcccctcccggcgtggcatttgatttacacttcatcacgttattgggagcgataaagaggcagcgagcgcgctgcggattgggctgcgagccgcttccccggcgcctgggctctggctcggagttgggtttagccggcagcaacgcactcgtgcgaacgagcggctttgcacttgatttatccccgcggggaatccgagctccagcagtctttgatttaataatggtttggctccttgcatgccacggtgtcggtgtcacggtttccccccaccccccagggaagcttccagtgtgaccccgtgagtctccccacccctctccgcccccgccgcctcctcctctccaccttttcctttttctgtgaatgcctacatgccttgattttccggctcaggaagtggggtgacagttgagttgcgttctgcaccagcggttgccatgagcactgacttcgggaggggaaaatagcaggcaagattctcggtgccagacacaattaagggacatgtttgtgtgaatggatgagcaagtgcatgaatgaacggactgctaagtccgcgcgtctgggttccagggcaggacactagctcgctgcagcgggaacacaatctcatctcccctctggaaaacccagatttaggtttaggaactagagaagggcaagcttgttaattaggaggttttgaagtcctcaaaagcaaatacaggtttttttgcctgtcagcagttggcacccttagctttcaggatggaagcacacacacacacacacacacacacacacacacacacatccaggtcatagttaatagtggactaaaatgtatgtcttctcttgggacaagcaggtggtgcccaaaaaataacttctgtgtttttgaggtctggtgggaggttagaggtgcaccccttgaggggacatcaagccaagacccgcccacagccggtcccacccctcgcccctgagtcagtgtccacagaatgtgtgctgaaaatccagcccacttgcccttggtttcactcaggggtttggactccggtgctgcaggactaagtcaatggctgacccagggcaaaaaggaatgaatatttgtggaagtgtcagagctttccctgcagaccctggaactgactgcagagtggacacaggtgccagtgaatcctgagtcctcaaactctctgggaacggagtgcacagtgggtgggtgtttggggatgaatgctacagacccagcctttactgtgtccactgtgttctgtccagggctgaacagtgctgaggtgagctctggtacccactgcactccatctgctcctcccctttcctgtgtttctagctcccttcttggctcccaagaaaccttcactttctcccgactctaaggatcagaatgtcccctctcccaacccctccttcccaagtgaaagacaacttgtctcgtggtggtgatggttgtggtaatggggggacgtgtgtatgagagagatgctgagtctcctggcagacctcaaggtttgactgacaacaggaggtggggcctgaaaagagtaggaattaacttagtgctcttgtgactatcctggaccccggtgccctctgaacagctgagaaaaacggggattctagcgatgtaggaatgctggagataaagctttctcaaagggctgttccttaggatgggagagtctgaattcttctcatcccatgcctaactctgtattcctctctcattgattcagatcatcttagctaaaaggaattttttgttctggtttgttttttaaatttgtatgtatgcatgtgtgagtgtatgtgtgtgtgatggggtgatgagaagtgagaaaggttggggacgtggggagacagtggtacattgctggaactatctggatcagaaggacatggttccattttcctgtcactttttgttattcagattatttgccctggcaagtctcagattgggtagtggaaaagggtaagatctagcagagaagacaaataggaaacaattgcattaaaataatcctgtgtttatgtctgttaacaataaacaaggaggcagttctgctactgagctgatgattgtaatgaaagtgggggtctttttcatttagttttgtttttatattgatgtggttattagtcatgtagccaggaatagaattgtttttgtgtgaaaaatattaatcagtattcctggccattataaatgtcacagctatgaggtgggttaaaaattatgtattacttttaagatatgttttacctgtcacagaagttaggttctcaaagaagattaggcccctaatcttcagcattagcatcaccctggaacttgtttgaagtgcacatttttgggcccctctgagactttctaaattagaaactcagagtgtagggcccagtgatttgtgttcatcacctcgagtgatgattacagtggacactgaagttgagaagcactaacataggcttacagtttcattgctttgattttgtaagtcatgaactttcttaacctaaagtagttttgtttttatttgtggaagcatttataaggaagagaacattttttaaatttatcaaaaaaaggaatcaattgtaaaggacatagacataagatttagtgtaaagttaaaaagtgtgttttgaacattttatatgaataactttgagaatgattaatttaaaaggcagggttattataaacagaaacttcaacagcctagacaggaactttgctagcataaaaatctgtattcctttatttgcttatatttgctacatgtaaagccattcatactacacacaaagtaatatttctcaatagtgttttctagtatcatggttcaagaggaaacacaaatgattttctaggttactcaggcaaaatcacttcattgtagcctaaaattgtttacatgattgagaactatgtcattataaactttcttccctggaatagctagggtatcccttttctcctctacttcctcactgaaaaactctgagcatgaaattcagattctgttttttagtgaattgagaatatttgctgtaacacatggattatattgtctcaagtattttaatcttcttcctgttatgcccaatctgtttgacaaccctgtgcaatacttaagtgtaaaagtttctgctatagacctaggaacttactgtcatttatctgggaatagtgcttagcaaacgaactgcacaatagctaagatttatatatggtgtcacagttggatgagggagattatctcttaactgcctgccttccaccaataattctgtcctataaattttttaagtgggatttgtactttatatttattacattttcaatatcagatgtaacattatagtaatataaattatttgaaaatatttctgaaggaaaaattgcaagaaaacctcttcataatagaatagcacaaaaaaatcatatggactaaccaaggcaattttaatggatactacccatttgacatatatatttggcaatatatatatgtgcatttaaaaaattttacttccttaagctatagatttttgcttattggattttaaaaagttatttatattaaaataattctcccaaatactcttggaatgttaaagttttgtttgaattttccttttagcttaattaaacatcactggataacaaaaagtcattaaatgaactggtatctatttttcacgttattaattttgttgcactcacatttcattagatttaggataactaatcgatgtagcttcaagaattggaatgtaaaacctagctatctgtatgcttattgaagtacctagagctaagtgatccaatgcattttcttagttttgaaagttttctttgtaagtcattgtatggtagtaagtcatttgggttaactgtgttttctagagatcctattgacaatgacatcatatcaataattgtatctcctgtaaacttatcagttggcttgctaaaaaaagaagaagtactctattgacatattctgtaattttacttctggtcatcatgcctttaatttccaaggaagttattaaacattatgaatgcatcagcacagacaaatccccactgcaaacaaaaaacaaaatacaactcaagtctgaatagcttttttgggaaccaaatcaaacggtgatttggtgtcctgaaatggttaattcactgtccaaaaatagctttcagaatgcattagaagtaataaatagagtaagcttaagaaacacttgagtatgacaaattagcaagctatattaactcaattcaggtaatatcagtaaatctcatacaatttaagaatgacagcccaggcagtagctggacagaaatggccttggtgaaattaagaacaagggcataagtgacacaagaaagctctggaagatatttcagatggtattttagtgggttgaatctggatggataggaagggataagaatgacatggatggtcagttggccattacattcagtctcaggatgttgccattctcatagcaaagctatccgaaggtatattgattatgatttttttttcagattgggtttggagaggccgtgtgatgagatactgcctttgactaaaccatatttagggtgttagtctgtaggaaaagaggaagagattattttaataaatgctgttaaaaaatcaatgtgaagctctattacataccatcagctccaacctctttttcctcttctcactccattgtccctacacactcatgcacattcttatattgtcaccaccatggccacgatcatgaaagaaaagtggctgggctgctcattgtatcttgggatcatttttgcccattcaaaaattgtccttgttggtcatattactgagatttcacatgcaaaatgggcagattattttatatagtgttacttgctcatgtcctatatttccctgggaaagcccctaagtggattaataagtattttagattgagcaagttgagcctaacttattttacaatgaataagtcagtgagagtgccagagtttagacaattaacagtcagagataaaagtttagagatgaaataattccggtgaatagatgtcacaaaagtaattccaggaaggcatttttcatgatcttgatttctttgcttaatcttattatctctggttatgcttctttatacttatattttgccaatatttttatttttgttttatagttgtgaaacaccttaaaccctggttgagaagcagggtacaaataaacttttctgcaaggatgtgctctgtacttctttaaaacttattattttaatgtaactgcagtaggactcatggggatgggattatagcataagccttgtgagttcaattgtattttattaaaacattgtcaggaaccatggttttgggttgtgttccaggtatagaggcgattcatcactcatattctctgatttgatcctcatgctttgagaagagtcttgcaagggttgggctcaaggtttgtaatctataaaggcaacagcaaacagccagatacactgacctactctgggaactgagctcgagagcttatgctctttggtagctcagattaactaagggaatgtgctgtcatctcagttaaataagataaggtcttccttaggctcccttttggctattttggaaggacatgcaaagtatattgcatatatttaaagtatgaaaagagtgaacatttttagcttctttgtaattgacattaacttaatggtcccacaaaataacttttgtttctttgcttcagtgactgagtgtaaacactatattacttagagcaaacaataaaatattgcattcatagaaaactatatcctatctttattttcaaatccaattaataatcttttggccctgtaaaatcataaagtgggagaagagactttaagatatcattaaatcatctcactaactcaaggcacagtgattttaccattatgtcaggcagatggaggtcctgcattgtttgtgaaacttattttctccagggtccagttgtattcattagatgaatttgttttttacaaattactaaaatctcttattaaaataatggggcatgtacttaattatttccgttttataccggtgcaattccattttcttttctaactataccaccttgcactgatcccatttcagcttttctatatcagtttcttgctacttttccaagacactatgccatttctaatcttacatttttaaaaactgtttcttttcctgctgatttcattgattgaattgagtaagatctgtgctttctgtttcaacatccaaatgatatattccctaggagttacagaagaggatttcaactattataaacatatttttggctattacacatttgttatttaaatacatattatggtatgatgaaaggcattagaaattatgatgtaacttacactttgtgtctctacaactttgcataaacaggaacctcagtttcttgctgttcctgctcaaatctatattaaggactgtggtgtggctgaaatttggggtcatgtgtatgacatgttacagtatcttcaagcagtatattttttgtcttgttttgttgtaatgtgaatggtggaaataaaaataatcaagtgatcctgtagaaggggaaacacatcttcctgaaagaggaagggtttgttcacagctaggcgtctctaagtcttaatggacagcacaaaagacagctgagatctgaaggaggtgagtaggaagtaaaggctattggaaaaatgtatctaccctttaaataatggcaaaacagcaaaagcatatatttttatctgaagccactagaactttgttgtagtgcatcaggatgaaaaagaaaaatgcctgctgtctgcctgaagaaataccatcttaagggagatttttctggtgtcctgaaaggaaaggatgaggagataaagggctcttaatagagcctgtggtcactctgaaccagattactcttctcactgatggattgtgggatttgggaacacaaggaaaggttgggtacagattgatcattggagcattccgtcttttactcctgagtgtaactgagttgggtttttgcctcacctgtgctggactgcttactaggaaggcaagaaaatactggaggaagatgtgccacttttcagaagtggtgaccagtttgaattccccacagaaactctaggcctgtttaggttcagttctcataaattcagtcaactaattaatgtataactgctgtagatgatgcatgtagctatgtagtaatgtgtccggaattggtgggttcttggtttcactgacttcaagaatgaagccgcggacccttgcggtgatgttacagttcttaaaggcagtgtgtccggagtttgttccttctgatgtttggatgtgttcggagttttttccttctagtgggtttgtggtctcgctggctcaggagtgaagctgcagaccttcgcagtgagtgttaacagctcttaaggcggtatgtctggagttgttcgttcctcccagtggctttgtggtcttgctggcttcaggagtgaagctgtgtagaccttcgcagtgagtgttatagctcataaaggcaatgtgtacccaaagagtgagcaacagcaagatttattgcaaagagtgaaagaacaaagcttccacagtgtggaaggggacccaagcgggttgccactgctggctcaggcagcctgcttttattcccttatctggccccacccacatcctgctgatttgtccattttacagagagccgattggtctgttttacagagagctgattggtccgttttgacagggtgcttgattggtgcgtttaaaatccctgagctagactcaaaagttctccacattcccactagattagctagatacagagtgtcgattggtgtatttacaaaccctgagctagatacagagtgctgattggtgcatttacaaaccttgagctagatacagagtgccgattggtgtattcacaatcccttagctagacataaaggttctctaagtccccagcagatcagctagacacagagcgcagattggtgcatttacaaaccttaagctagacacagagtgctgattggtgcatttacaaaccttgagctagatacagagtgccaattggtgtattcacaatcccttagctagacataaagattctccaagtccccaccagattagctagatacagagtgccgattggtgcatccagaaaccctgagctagacacagggtgctgattggtgtgtttacaaaccttgagctagatacagagtgctgattggtgtatttacaatcccttagctagacataaagttctccaagttcccactagactcaggagcccagctggcttcacccagtggatctcgcaccagggccacaggtggagctgcctgccagtcctgtgtggtgcgcccgcactcctcagcccttgggcagttgatgggactgggcaccatggagcagggggccgcgctcctcagggaggctgaggcaacgcaggagtccatggtggggtggggcggggtggggcgggggcgggggggagggggggcgagggagggggcgggctgctagtcccgagccctgccccgcagggaggcagctaaggctggacaagaaatcaagtgcagtgctggtgggccagcagtgctgggggacctggcacaccctccacagctgctggcccaggtgctaagccccccattgctcagggccggcagggccagcaggccgctccgagtgcagggccgccaagcccacgcccacccggaactccagctggcccacaagtgcccagcgcagccctggttcccactcatgctgctccctccacacctccccacaagccgagggagccggctccagcctcagccagcccggagaagggctcccacggtgcagcggcggactgaagggctcctcaagcgtggccagaatgggtacagagagtaagcgagggttgtgagggctgccagcacactgtcacctctcagtaagtgctgtaaaatcaaagaggttatgcatgaatccaggagatagaaacaaatggaaaaacaaataaaataaggctatgagaaatacacaaatgtgtgtatctagaagaagagagaggaattacatttcctattgtggttggagaaaacttgaaaaagctcggaacagttaagacttgaaagtgggtaggcataatatagataaagaaggaagaaagggcattgctattgtgtgggttctaggtggaggaacagtggtgcagaaagaaaagtagtcctggaatgggtgtgtaataaagcctcagcaatttctttaaagtttaccccaactagaaagatgtatctgtcctttaacctgtgtcatcatacaattttattgtatgatactctggaacttgctcagatatatatgtccatcaagattctgaagtgtgtgtgtgttaaatgtgcgaagctaactgaccatttcttcagaaggtaggacagttatctctaaagttcctgtggggggcaactccttttggaggtaaactcaaagactttttaaagtctaaatttttagagtgctaaaaagaagtgctgtttagcagcagcaactatgggtccagaatgactaaaatcatttcgttctttacgaatgtacagccactgggatgaaggcattgcccttgtgaaaagagaggtatgtgctttcattattgttttttattacagtgcaagacagcatgatgtagttgaaaactgttgggtaacgtgggctttcttcttgttcagctgctgctttactgtgttacttcaggcaaaaatcttgatctctatccctcagtttccacatcgagtaaactcttaggagagtgggctgatgcatagaagaaatgtagatattagcaagaataagaaactatggctgcatttttatatctggagtagaagggggagggagcatggagagtttcccttctgttcttaaaaatctacacttagatgctctagcagttgaacctcataataggactatcatttagtttttagaccagaataagaagctagaaggtaacagagaccaagtaattttttttctggaaaaaatattctggttgtgtcagtctaggggaaaataacagaaactgagtatttttaaacactttaagtattataaatatgtgcatgaaaatgcaatttgatattgtatttcgatgcacgtgtagtttatattgttgcttatgctagtctccctttctcaatccacataacccaggagtttctccttcttctccttaacagtggtggttagcaaggagctggcatcctccccctcatttgagagctccagagaacattagtgtatcctaaaccttatggttatgggtaaatttatgcttatataaatctataagtgtgttcaaatacgtgtattgatcttgttgttgaatcaaggagtaagagtattcttaatagtcttcaagactaattaatagtcttcatttcaagactaattggaaaacagcagtttataaaaatcagccacccaattggaaaaaataacctagggatatatttatttataagaatacttataattggtagttaatacataaaaacagaaaatgaggataaaccattaaatggggtcatcacacaattactgtgtcacatcttctagttttgatccagaagtaaccagaattggtgtttcccacccagtcacctaatcatttaaaacatttttaaattagaattaactgaaaaggactgagtgggactttgctcaccattaaactgtaacagccacatacctaagaaagcattttatgcataatgcaatcgttttctttggcaaacactttctatttttggagggcggaaggtagtccacttccatattctctattcatataattaactagatggctgtaattgcttaattcaattattattctccatgtctgaatattaactcaatattagtcaagtatattggtcaagtatctctttaaccacatagaaggcaatctttactcaggactgtgaaagacaacaaaaattgttagttgagaagatttttcccattatgtgaaatgagcaatattgactttgctaaacaaatcaccttaagcaaagacacacagtactgtgtaatatggagagatacaactgccaagtaatttcacagttgtcagtctaacttggtatctcagaatgagttaagttattatcaagaattggcatagttaatgcttttatttcagttctgaactcgttccttgtttttcatgggttactctacgccattattgtgactctctctcatcctttgagtaacttatatttttcatttggttcatgtttcacactggtttgtaccacctgtacaacagagatgctgtatgcattttagagttttaggtctttgtcccaattaatcaaagctcaacctttgactaattttgttcttcctttgttgtgcatagatttatctaaatatacttgtctaaggaagtgcaacccttttccattatgaccattccctacaatattataaactccataatgacatcattactgtgaaaatcggggtttagaaacctcccagtctttccccaagactagaataactcccagtggactgcagcctgaaataatctgtcttgttactcagagtctgcttactctctgattatttcctgtgcctcactatcaaacatccctccaattgcagcagctggtgtggaaagtggccttcttcttgcttcctgtgattttgcagttgaactctatggtcattatatctttttgattcatatttcaaacagtgtttcagttttactttctgtcgtcattgatactaatttaatgccttaatctctaagcttacttatgcaaagaagtactttgacacccttatgtttaaccaccttccctcttccagagagagctaaagaagatacacacacacacatgcacatgtgcatatacatacacacattcataatacaaatatatgtttgtatatagagtatttgcatgtatactataaaaaatacatattacatgttcaagcagaaatcgattaactatgttaagagtatataagagtgcgtatgtgtattcaaaaaatgcatggaatagtagctaaactttatttaggctaatcccaagaaactgggtgcttttcccacttcccttgcaaagctgactctaattcagtgttggcaacagagtatgcagtctctcacctaatactcagtttgtgtttgaatatttgtgatacattcatgtttctattgttcatgggtttacaaaattacctttagaaactccaactactggctgggtgcggtggctcactcctgtaatcccagcactttgagaggccgaggcaggcggatcacctgaagtcaggagctcgagaccagcctgcccaacatgtggaaaccctgtctctactaaaaatacaaaaaattagccgggcgtagtggcgggtgcctgtaatcccagctacttgggaggctgaggcgggagaatcccttgaacctgagaggcagaggttgcaccactgcactccatcctgggcaacaagagcgaaactctgtctcaaaaaaaaaaaaaaaaaaaaaagaaactctgattacttcgttttttgcagttgacaaaagagaaatatttcttagctgcctaacagcaatgcatgtgcagtttattccacctgcattacagtaatgtgtatatttgaagcttagcatcacttgcatattcagaagaccatccctgccgttctattaatcaggtcttttaagttgtattttattctttataagtgagctttcagtgcaccaggcatatctatattcatgtctggattctaaaatacatgcacaaacaaaacttaagtaacttggattatctttcatcttttttcacctataattgaaaaataattaaagatgagatatagtaatttttcataaaataattgccatttatcaagtgcctactgtatgccacaccttgtattagaagttttatacacattgtaccatgcactaatctttgtatgagatagatgcaaaatctgaagctcatgaagtttaaataaccgccatatagttactggtggctgaatttggaatcaaatatgaaatgtatgtaaaagtaaatacttgtatttatacttatttatattattaaaattatattcagatatgtgtgtgcttatacttattctaattaaatcataaaagttaggtagcttacattgtgctatgcatgaaaattatcttaaacagtatatacttgaaatgcaacttgggtaataatacattttagcttgtcacatgcgaagtatatgtaggtagctaatgtcagcactttataccatatggttttctttcttagaaaagaaagatatgttttataattcttttttcttttcagtattgaaatgcccatactgaggactctctctcatataatttatttttggaatgataggatattttaagcttattcataattagtaacctgtaaaaatgaagaaatggttctactacatattctgcagaagtagttatattcctccatgtaaaatagtaggtatgtgcttataaaaaataaccactgtcaggtgtactactttatttctccctaggctgattaacaatcgctggtcttggaaagattgatagttaaatgtcatatttggcctgatttttgttgagttccctccgagtattgcttgggcatttttcgcgcagagttaattgaggagactctatcagcggatttcttttcttgacaatcttgttgtgttcaagaggacagttgattgcgagctctgcccttctcttagctgacagtgagttcctcagacctcaaagcttacagattagtgcagtttagtgatttgttttaggcttttagctacagtatttaccactataaaagtcatttttcctatgctttttgaatgctgttattgtgtcctatagtataaccctgtatcattgtgactattgtgtgattgatacagaaactgcttcaataggaaaccatttcaagagagaacaggaaaggtattatattcagctgtagcgccatgcatttctaagcagctgatgttttctttaactgataaacatcccccctcaaattttcagaggcaattgagtctttagaactttaactcttaattcagtctggctgcaagagcactgccctgaaattcattatacattcacattttacaattggcaattcattaattctgtagtataactgttgttattgtatttcaaagccagatctcttctttaaaaaaaaaaagcatggagaagcactgattttgtgaattccttctttaagcaatggcttcctaatatctgaccaaatgcttgaaactaatgggatatgactttttgcacactggaaatagcgctaatgttaaatggtggagccatcatgcattttgtaactaaaaatttcaaattaaactggaagcctttgtaaaggatagagtaaaagatgagtcaaatccaagttcataagagtttaatagatttcgtgattttacaatttacacatttagttctatatttgggagtacttatagaatatagtacacctttttaaagtctttctctgcttccaatttttgcattttgtgatatattagatgcatgctctattttgagtgagagtggatagtgacttcataattgaggtatacacttatacacctaagatttaagtacatctctatgttgtggtttatcatttaattttaccaacaataattaaataatatccatgaaagctggaatacagtttcttaagtaaaataaaaggtaaaatatcttatgaacctaaaaatgccatttaaatgtctttggctgtgacgaaagctaatttagactttcttaagatatttctaagtttgttctaagaatatttttagcggcttaactattgactgcttctcattcattttacatagctgtcaccctcccaacaattattatgacatttcagaggttttcacagtagtaatgaaagactcagcatttctacagatggaaagttatttataaagcaaataatgaaaatagtaaagcagaatttcaacctactattgtgctctgctctggggattagacttgaagttgcatgggtaggagcagatgtgttagtttggtcataatcttagcctagagaaataggaataaatttattgacatagcagggtgataggatttcatgtcatgaggattaatagaatagatcaaagcagaatgcagtgtgttcatgtcataggttgacttctccaggaaaccgaccccaagtggaaggtttacatgcaggtggtttattagagagtgatgttgggaagaacacctgtaagggaagaagggagcctgggaagagcagagggagaaggtgaactctgattcacttgcaacagagtcctaggctgagtgcatgggatgctgtagagttgggatggaccttcagagatattccaaatagagaaagaattctgtttactctcttttctaccagtccttggacgtgggttgcccctggggcagagccaatatatttgggttaggcagctccctttactggaaggcaaattctgggaggaactcagttgtgagcaatcatcaggtaacactcttggaagttgggagagtggatgtcttcttcatgcagaaggagttctgaatgttacaccccatcttagacagcttttgttgctcatatctgcttgcttatcctgtttgagaactggccctccaggagctggccttttatcttaaggaaactcacaaaagaggatggttagcaggacaaacgtcagccagcccttatgtctggtctcagaaccgtgtctgatactcatcattcctcttttctactacttcttctagaacccattacccttagctagcaattctaaaggattagattgtgaacttggcaaagtgagctgaagggcctaagatcttggtcaccaagatcttctcaggtcacagctgatggatttatcggtttcctaccagaactaggtaagagagcatcaacacatacttaaagtgggtcactggggtgccagagttcttctcccctgctcatgttacataacagcagccttgccacctccagacaatcaggatttattatccctgcctgaaaagtgactttgttctttgcctgcttgtcttttgcataaggagcccaaataaacaggtgacaactgtcacaggagtttgagacttttgctattgtccctaagaaaagtgtccccctctgggaaccaacacatcttagccacacaggccctgtaattctggggacaggaagcacaggtaccctacatatgtcatgagagtgaagataactgaggatactacactgtctcctcttggttcttggacttatgtattctacctactggggacacagctacatataatagtcattaatttaggactgtgtcatatcctgcaagtgtggggtccaactttaagagtatcatctccaagctgctgaattaatgctgctccttcaaaagttttctattagatgatgtgatagaaccagtaaattccattatcattgcagcaccttcttttctgttcagtggatccctttggttagtacaatgttaggagagatcctgttttaggtatatcacatattctgaaatctcttacattgatgtgttttatggggcactgtaggcacaaggtaactgtcagttccaatcaagatgaatttctaatctttcatttgtaaatggagtccattgtactcaatttctaccaaatgcctagttagtttccttgaggaatggggtacatcagggtccctcctgctggcaggttggacatttagcagcagcattagctagttcaatgctgatgaatgggagcttttgctattcagtatatggataatgtctataattttcactacggcttcttcccttttgtgtctattgatgcaacactggagtagctgatggcaagctgactaatatcaataaatcaagttattctgtattctgattccaattgctattgctctgtaacaacccaccccagctttgtggtataaaacactccctttattatattcgtggattctgtgggccaataatttatatgagggatattcagaatggcttatctttgccccgtaatttctgagcccttacctgggaagacttggaggtggaggatgacttgacatctggaggctggaatcatctgctggcatcttcactgacatatgtgatacttgagactctggcagatagctgggactttggctgaattgaaaactttgggctttcttacagcacggtgtgaggattctaagagtaagtatcctgaaaaggtacaaaggatcgctttgaattttgccttggaagttacatgcatcgattccgtgacgctctatagtttgaggcagagacaaaggtccacccaggttgaaagaaagggattataaatcccacctctttacacctctttatgggaataatgttaagtttacatttgatggaggacttgtagaattggagaaattgttgtggcctttttaaaagaatacaatctgccacatgcctcttttgtggtggatgctctctgggggacaataacattgtctacaaagatctctctactttgtgcccactcccataggaggtacatttgcatgcctgtttttctgagttattgttgctgattttctgtcacttctctttgcaggcgtccagccaacaatcagctaagttattcactgctgccaataagactatgtttatttttaccgcagccacttctctttccatacaacttatatggtccctgaagctgtaccccattgggaatattttctctcattgcactctttgaaggcacccattagtggggctgcagggcaggtgcagtacctttttggtttataccacatgtggagctaactgatctgtgaacctgtcttgaacttggtggttagacaggactgcccatgcagtcatagggatgagctgagggaaatgaggcagtgcaataggaaagatgtaggggtttgccatttctgcatatagcttacttgggctttctctgtctacttgtgctcagtcccaaatgtatcatttttatttaataatggattgctacaggacctacttgatcttatgacttggctgacaaaacctagttataatggacatttttggcaccatggtctcttaattgcctattttcaggcattctgcctaagtaagttcccagtagtatgccataaactgtttgtcaagtgatttgtaattctatattgcaaatggcacaggcttgctgaaaaaccttcagtggctaacattgtgatttttctacagggacttgccgtagactttacgtgtggcttgtcacactaaagatacttctaatatcatgggatgtgtgggattatatggtctaagcttgaggaattaattcttcagttgaacctatacctcctccaaggtctttaactgccctaagccacagtccaagccagcatccttctgtggcactggtaaataggtcagaacagtattcccagcatggactgtgttctctcttagatctaaagtgttctgttatggattgtgctaccttcttattgatggggaaagtgagctaatttgttctttttttggaagattgctttttattttggaatgtgcatcaatttgtctttctctttggaaagattgtctttccatgactcaggccatagactcctacaactcactgaggaggtgtctattttccatcctctgagcacatgtcttacccagacttccgaagtacttgccactttttgcttattcggttctcttacaggatgtcattgatattatgtaatggaccagtgtaatgttctttctaatatccaatacattcagattctttcagactgtattatggcagaggacagaaaagttattataatcctgggtcaggatggaagatgcgtactgctgttatgtccatgtgaatgagaactgcttctggttcaccttcttggtagagatggataacagtgtttttgctagatcaattgccaggtaccatgaactaaagttggattaatctgctgtagcaaagatactgcaactggccaagcacttgcaactggggcttctacttggttgaatttgtgtagttcaattccaacttccagcatctatctgcttgtttatcaacaagagtggtgaataaaatggagggcacaatgaggactataaaatgtgcctcctttagatctttaaaagtggtactgatatcttacattttgtctagaatgccatactgtctttatcctagcaacattatcatcagggtgttattaaatcctgtatcctgggagggtcctcccacatcaaaaatgcctctcttatccaacattatattccttcccatcttaatctagcgtccttagaatcaattcatatacacactcttctaacttctgccagtacttattggctaaatctgcctctttcagagcacagtcttttttcttcttcttttctcccttggtaatctaagcaccttcattgctgggttaatttgtaacttaaccctggtgatgagtttggctgccagtaggagagttggggatatattctaaggggaaatatactgtcttcataggtggagatctcttcataactggaactctcagttattcaactttatgttccattctctggtgacccagcatcttcagaattggttccaaagttattctactgattctactggaacatattggctgggtcctgtggctcttttgagctattgtccctgtcctccttttgaagggttagcacttcagccagttgtgacttaccgttagttattagccagttggccagcagaggaggtggtggaaaatcctgggtgggacttacattctttttcagggaagagtcatcttcattgtcttcaagcaggaaacactagtctcttaacagggagacttctgtaggcacctagtgtccataggaacctgatgatcgagattattgactgcatcaaactagattttgttatctctagggctctttattttcctaatttgcacccttactttcatgtagctgacttttcaggtgaattcaaccatatctagagctttgctcttataattaagttctgtacctgaacctaaggaatttttacacaatttgtagaggtgaatttctttttatttactccatgggaagatctttggccttaaattgatggttgtgttagttttcttttgtttttgtaacaaattaccacaaacttagtggttttaagcaatattagttctctatgtaggtcagaagcctgacatgggtctcactgagctaaaatcaaggggtcagcaaagctgcacttctttttgaaagctctaagggagaatccatttccttgctcttcccaacttctacagcctccttttatgtcttggcttgtggcctgtttgttccatctccaaagctaacaacatcacatctctctgtgcctttcttccatagtcctgtctccctctgactctcctctttttccgctgtcttgcactttctgagacccttgagtacattggacccaccctgataattcaggatgtcctctctattttaaggtcagctgattagcaactttaattacatctacaatcttaattccacgttgtcatgcagtctaacatattcacagtttccgggaattaggatgtgaacttcttttggcgaggtttggtttgttactggtttattactgcttaccacagtaatacatcagtgtcatctttccattttccattggctttctcaaatgcgtgggtagcctccagagataaccatctaattttgtagtccttgtaattattacttcccccaactctttaagcaccagcgacatttcacttaccttcctctgatatattatcccagttcacctagagaagacagaattacataaagctcaagagcaatctcagccatagatctcagcaaatctcagcaaagaactattgcttccacagtatttcctggatgaatgaaatctattctcctggaaaaatcattgctattgtcttgttcgtatttcctgagttttttgtgttccatagaaaattgatttttctattttaaaagaccttaactgtggcaatttcacatgttcttatggtgaggattatttcttgtccatctaagattcttatgggatattgaggttctactgggatagcactcatatccaccagtggctccatgagttggtttttggaagttagcaggataaaaatggagagaagatagtttgtcagacagtgcttcagcctgaatctgtctcagactttcaattacttccccatggtgtagtaagaatctgggccacacaggtcagttcctcagggattttgaaatcctgatttctgactctgagttatagttcttattcatttttacttttttgaaaaaattaaaagtgatatgttttctttccactattaattatcagttgctggataaatatttgtgtgtgcctggggggaggggagcagcactgaaatgatctttgcaattttaaaaattactaaagagttataaggtactaattttttatgcaatatccacttgcctggtttgctgatgttttacagtacttgttttaactcagcaaataattatataatcctgaaactttaatgaaattttaatatcatctttataagcttgttacttgtgaatcaaagtttaattctatttcaacacatataacaattataacttgaacaaatcagtattttcagataaaggaaactgactttgtagttttgccatcattggagttagtctcatttatataacatttaagaacattcatgtgtttctgatacttttattgctgttatgtatgtatagtaaaagttccgatttctctgtgaataatttataatgtctatataaaactttgttctcaggaataatagatgagaggaatatggactgtatataaattttgtgtaaataaccttctttattccaaaataacttcagatgttctgatagtactttatagcaaaagaaagcaataatactttctagcagataattatatttgataactaatgcttctgtatatcttttgctagttcttcctgttctcctcaatcacgagtaatcaagatccttatatttctgtccttgtccctctttcttttctcaccatgcaccctcttgccttgggcagtttaaatactgtccctgtctgccaacttttaaacttacacttcatatcaggtctttgttctgagctccagatccgtatgtgtaactgtctctttcacatttttacttagagtgctcaaaggcatcaacattaatttgtcaaaagctggactcttggtctacccaactctttctcctcatcctacctcttctcattaagtcacccaggtccacatatcattcacctgaaagtcatgcttgaccttgacctttcgtttttatccctgaaagcagatcgtcacctttatttggggagcagttctgcaaaatagatctcagatgtaccactgccaccaccgttatcccttccatgtttctattttgtctcatcgaatgtagtattctcttcattattctcccatttgccctgtgagtaccccttcctcatgcttcatataactccctacatacatccatacatcaagcctgtgtgatggctaaaaaaaaacagcagattacatcactcttctgatttgaaagccattcagtggtttctcattcctctgaagataaatttgaacctctactatcattctcacacactccagatatggccctgcccactctgctgcctcatcttgaattgcttctccctttaagcactgtggtggagatacagtgatttttatttcatcccacggaagcgctaagttctttcgtgcctcagagtctttgtgtgtgcttatccattgctccgaaaatgtctgccctgtattggagctcttcagagaaacagaaccaataggatatgtgtgtataggtatttatgggtatacacacacacacacacacacacacacacacacacacaccacatgcacacacacacagaatctcccttaaggtcatctacaggttcttgaaaactgtgactttaagcaaaatgacatataatgaaacagactttaccataggctagttaacataaatgacagttaagttcctgtggtatatttttgatcacaaaatcatcactgaatttctaaataaagacccaaaaagcttctaatattaaacattgaaataaatgttagttacacatacttttaagaaataataacaccaagtaagataattatttacccaatttttggtgaatcattgagtgacagcagtcatagtggcagtgggtcaaatcaaggaataaaagtttgcaaaaagaaaactgtcactacctaccatcatgcaattcaaaagaaacaataacaaatatgatgggcttgctgagtgtgttcattccacattgtttttttgtgcatttgtatgattatcatctgcttcacatatttttattttacaataatttgtgttaattcattcatttatgcatttttccaacctgcttattccagttcaaggttgcaggtggccagactctatctcagcagcccagggtgcaagttgggaagcaaccctggacaggttgcctttccatcacagggtgcattcacacatacccatacttactcatactgggacaatttagacatgccagtttgcctaatgtgtatatctttgggatttgggaggaaagctgagtacccagaaaaaacccatacagatatggagaacctgcacactccacacaggcagtggcttctgctgggaattgatttctttttctcatcaaaattataatgaaagatgttgaaagaaacaatgttattcaaggacctgctgcatatgtaaaataaggaattggctcacatgattatgggggctgataagtcccaagatctgcagctggcaaagtggagacccaggagagctgaggacgtagttccagcctaaaggctggcatgcttcaggcccaaaaagagatgtttaagcatgactcccagagcatgaaaaaacatgatgtctcagtttgaaggcagtcaggcaggaggaattcccctttatttgggcaagggtctgccttttgttcttttcaggccttcgattgattggatgaggcccacccacattagagagaccatgtgctttaatcagtctgttgatttaaatgttaaaatcatctaaaagcatcctcatagaagcacttagactaaagtttgaccaaatatctagtatcctattacccagtcaagttaacacataaaattaaccattacattctctacctctctcccaacttttttagcctaattcatcctggtttttcaatattcagattaaaaatagagctgcctcaattatcaccatcccctaaatttaaatttaaatccactgttatgtctcctatagcattacatattttctctctgagtacttattataatttattatgctctatatatttgtggggtttttttgttttgttttgttttgttttgtttttgagatgaagcctcactctgttgcccaggctggagggcaatggcatgatgtcggtttactataacctctgcctcccaggttcaagcgatttttgtgtctcagcctcctgagtagctggaattacaggcacgtgtctccatgctcaggtaatttttgtatttttggtagagacggggtttcactgttggccaggctggtctcccaggctatgctgtataaatttgtgaaatgatttgtttaatgtgtaaaattggatgaccaaaaggacaggaactactatgacttgtttgccatttatacataaagcacttagcagtttgcctgacacaacacatttattttactggagccacagaattaatgggtagatccatgaacaaacgctttagcttaaatttgtctatagataaacttttaagcagttgctacagtctctaaataatagaacagtaagaaagttttccagtagtaagttgcaatttactccctcatttattaagaagaaaaaaatacccaataggttttttggcaaaaatgtaaagttactcttaatcactatgactatggaaataataattaaaacatttaatgagtatacaaatattttatatgatgaattttagacatttaaaaatgtattgatattactaaataattatttcctctaggtactagacatgaggtcagaatacatatataaaccatcatttttaagtgttaatgtgatagctgtaggtacaattgatgttaatataattttaggtaaaaatgtattatctcttctccatttctgtttgtattctaaagaagatctgtttaaatatggtttaagaaagaagtgttgaacacaacatgaagaaattccaaagttaagtgattttatgaacactttcttatgaactttattttaagaacacttcaattaggtcaaaatatgcttctgaaatgtattctgcagagaacattgggtgattttatttatccagtcttatgctacctatgaaaggcttttacttcccattcctggtcccctgtctgccatagatctttctctgactataccagcccactcagatattctttgcagctgaactttgcttgtgcttatctttcagtgccttatggtttagcacttattgccctctatttatttttgattacgatcgttctttgagcaaatcattattagacattatgtatatagcaggctactttctagtcattgagggaaacactcaaagaactataaaaatggtttttgtcttcaaatggcatatactgtcattggaaagataagggaatttataatcatgcccataataataccatttactgagaatatactatatagaaagaacttgatttcaaaaattctcaacatacttctttaatagtatcccaaaattcagaggaagaggttaagtctcagactgcataaatagtgaaaggttatgtaactaataaatgtgaaagcctagattaaaaacagaagtgtctcacttgacaatctgtattcatgtctcttaacaatataaaatggcacagtatgacataggcaaaccattggaagattcacaggaaacaaagtttgaagttgtgtgtgtgtgagtagatatttgcctacacaatttgaagtggttagtcatagtttattgttgttttgtaggcatttatttgtttatttattattgatgcataatagatatacatattttggtggcatctgtaataatttaatacattaatataatttgtaaagatcaaatcagtgtatttgggatagccgtcaccttaaatgtttgtcttttcaaaaatggatctatataagttataacaataattttatagaattcagaaaaaatgacaaagatgctacaatgtatatagctgatttcatgttttatattgcatgtttaaccttctaaaacttttaaaacagctataaaacacatatattttggacataagggtattaatatttccatgttattttgtggtaggcgaaaagtggcaagccacctgcccaccccaatattactgtactgcacagaataagttaagtatcaacatgggtaatgtgaactacttttttctataagaggagatcagtattgtatacagtgtttataaaaggttatggtttatgtctccagttgggttttgatcaactaggatgaaaaatcttatgacattcagtccctgagccaaatggagaagtggaattgtgtttcacataaattatcattttttttttgcctttttaaagcttgtgtctgatgttaatgcctactattataaggaaaagtcatcccaaggatgacattacaaagattcatacagtgcaataaaatgaataattcatttgaaataggccatgtgtgttactgcttataatctaatataacatgttgcaattaatagaaaacttttgaagttgattttgtaaggtgagcctccaaaatgtttgagcagacctaaaatatgcttgaataattaaaatcttagagtatttttaatcttcctgacttaatctgcatgacacgtatttggcaaatggatacaaacatttatttttatgaacatttgacatattagaataccatatatgatgatagagctaaagattaatccaaacaatattgagtatagacagacataattcataagacatggcaatgtatttcattaataaactatctcttagatgttcatgtaaattatggtgcagtagaatgctcctaaatagttgagtgaaacttggcccaagggaagcagagatattaatcacacaaagcactatttacacacactaaagagtgtggatttaaggagcaagtaaatctcactttcaaattacagattcacaaacaatttcattttacataaaatggctctgatcaaaattcaaccctaaaattaaattgtcatctaatatttgtgcagaatgtgccatattttacgctaagggttgtagggcattaaatgatgcataagaaaaacttttattcatagaaattatgctcatgattgggcaagtatttcatatgcattctcagctgcacaccataatgaagaatgcactactgttatccccacttcactgattattataccaagcttagagaggataaataacatatccaagttcacccaactagtaggtggctgaccaaggatccaaggatccagacccgagaagaaagactctgaagcatgcattttcaatcacttttccactattttggcttcagaagtaaaatttaaactgaaaatctgctaagaattatatgtataatatatatgcatctatatgtattatatatgagtattatatatgttatatgtgtatatgtgtatgtatatacatgcatatatgtatatgaaaagcttaatgaagtaattgtatggattcttgaagtatgctttaagaaactagtttggtaatctatcctagacaatcattagtaagtgaaaaaagcaaaacctattggtatattgtatatatttatatctttgtatttaacattgagtatatttcaaaaatgaaagtttacatgacgtagtcaaactgagaaaaattttcttcctttttttttttttttttttgagacggagtcttgctctgtcgcgcaggctggagtgcagtggcgggatctcagctcactgcaagctccgcctcccgagttcatgccattctcctgcctcagcctcccaagtagatgggactacaggagcctgccaccacgcccggctaatttttttttcttttgtatttttagtagagactgggtttcatcgtgttagccaggatggtctcgatcttctgacctcgtgatccacccgcctcggcttcccagagtgctgggattacaggcatgagccaccgcgcccagccagttttcttcatctttaatattgggtgttattgttaatctgttttgttaaatagttacattttggttagagcttcttttgatcagttgtaagcatttttgttagtgctggtactagttttatgaaatcttaaaaaaatgtataataatgaaacagtctgtaattataatatttgtaattataagaattatttttataagaattatacgaattttcttttaagatttataagaattgtgaatcataagaattgaattgggccgggcgcggtggctcacgcctgtaatcccagcactttgggaggacgaggcgggcggatcttgaggtcaggagatggagaccatcctggctaacacggtgaaactccgtctctaataaaaatacaaaaaaattagccgggcgaggtgtcatgcgcctgtagtcccagctactcgggaggagaatggcgtgaacccgggaggcggagcttgcagggagccgatatcgcgccaccgcacctccagcttgggagacagcgggactccctctaaaaaaaaaaaaaggattgaattataagaattgtgtaaagatggtagctgcattatttttagagaaacagtgtcttagtttcttattgctgctgtaatgaattcccacaaattccgtggattaaagccattcaaatatgttatcttaagttctagaagtcagaaatctgaaatgagtcttatagggctaaaatcagtctgtctgtagggctatgattttttctgcaggctctaggggaaaatcagtttccttgccttttccagcttctagtggctgcctgcattccttagctcatggccccttccttcttttccaaaaccaacatggtagcattttcaaatctttctcctgctctgaaactcccacctaattattattttaagatagatatatatttttaagatttatttttagttttaattgacatataataattgcataaatttatggagtagagtgtaatgtttccatatacatgtgtagtgatcaaatcagggcatttagcatgtccgtcatctcatacatttatcatttctttatgataagaacattcaaaatcctctcctagttttttttttcaaatttacagtacaatattgttaactgtcttcaccctgttgtgcaatagaacaccagaatttatttctcctatcttaactataattttatacccatggatcaatctcttcccttctccctctccttcctaccctctccagcgtctggtaacttctcttctgctgtgtacttctgcagcttttttagatcccacatatgagtgagatcatgtggtatttgtctttctgtgtctgtcctgtttcacttcatgtcctacagattcatccttattcaaaaatgacaagattgtaatcttttcttatgattaagattccattttgtatatatatcacattttctttatccattttgtccatccatggacacttaggttgatcttataagaatctttgtgtttccattgagcccaattggatgatccaagataatctttaagtctcaagatctttaatgtaatcacattttcaaagttctctttgccatataaagcaacatattcacagcttttagggattagagtgtgggaatctttgggggccattattctgcctaccacagccagattctagtatgtagactgaagtgactgtttttctatgaaaacatatctttatatatcttacagtaggcgtatagatgctctaataaactaatttcaaattggctgtggaaaaactcacctggtctacactctgatccactgaatgaccttttaatgtcttatttcctccttttcactatataaattatactgaacaaggagagtgctcagtaatgagcttttagcttttactgtatttttaagaactgatttaatcagtaaccctcacaaaaatttttcttttctatttaaataaagaaaagtggagaatctatgccatttaaaaatcctggccttggttgttcctaaatttatctttgcaggtaaaatgaaaaagtaaaaacattttgttattctatcaaatgaagattattacataaggaatgtgtcagtcaaattatgacttcttgatattttttatgtacacagcagaccttttaagaagagattaagaactgttaggtacgttaacatttggtgcctctttgctttcctacttgagaatggctggtgatagaaagatgcaaggttttatttcaggaactaggatgctattctcttgcatattaaactactactaggggatgggtatctaggaatcattgggaagaaattgccatatgctatttatgtaggtaatttccatatagcaaatctgatggtgtagagaaatcattaatttacatatgcatgtccaaaaatggtgaatgttagtgattgctgcatcatttaaaaaatgattgacaagaagcaccatagatgctaaaacaggctgctcattaaatatgttttcaacttttgatagacattttattaaaaatggtataatgtaatactttaaaatattttccttttaaaaattttttgcttatgaatagaattaaaaataaatgaagatttacagaacctgttatgtatttggctcttcctttaagaatagaatgtgatttctcattagtataaggaaggaatataatcattgtgatttatccagaataacaacagtaatgctaatagcgaatgcttacatagtggttagtatttgccaggtgatattttaagtgccttacatacatacatacatacaaaatactctgttgttatccttatttgttgacatatgaggaaaattaggcaaagacacattaagcccaagtcccattagtcttaaataaacagctggagtttgaacccaatctatctccagctcattaagaaataaattatattggattgtttaaaatgttattagggagtagtcttgatgaaatgcgaataaaccaatccacttattaatcttctagaggctaaatttacaaagttaaccttttttagttaacagaagttgggttatggaatttacaatgtttatgctttaatacagatattatcatctagagatggatagatgataaatagatagatagatagatacatagatagggctggtagaattgaggactctagtacttctatataatatggatttaggaacacagtttgtttgcttggtaggatatgaagcagtgtttgccaagcaatatgtgtgaggctgagaaatgtaaatttttgatccaaatgtatctgatagataatctgtgggaactaaagctctctcgaagccctcttttggaatggtcaatggatgtatgttattgtctgtttttaatatgctgcaaagtcatgttttgagctcactttattgtcttaaaatgtatacatatttgttcagcataaagagttatgtactgctgatttatatatcacgcccttttctaagtgccttgggaatactgattcagttaattctcataagagtccaatgagataagtaccaaaataattcccattttactggtgagggagctgagtagtaagaaatgggtacatagctgaaggctactgagataacaagtggcagagctgtctccagagtccattccttattcataaataaagtagttcacatctgtaagagcaagttcccctagggagagaatcttctcccctccttattttaccccactttacaatttttcctacgttacacatttggaatgaggtaattaagcactgtaacacccagttcccattcttcaccacttgggttctagcttattttcatctgcagattgtactgattctcttctttccccttcactctcctctgctctcctcttctccattcctatccttgcatctcttccctatcaaatgagttcaattgatgaatgaactgctaaataaattaatacacttctgaaatggcattttatatgcagtgcctgacaaccttagctaaagctattacatgcagatgaggtattacagcaaaactttctaattatttaatatcaaattgtgttatcacaaatgttcaacctaaaatatattctaagaggttgatatcctcattatgataaatagcagctttttagaagatagccactacttatcaatctttcttttgatttcttattggctctcgtctggacttttgaactcctggccaccattcaactccctattcaaatgctgtttctttttggtatcctctctttcactggatcttctctctcctttccctttttctctaatacttggatcctcattatagtattttcattagtctactttttacagtcacatttggacctggactcatgtaaacagaaatggtgagatgtctctagagacactcattgaatcagggattacaattgtccacagtgggcagagttgacaatgtaaatgaagtaactcatcatgctctggaatcagacttgcatatacttgactaaggaacctgttttgtcctttagaccagacgtggtcatttaggaatcaagctaatgatctgtatccctggcaagcctatggacttcttggcttcacttcaagtataacaagttgagacatacttaatttgcattgaatacatacatatgtataggtgtacatatgaatacttctgtatttttaattaaatgagtaatttaatgagtgtttcattcactgggaagaagatgaatattgcttcttgccattgaggagctacttgagtagggaaaacaaaaaaaaaaggtaaagaaatcattgcgaacttgcttattcgggaaatggttgatacgtactttcttggtgcaagtcatagtaagctctatagtactagctgtgaaccagaaacaagtgctcctgcctttatcagccttacactgggatcttgtgtatgagagaaagcagaaagggcttgatgataacataaagaaaggaaggcttcttaaaagaaattatgtttaagtctttgtaaaagcatcagaaatattgagggacgtgaggatattttgtgcagagggataagcatgttcagtaagccacaacttttgacacttggatgactagaagtgggacaactattggagagtagatggatcttagaaggtgagagaacagtcaagtgtcaaggaagatgtacaaagaagaggtaggattcttaacatttggggcttttatgatatgctaaaaatttgatttatatgcattctagaatgatacagaaatccctccacaaatttttagaaaggaatatgacatgatgattttaccattaaaagccaacaaccacaacaataaagagcaaccataaggaagactagtggggtaaaattggaggcaggaaagacagttcagaagtcattgcagtacatcgggtaagaaataatgagggcatgaattggcataatcatgtcaatgttaaatgagggaagactcactgaagagacatttagaagaaaaaaccttcagaagttgaaaactggatatacaccatcagggagcagaaatgattctcaaatccttgactcaagatgtaaactatccaagaaggggaccatttggcattaaacttgagggtgaggaaagaggagatggagaaatatatgacttacgttgtgaccatgttgtgcattaaatgtgcgaagacgctcccagtcaagagagcatagctaataggaagcttgctatagttctggaaacaaaggcaagatgttacctagagttacacatttacttgagagttctcattcattcagcagatatatacttaccttccattctttaccaagtactgggcttaaagctagtgatgcagtaatgagcaggttaaggccccttttctcaaggagctaagaatggaaaagtgaataatgggtatttgagagtttaagctatatagatatttgagattgtccaggcagtgtttctactgtgcagaaaggcacatgtggagtcttatacagtgttaacattttgacggattgttgttggaggagaggtccttgaatgagagactgggaagcagcagcctctggtaggagctgaactgggaaacacatggaaacatagaacagtatacaatatgaaatgccataaaagtcttaaataaaagaagaataaaaatagcattttttatttgaaatctaagaggttatctgtgccccttttgtaaggagttatgacgtacttgtgcgcaggattcaacgtgtagtgctttgatgcaaaaatgcaaagcaccgtatgctggagcccatgagtaactgtaaaagcaaggagggctcatttcttagacaaaataattttttacaaaattactgtctctgttatattcaaaggggaagaaagtggaggaaagccaaaggatttatctatgtctgggacagagtttttcagagagtgaagttcatggcggatgaggcatggtaaggcggtagtgaatatgtttcttcatcaaagttttaatcaaatgacattttcaaaagatataaatcgctgttcacatggagcttacattctaagagggtaaaatagacaacaaatttatatctatatctatacacacacctttatactcacgcatatcaggtggtgataagtgctataaagaaatataaaataagatgagaagataaagaaaaatggcaggaggttcctaattaaagtaaagtagccagggaagactttctgtcgtgacatttcatcaaagacctaaattatgtgatgaagttagggtagagtattgcagggtgaggaaatgctgactgccaagaccctaatgtatgtgaatgtctggtatcttcaaggaatgccaagaaattacacagaactagagaaagtaatagaaggtgagaccagagaggtaaccagggcccagttgtgtgaggcttgaccattttaataatgaattgtagggtctgaatggtgatgtgaaataatctatcacaggttttaaagggatcgctttggtgcatgggtaaagacttgactataaagggttaaacctgtatgagagaggcctgttagaaggcacttgccatagttaaggggaaggatgatgtggtttggactagggtaggagatgatgcaaagattcatgatgcattttgaaagtagaggcttaacagttttgagtactgggtgaggggtatgggagaaaaagaggcgaccagaactattcaggaattttagtcggagtaatggtgcaggattaggctgaataaatatgaaggtgaaattgtttgggagatctgtaattcctacttcttacctaacactggcaattgcatgttccaaagagcctgcacatggtatacatttaatgaatgttggcattaattccatccaaaagtaaggatggagaggcagtttttgtttgaggtgcacaaattactctaggtactgttgttgctaagttttctcacagcaaaactgggtttctaatttattatcttcccctgaattctctctgcctgttactcctactgctcaaattaaatttattttgattgatttcaactgcaaaatgggttttatatttatatgtaaacattcgtatatctgcacacacacccataatgcacacgtgtattctgtggacacgtacagacttagcatggaccccttttctactgagtatttctgactgtggatgtcaggggcctcatctaaattatttgctttaggcatcattaaaccagcttctgtgattctgttgtagctttgaagactataatcacatgttcaaagcctggcaggatttgattgagaatgatggtggcaaaggagacagtaagcaaatgaatcagagttgtgtcatatcatctctttgggtaacagcgtagacatttaatcttagtgtgttttagtttgcctcaccaaagccagtgtaggaacagagctgtgcaattagcatgaaagttcatccaagaagaacaatgaaatgagaccagctaaagtttagtattacgtatatcatatctgaaatctgacacttgacactatctaaaaactaacttgcacttacaatttggataacattttctatggtgaattcgcatgagtttttatttcttataatatgttacatgagggcatttttatgcagagctacatgtatttacaatatgcagaatttagatttttaagaggtaggagtggtacaaacttttggggagatatttaaacctccaaaaattatttccttgaagtttcaccaggatattcttggaaaattgtttaaaactaaatttttgtactggttattttaagtgacaatttggctgtattatctcaggaggaacttagctattaggagagtggttttcctctcaaattcattttcttatatttatgcggaatttagttattttaaataatttgctgccaaagttaaatagtttattcataaaattaaataactgtgggtatcttaacaaccaacaaaaccagcatctcataatggttagagttagaagcgcttgaattattctacttggatttgtatcctgtttgtacccctagccaactgggtgatcttggtcaactcattccacttcatatacatacccatatccataagtatgttttatgagacttgtgtccttatttataaaatgcagataaaatagcgggtctcataaagttgttttatatgttgaaatgtgaaaaggggtgtacatatttattatgatgtttaaaacattgtaaatacttatgcactttttaaactgctttaagtatatgcatacatttattcatttttttaattttttttttttgagacagagtctcgctctgtcacccaggctggagtgcagtggcatgatctcagctcactgtaacgttcatttcccggattcaagtgattctcctgcctcagcctcccgagtagctgggattacaggcacgctccaccatgcccagctaatttttgtattttttttttttttttttttttttttttttgagacggagtctcgctctgtcgcccaggctggagtgcagtggcacgatctcggctcactgcaaccttcgtctcctgggttcacgccattctcctgcctcagcctcctgagtagctgggactacaggcgcctgccactacgcccggctaattttttgtatttttagtagagatggggtttcaccatgttggccaggctggtctcaaactcctgacctcaggtgatctgcccaccttggccttccaaagtgctgggattacaagcgtgagctactgcacccggcccactcaagcatttattaatgctggcttctggatgctagatatcttcagttgatgtagctttctgtagctacaacaattttagtggattttgctctgatgattaattcaaacctggaaaccaacaaaaactgccttcttcatttgcatgaatgaaggcacaattagacagctttgaggtttcacacagtttatttccagttatactgagaagttgttgcttttaatagtaaaattaatattcttttaccttttttgcttaaattcaagttataccttatgaagatatatgtgttttaggagtttttgagtctggggggatcaaagtgtttgaaagtattatataaccataaaaagatcagatgtagtgatatgatatccatgttgtaagaaattatttgtcctttactggcaagccttattccctaagtagctttttgaaaaaaatttccgatttatcctgctgcttcttagttgctcgagcattttaaaatagacaactttttgaatgaagatttgcaaatggcctgtgttttttgtcaataagtttattgtctcaccatcgttctctcagattatgtcttacataagatgtgtctatttttatgttttctaatttaatacttttccaccttattcttcgatattcacacactgcttgtattaaacctacactcactggaagataacaaggcatgaataattttcctgacagcaaatcagcattattgttcctgaaagtttgagttgcaagattataaaacattcacacttctgattttaaggaccattgaatttggggggttaattgttttctctgaagacagatttaaatcagataatggccacagtcctttgtacccagaaattgatatttttctagccttgtagaaaggtattagcactttggcatcaaagtacatttaatatgtaagggatgatgacaactcatggcattcagcctgttgaagttagtttttataaattaaattcatgtctactggagcaactttttttcgcacaattatccctacttttaaaaagtattattatttgtaaaccatctgctctgtgttagatactacgtcaggtcatataaaaattaggagagaataaattgatgatatcatattcaattctgttgtatgtctcatttaatcatgtctaaatcataatgtaggcatttatctgattttattagtgatgaacctgatactcagataaataagtgacctgcttaaggtcaaaactttgagatacagaatccttggactttctcttagaaaaacaacataaaatttatttcttgccatgctttgtagagtactttaatataaaaactagctgtgattaaaaatgagtgacgatgatacaactcataaatattgtttaccacctgccatttactgatctaaatgttttctgtctataaaaacatttaatgttcagcacaactctattgggtaggtattattattattacccatgataataatcagatgaacaatttgaagcacagagatgttaagtcacttgcctgaggtcacacagtttattaaagaagtgttaaactatgattttttagcctgccattgaaatagttttatttcatactaatgtgctcttttgaaagtgattcagttagtgaacctgaacatggtaatgattgagatggaagactctaagagcaataagccttttgcctagcatcctatagatttttcatttgtcacaaagtaaataaaacaaaagtattctttgcctatatgaactggggctcaagaactcatgaagtcagattaactgctactaagatcaatcagtctaactaaagtttatggtttaggcatatgaaatagaaagttgatcattttatttaaaaaaatgtagcacaaaatatagcttagaaaagctaaaaaagaaaaaacagttttgtttactggaggccagatttacaagcgatttttcttttagaacagacaacattaataaaattctaagactgtgtttttacatttgaggaatttttttaaatggacacatataaaaatatgcatattacacagaatttattaagtgagcttacacagttatacaactaataaattatttgttttcttgtctacttcttgatatgattatataattttttacataattgaaatcagtttatatcaaatattttgtatgatattttatgataacatgaaaagtgcttatgatataactaattttaagggctgcatttgatgtgtcataatatacaaaattcattttgaatctagatagattttagtttttcccctctattttgagaaataccacactaagcaaaaaattacaacaaatggtgcatttggcttttttctttttatatttaaggtgaattccttgagagaggattactgagtcaaactatacaaacatttttccaaattacctcccaaaagatatgtactttattttctttcttaaaggatccacttactggctacatacactttggtctgtacttcatcctaggaaaggacagtctatttttcaaacctttcacctttatagtattttaatgtagggagtttgtcatctaaacatttcggacccagttaatagagtttgcaccaatccttatgttacaaaactcaggatcctttagctaacctacaggaagtatttttgaaggtgcttagacccagggaagaattagacccagggtaaatggtctatcatatatttaaagtggactgcaaactaaaatttgtcttgtctttatagcagcatcagtagaattctgcaactttcgcacagcatttgtaaaataagcaaaatgtgcagtgtagttcactggaaattactgatgtgataccagtattttgggatgtattggaattcttcaaactgaaatttggcgttttttcttatatgcccacttagttttgtcatgtttacctatgaatttatttatactacatgtttactaaagtgtttacaacataaactaacatctcacattttaaaaaagtaaacagtgttagagattatccctgaatggttcaatttacacacttacacatgcacaaatactatgattattccttccaggagcagcttttaaaagtgcacagcctgtgtagttggagagttctttggaattccaaagccccctgctctttattgaactaaggtttaactggtgttcttatgggctcatctctgtgtcaggtgtccagaattcagcagcaaataaaatgggcatagtcctgacccttaagagcttcaatatagtggaagatttgaacaataaaaaaagacatcgtcgttccatgtaatgggaacaatgacaggagcagtagggggcatgatgagcgcagttaggatactgaccaaaaacatttctagggtcaatgaaagcatcccaggtgcatgaaaataatatttattgacaacatttgccaggcagcatgccaaccactttacaagcattatctcatttaacatttatatagttatatgagataacatatttccattatcctcattttaaagaggaggtagttgcaaattagagaagttaaacaactccttcaggttcacactgtaagaaatgatagagtcccagttcaaacacaggccgagttaaaagtatgagcatttattgttgaaaaaaaacttgaaagataagtgaagtgttaatcagaaggagagagaggttggggaaggaaggaaaggaagagcccccccctcaaaaaaaaagaaagaaaagaaactatgccaagtcttagaagacagaaagagcatgacaaactcaaggaaaattaagaaggtcattatttatgtttcttttaatgtgaaagacaaaatcacatgctataagaccataaaggaaaataatgatcagttcatgaaggatcttttaagataacaagtttgaactttattctgagggaactgtaggaccactgaagttttattaagaaacatgaccttttacagtttgctttttacaatgtttctcatgactaccatttgtgtattggagtagagggaatgaacaaaactgggaacagttaggaatagtaatttaggtactagataatagcagccaggctgggaaagtaaggatgatatcaagaagacatatttaaggattaaaaagacttaatgattggtttggactcaatgattggatgtttgtgtaggaagagagaggtttcaggaatgcaggtatgtttctgggatgggagtgaattcatggcaccattcatttctatagggaaaatggatgataaaattttgtgcaggaggatgatgagtttgcccttggacatattaagtgactgcagacatgtctaatttatagtaggacatatgaatgcacagttcaagaaagattaaacagggcatcaggatttgtgatttacatcccataacagtattcatatggtttcatgtccatgcataggtgtccaatcttttggcacacctgggacacattggaagaagaaccttcatcttgggtcatacataaaatacactaacactaacaatagcggatgagctaaaaaaaaaaaaaacttaaaaaaatctcgtaatgttttaaggaagtttacaaatttgtgatgggcggcattcaaagctgtcctgggccacgtgcggcctgcagggtgtgggttggacaagcttgcattagatattatgagaaacccttgtcttgcatcaatgtgtgcaagacaagaagcttgcaaagtgactaagaaggaccttacaaatcataggagaaaaagcctggaaagtgcagtgttgcagcaatgaaaataaacaattgggaaaggaaaatattaagagtcaactactgataggagagatattgggtgaaaagtaattttggtgtgaatagattatattgagagttgaggtagaaaccaggctaacagggtaatgtatgagtggcaggaaatattgtcatccgttacggataatttggggaagaaatttggctttgttgggataggatgggctgaaaggttatgtgatgacaaagagggcttttcgtttttgttttaaaaaataagagaaatttaatcattttaaaatagcaatggaaatgtatttagggaggttcctggaaaggagtttgggctgggggaagagaagattcaaaaattactctccagtgtaggccagaggaaggggatgtggatagaaagtgtccattacatagcatctactgtccttgagaaatgagaaatgaggtcatcatctggttacactgatgggagtagaagagaacaagattatttaaatgctccagaacagtggttttcagctctggctatgaaaaccaaatatcagacaatttatgttagaatctctaagaggtagcatctaggaattactactgcaaaagccttccaggtgatcacattgtgtatccatggttgagaactattaagaggattttttacctatcttttcagaggaaaaaaggagctgtcttgctctgtgaccaaggatggatttcttagcatttctgttttgcttgcaaaatggggataacagggcttaacctcactaggttgctgtgaggaatagctgagcaaagagatgtaaagcaactaccatactctctggaatataggaagtacacaatgaatattgactgtgttgttttttgtatccagatagaaaagaatcttagaaatgtgtttcatttctaatatctggctgttctatgtactcaggacattgggatagttgtattgacttcattggaatgcaacaggtagagaatagatactctagatgtccttacttccttttgtactattataataattcattctcagagttacaggatgcatagctgcatatggcttattttgatgatcgccattgtttttaatatttagacaactgaaagtataggattctttccagaaagaaagtctctgtattgtatggataattctgtaagcacaaaaagtaagatttttactgaagaaacagacatgaaaccaaagtgtttggatcatcaacttgtgttatctgtcactgaaatgcattacataatctttgacatacaaaatttgaatctgtgtatgatgcaaacacacacacttatacacatacatagacacatactacatacatatatactcaaattacaagctaaaaatttagtttccatagtataaaaataacctattgaaacttttattgctccatgtaaccgatacttataaaaatatgtaactttttgaggtatatattgcagaagtgattgctaactaggcttttgtctatgtgttcattttataagtacaacaattaagtgcctgtgtgactttttttaaacttatgctgtgtgtgtgtttgtgtgtattttttccttcacaaaaatggtatacatcctttttttttttagtatcagaagtactgccttatatctaaatcatattctgtgagccctccccacaagttatgtttttataccttgcttttataccttgctattcagagtgtggtccatagaccagcagtatcagtatcacctgggtgcttattggacatgcagaatctcagggctcaccacagacccccggaattagaatctgcattttaatgagatcctttgggtgatttgtgttcacagtaatgtttgagaagcccaagtgcctcaagggaagccttttcttctctagtagacattttctaatgagctgcagaggaaggagaatgtttattcctttaggaagaaaggatgcacctaattttaattgcttaactataaaatatgcataactaatgtataagggagaaagtaataagggttacattttagctagtcggctgcaaaataataattcctttattttaataacaaacagttgtatctccttttgtataaggcatctcttcttaccctgaactagttacaacttcattctccagtacttactctctgaaccaatgcctttatatggaagatctcccgttttcagagaggtaaacagaaaccgctgtggtatggcacaaatagggcatgcctgccctccactatttcctttttttggcatacaactgttttcaataatgtattacttagcctgtgtttatcaggcaaatgcagaccataatagttaataaatttttaaaaaccagaacaataataccaatatatctgtaaacctccactcagctcaaatgaatcagaattgctattaatataatgctgttgtaagaatcatatgctgtccttctagtaacttatttaataatagcatgtacatccccacaacacagatatgacacagattatttataagccgtttttattcacatacaaccctaatgttttttttcttgtcaccaatgggaagagataccctggatgtgaggcgggccctgagatggaggttagcatgcaggatgtttgttaggtgtggttattagaatcaagagaagtgaaagaacagaaaagcaggagtgggtacagggaggagttgagtgaggctacagtgcctgtgacagcctctgtgtactccatggagagttctggaggtgggatggctcttcagccttgtctcaagttgggatatggggctgacctttatatatgtggagtatgagtgtccctgcaaggaggaaagtcctcaaacgcagcagtttccttcgagactttctaaagctacgcttaagcgtagcacaaagtgagctgtaactctcacaccagctggggggaaaaaaatcttcattcttgaaggggagtctggctggtgcatcatagtatccgtcatatttccccttgagatgtaagtctaaagaaatacaaggtccttcagtatatcttgatactcaaaaagaggttagtactgttcaccatagttttagtcttaggagttttggttggtctttgaaaattgcccatttgttaatctaatacttagtgagaaccctctataggcagttctgtattatacaatttcttagtgttacaaagttacatagaaatcacaattcgtcaagaataatgaagcttaatgaaacagactttaaattcattaaacaaatatttctaagcaccaaatggtgccagtcactgtgccaggccttgagtttagggtggtgaacaaaaccaacgtgttctcagacctcatggaacttatggaggatgtagaggcagatatgaaacaaatagtcatgcaaataggcccataattacacattttgataggagctatgaaagaaaagcaaaatatgccatgcaagagcaatttgcataaaaatggatgaggagaattactgagaaagtgtcaggtaagatgagacctggagataagtgatggcaagagtggggaagaagagaacttgagacagtgggaagagaatatgctaaagctggtaaagagttcaggttcgctccttttctacctacctaccccaccaaaaccccaaaactatggcaggtggtactgtgtccggaattggtgggttgttggtctcactgacttcaagaatgaagccgcggaccctcacggtgagtgttacagttcttaaaggtggcgtgtccggagttcgttccttctgatgttcggatgtgtgcggagtttcttccttctggtgggttcgtggtcttgctggctcaggcgtgaaactgcagaccttcacagtgagtgttagagctcataaaggcagtgtggacccaaagagtgagcagcagcaagatttattgcaaagaacaaaagaacaaagcttccacaatgtggaaggggaccccagcgggttgccactgctggctggggcagactgcttttattctcttatccggccctacccacatcctgctgattggtccattttacagagagccgattggtctgttttacaaagagctgattggtccgttttgacagggtgctgattggtgcctttgcaatccctgagctaggcacaaaagttctccaggcccccactagattagctagaaacagagtgttgactggtgtatttacaaaccctgagctagacacagagtgcgattggtgcattcacaaaccttgagctagatgcagagtgccgattggtgcattcacaatcccttagctggacataaaggttctccaagtccccaccagattaactagacacagagtgccagttggtgcattcacaaaccttgagctagatgcagagtgccgattggtgcattcacaatcccttagctagacataaaggttctccaagtccccaccagattaactagacacagagtgccaattggtgcattcacaaaccctgagctaggcacggggtgctgattggtgtgtttacaaaccttgagctagatacagagtgctgattggtgtatttacaatcccttagctagacataaaggttctccaagtccccaccagatgaactagatacagagtgccgattggtgcattcacaaaccctgagctagacacacggtgccgactggtgtgtttacaatcccttagctagacacaaagattctccaagtccccaccaaactcaggagcccagctgaattcacccagtggatcccgcaccggggtgcaggtggagctgcctgccagtccagcgccgtgcgcctgcactccgcagcccttgggcggttctgggcgctgtggagcagggggcggcgctcgtcaggaggctctggcggcgcaggagcccacagagggtgggggatgctcaggcatggcgggctgcaggtcccgagccctgcctcgctgggaggcagctaagggccggggagaaatccaacacagcagctgctggcccaggtgctaagcccctcaccgcccgggccgacggggctggccggccgctcccagtgcggggcccgccaaggccacgcccacccggaactcgcgctggcccgcaagcgccgggcgcagcccccgattcccgcctgcgcctcttcgtcggcacctccctgcaagctgagggagccggctccagccttggccagcccagaaaggggctcccacagtgcagcggcgggctgaagggctcctcaagcgcggccagagtgagtgccaaagccgaggaggcgccgagagcgaaggagggctgtgagggctgccagctggctgtcacctcacagtgtagcggacaggaagaagaatgttgccaggcaggtaaggctgaagacttaagccggactatctcaggtagagcctaaggcggctgttgtccagaattcaggagacaagtattgactgtttttaatgatatgattagtttaccaaaacaaaaaaaccaaaaaatcaaaacaaaaacctatctgccatgtagaaaatggattcagcctagattgttgatagatagaatgcaaatattcagaggatgcagtaagaccacccaagagggcatctaatcaaacagagggtcaatgccatgcttgagcagagacttaagtatgagtgagtctcactgtaccattgatgggaagcaaaggattctaggtctaggaaaacagtaacttggaattaacagagactggaaactctgtctggtgtcctgaggttccacttagaataattagctgtataaagatagcaaaagaacatggggcaaaagagagggcaaaggctaagtcattgggctcctgagattaaggttaagaatttttccttttttctgaaaactaaagcactaatgaaggctttaaagcagaaaaatgaccatcagcctaatgagcatattagaaagataactttgttagtcctgagaaataaagtttgaagagtgattggtaagacttgacgtagggaaatggttagacagacatttcagtaatccagataataaataaaggcggcttattttgagacactgaaaataaagattgaggaacagaatctaaaaatgtttcatgtgaatctttatatgtctatttttatttgccagttttatttgataatccaaagtcatggggcaattttgatagttggaaaccacagttaccctattttagactgaaaatacaaatatgaattttgtgtaacattgctgttagggtgatattgtgagcatcagcattggtatgtgagtagcaggtacaatttaatataagttttaataggagactaagtaaaacattgttatataaatattttagtaaagaatcttgtattctgaagttaaatgacatacttttttttttgtttttgcataaacattgtttaggatcatctgtgtcctttatcatttctctcactgcagatctaagaagtttgaccaacttttaatagaggcccttacagtatgctaaagaaaagcattccaagataaataaaaacttgtcacagaaacaactatactgtaacctgttgtgtaaaaggaaccatagatttgtcacttactacctatacaatctagggcaaactgtttaatttttagggcctgtaagttggtcagggcatatatattgcagcattctacaacataaaactttaaaaatgagagtttcagtgatttttttaaaatttagatgtcaagtgaatagtagaaccaagtctaaatgaaggttccatttaattatgatactaatagaaatatctatatgggcaaagattaaaatcatatattcaaaattcacttatcctgcatttgcagagtttaatggggtgcctgacatacagtctctttatttctatgtactacagtttttatctgagaagcatttcttgttatgaagaagataagcagaaatgttatgtttccctaggttgagatcaaaggaactaaattggttttgacttctaccatttcagtgacctcaattttaatttaaaattagaagcatatagggaaattatttgccatctatcttacagcctggagcttaaaaaaaactgattagatataagaatattcatttatattcaggttctggaaccaaccctttggctctatttatatccttacagtttgataaaatgtatagttgttttctcatgggtaaatagaaaagagttatcatttatttatttgtttgtttgtttgtttacttatttgagatggagtctcgttctcttgcccaggctggagtgcggtgctgtgatctcagctcgctgcaacctccacctcctaggttcaaacgattgtcctgcctcagcctcctgaatagctgggattacagatggccgccaccatgcctggctaatttttgtgttttgagtagagacgggatttcactgtgttggccatgctggtcttgaactcctgacctcaggtgatccgcccgcctcggcctttcaaagtgctgggattacaggcgtgagctaccgcacccggcctagaaaaagatttatcagacaaaaggaacgaggaccttcaaccttactacgttgtgagcacatattttacaaattacaatgattaaattaaaacaatacttatatgggtagacattaaaggaaaatcagtgcctcaaaaaaggggatggtaaggctaacatagattaataacctcctgagcatacaatgtagctgaacatttttctcactgagattaccagaagaagtcggccattgttctttggtttgggaattaaacaaaagaatttgtttgaagtgatggataatttcagtatatacttgggttttgccatatagataaccagctaatgcttctgacttttctgcatagattgtttaagtggcacacatcaaaggggtaatagtttgggttttaattataatccattacaaactcacattgggattttaggcaagtgttaaaatttgctcaagcctcaatattttttttttcagttataaaatgaggatattaatactggttttctgtaactcacacaattgtaatgacaattaaatgaggtgtttatgatgaatgggaaagcatttgaaataaagggaagtgctatgcaaataaagtagtaatacccccttagatcacttaagacatgcctgcctctgctggttcacagagagaagtatttaatatatcctgatgatataggctgacagtactgcattagatattgtatgtgacctaattttttaaaaaaatctatgcattagtttcattgagaccaccagtcccttgaaacttcagcttttatagtttcttgtcagtagaaacatcctgtcttagttcagtttttgttgctgcaatggaatatcacagactggttaatctatgtagaaaagaaatttatgtctcacagttttggaggatgagaagtccaatatcaaggtgctggcatctagtgagggccttcttgttgcatcatcccatggtggaagggtggacaggcaaaaaagcatgtgtgagagagagtggaaggggactgaactcatcgttttatcaggaacccactccttcaataacaaacccatgcctgagatattggcattaatccattcatgaaggcagagccctcttgatctaattgcctctgaatagtcccacttctcaacactattgcgttggggatttttttccaatacgtgaactttagggatgcattcaaaccctaccacaccctcaccaccatcctttaattttcctgacttagatagaatagtccacaatgacagctacaccctggtcaacatccacaattcatttcctggttggcttcagtgcaaccatctggcatcagaagctactctggaacaagccacctatctacttccccatgactatgaccaatcctagtgttgccatagaaaatcgcccaactctgaagattcatgccattctgatgacattttacaacaggctagcaacaacacctagaagatttccgcatccatgggtcagtttccctacttattttctgtagtggctgcatcagacctcatgcaacttcctaaagatcagctttcgtcccccaccacctttaattgacaacagatggtgttatttgttttcactgggaaatcatcatcagctgtctgctctacctgaaacattctttccatatcaactttgtctacttcatctacacacctcccatttattcttgaggttacaacctgaggaaaatgtccttgatccaagtcaatgtgttttctcacactggaggacacatatccttataattgctgcttccttttcatgatttctctaactcaatgaaggcagaattgcccccttcacagttgtctccttaatgcctatcactgtgtctgactcatagttaagtgttcaataaatatttattgagtaaaaaatagtgatgtcattcattctcccatccccctccaaatcttcttcttctctcttttgtggctctcttcaggttaccttttcgttacctttaactttgacttaatgcaatatgtatttattaagtaactgtcactcttctaggcatatcaggaatttataaaacacatagttttgttctttgaaggatgttagaaaatgaaacagatatatgtggaatatgttataatagctcatatgaatttaatacttactatgttacaagcacagtgcttatcaccatgcccattatctcatttaatcatcactatgtttaaccaacattacatgttaattcctatgtaataatgtattagttttctctacatcatgctctggtgacataatcccagaatttcagttgtttagaacaataaaaacttatttttcgcttacaacgtatgttggctgtggttcagctgggattctgctctgtgtcttcttcactttgggaactaaacagaatgagcagcccctactcaagatatgtcttagtccttcttaggggttaccaacattcagaccacagtaggacttgacattcttgtgtcagaaggaaaagaaagaagtggcagaaacagttaacatcatccctgctcacattttgctggccagaggaaatcacatggccactcctaatgcccatgttttgatgtgttatacttatgaagagatgctgtttgctctgggggcatgatcaagagaattacatgaaaagaggcaagaatgtattattaaggagtgggaagccaatcacagtggtgagctcttgtagtcctagctactcaggaggctggcgtgggaggatcatttgaacccaggagctccagtccagcctgggcaatagagcaagtccatgtctctaaaaaaaaaatttttttttaagaaacagtaaaaaaagatgagggaggttgggcagaatctcccatgcatgtttgagtattaagaaaagtggcatggaaagaagaagggagaatagtaattcctaaagactagaccttaactgtatttaatatagggttcaagaatttgtgaagggacttggaattgtaaataaaaggaaaatcaagttctaatatgcaagaatatgagtggtgggagttaatgagagtgctcagtaatgccaaatgcatgtattcaggcataaagatcattaatttggccagcggaaggagggtgaccaaaatttcaaaggatttgctctgtttaagtaatctccaaatatttgttatgttgaagtatattacaggtaaatggctggatctaattttcagcattggagatgctcagtgattacagtcgtaattggacttcaggtgacaaatagtgggcaattttgccaactcatgctttaccttgtcttaattaaagtgatgttgtgccgttgtgcctcagccagcctgacccagtcacggtgaacacagatacccaatcatttactgctggggaaagttcaggtttgctattccaaaagactgaaagcccattctttcaatttctctcttcttccctcaaagctttatactgtatttgagccatacaatggcaaccagattcttaatcttatttaaaaattgttgatactctgaagggcagtgtataagctaattttataatttggaaattggaatagacaaaatttgggggcaaagtttatggcccaattagggaaacaattaggttatcctgccctctcatcagtatttgaagaagtatatttgtacgcatctacaatatacatctattattagatggaaagtattcacgtgtaatcaaatctttatgatttaaaaatttggaattcaaattgaagaaagttttaacttgcatttgccaaagatttcgtctaaacaacaattttctaagagtatctttatatatgttaacaatatcacagtggtgtccactatatatcattttgttccatgtgtcctggcacaggccacacagtgtcatgactgctagttattgctgtcattcaaaaactcagttattaatgtattcttgaatcagaaacagtgattcatagtttgataaaatattctgttgccattgagcattcctttatttctaaaatgtagcatcaattcgatgccttggttttcatattacatgcatggttaggtcctcatatccatccttcaatatttaacttcagatttaatgtatgccggcattaagccagggattatgtgtgctcctagccaagagcttcctgtgaacctttcattggagcctctttggtggccaagatgtgaaggaaagtttgagccatcggaatcaagtggatggctgtgtgctgggatgaggacaacaacagatcaatctgtgagtcagtcaggctccactgccaagagtagagcagccctggatatctaagtaataagttaaatttcaatcgcatttagaatcagtgttaaaaacctattcagatattgtctgtggtgaaaagtgtccaactggatgactgagtttgtcaaaggaaacaaaacataaaattcacagccttttaaaacgtcagtaccagaatcaaaaagagcaatatagctccttatgcttgacctgtgagtacagggaattacctactcatctgtgagttgtgctacgtgctcccttgaaagcccttaaggcttggtcattctgagattccatgtttgccatccgaaagctggagagatgtgtcactgtgccctttatctgcctcctcagatgctttctgactgaatacacagttctgagtcatggctacttccacccttcacttgatgtatgaagactttgacttacctgtgaaattattagtattagttttaatgtacttaaagctgtttgctaattcattcaaaaaaataagctatccatttctttgttagcagcccacctcattgtgatgatgacgcagctaactactgtaccataaagagtacaatttttattcatgtggtttatatttggaatattattattgggcagtaaaattattagttactatttatgattgtctagttagtagtatctaacacaatgctaggtgcggtatagacattgtttccaatcatattagcagttttgtagataatgtatctgtgtgtgtgtgtgtgtgtgtgtgtgtgtgtgtgtaattaaactgaggctcagagatgctattatatcaatgtatcaaaatcattataacctagagatttgtacttcagggctgtgtatcaaaaccttgattcttccatcctttcaacctataacaaaaaaaaaagaggcctgcggaagctagagtccctggatgggtcacatctgaccaccatgaaaggcttttttattccctccagtgtgccttgtatgtgtggcccttttctgtgattgctttgaagagaaaatttggaaaactctaaagtctactaagttgtggtactggaatttcagctcaagtctgcatggatccaaagctgtgttattttgcgtcatcatggcttagtttttttgtttttgcttttaaactcaatctaatttcgttcatgttccaagcttacggacatttgtaattttgtggccagttaaaagtactagaatagacattgtagaaaagtaaatgcaaagaagaaatgcaaggtagataaaataaaatattagatgcggcattcagaaaaattgcaaaaatgagcgacatacagtgccttcttgtaacacatttagagaacttaacatgtattgcagtaagaaaaattgaagtagagagttttagagagtcttgagaaaggacgggtcacattcagggagtaggggatgattgaaacatccagatagacatccacacagacttgatggacaggtaggcttttgataatgaggagcatgcagatggacacttggcaaaaggaacagataaacagaaatggaggtacaatgcctaccaactttcatagaattcacttatctttcattctgaattttgcatctgcaaaaagtgcaccaagataggtcctcactactttataggcatcggaatgatatttaagactgactgtgatacaatttatgagtggagcattttgcttgattagaagcagcatctcaagctagtacagttatttgtatttatgcatatgtttatccttgtctcccttttggccataatgatgataattatgtttctcaaaattgctctgagttttgccattttcacccctattgaacactgataggatgtagctaagagatgcaaaaccagtgaattcttagctgaattcagactctcagattcagcttatattgaaaactttttaattaaaaagttatttattaagaagctgtttgggttttttctaagtactggcattttttaatataaatcttttattaatccactcatttatgtacagtgaacatgaatttacccaccattccccaattacattgttcttcaagctgcctctgtctccatcttggtctacgtatactatttagtttgcacataatatgctataggcaaatatataaataatatgcatgtaacctaaggaaaaagcaataaatataaattagtttaccaagcaactcagttatggttttgtaagacatccataaagaaattgtgttaggagacagttaataaagaaactatatgagacctaagaactgtagcaagctggtaggtttagtgcagaaattgttttttaaaactgtactgacttgacagcagcatgcaagctcaccagtttttcatttaaaaaggactaataggccgggtgcggtgattcacacttgtaatcccagcactttgggaggccgaggtgggtggatcacctggggtcaggagttcaagagcagcctggccaacatggtgaaccctgtctctactaaaaatacaaaaattagccaggtgtggtggtgggcacctgtaatcccagccactcgggaggctgaggcagagaatcgcttgaacctgggaggcagaggttgcagtgagccgaaattgggccactgcactccagcctaggcgacagagcgagcctccgtctcaaaaaaaaaaaaaagactaatacaatttaagtgatcttagaaatgctttattattcacccagtttaccagaatattctactcttcactatatatgagactgttagatcttttgtaggcatatgagttgaatcccttaaagttctttatttagtaacaagatcataccaacagtggtgctctaaaatcattgctgtccggtagaacatacgtgagtgatggagatgttttatatttgtgctgtccaataggacagttgctaaccacatttggtttttgagcacttgatatgaggctagtaagaatgaggaagtaaatttttacttttgtttaattttaattaattttaatttaaatagtcacatatgattagtgactacctagtatatagctcagttttaactgattcatgtcatatttctaatgtttttggacaaatgtatcttgtgaacattttatatatgagctcatacaaatatggaaaatgcatttatagtccattatctaaaaaattgttctatttttatgttatgctttcttaggtgcaaactttagaaattagtgagatttcagttgtcccttttgtgtgtgacaacttctaaaagtagcctaaggaaccatttggcccattactttgtgcttaaagcagacccagtaattcacaggagaagcatatagaagagcgtttggaaactcaagacaggcctcaagcaaaaggtgtctgagataaagaagtacgtgctccaaaactgtactggcaggtaagtaatgaggaaggagaagttaacatcattataaaatttaggtcttcttctttttttggcattttaacccaatacctagaacaataataaaacaacaattatcttacaaattatataagtagcataaatgcataagcagacactgttaacgtatctcttctaattggctaatttagagtttactgccaggaacaaagtagtctggaaattttagcagcgtatcagaggaggagcagacaatgtgcagacacttactttggttctcctgtcaaatttgacagtaatggcccttcatattttactgtctgcttcaaaattcagagtcaaatgtattttagttatagcactgaaactcacagtgcttattggtcttatgctgagattttgtggtcctgatctctcttcctcactttctctcgctcctactcattcctcccaggagacgtggagtaacttttgttcttggagagattggaaggaggaacaaggcctccccctttagtatttccagccccacccatgctagtgccaaagaccccattgaagggctcaggctcagattgttccagtgtgtcagtgctgaatggacatggtcagtccactcagttctggggtcagtatcaggcatcccatttgctcacagatttcagtcatactttacaatttccactttattaataatcacggtgaggtggggaagaggtttgttatttattagacccctttgaaacctaatagttctcacctaagctggtgataaatgagattgaggctttaggattgcctattagaatatctgggggactgtgtcaatgtgcatttgtcctcttccttctatcctctgtctaactgacctaattcaactgcagtccctgtaaatatctccactgagaactggcttaggatattggaaaagcccagttactattctacttagtgtagacttgcacattccgcatttcagacttttaactacaccaggctactatactgtgaaacattgttgtgtatgtgggcttgggctagaatcatacactttacatttatcttggtcagtccctcaatgcttaacatagccattgatctgtataactggaattactcttaatatgttcatgaatttcaaattttatattgatttttagtaaaatgttattatagaatggttaaaatcactattttggtggaaattaaaagcaccactaaaatgttatttttaaattttctgaatctttttttattaattcaacatctgttgctcaggaggtcaaggcaaataaaataaatgtgtttgtcttttttatggccatacatctatgagaaagaatataaaggcaaataataataataataataccacatcaggaatatgaatcaaatttgctataggatttttttaaattaaataatgaattctacccgagaaaaaaataaagcaaataggtgcttactaagcccaccaattatagaatctactttgtgactgccaaatactaataataaagttaaacttatggaacatttactgtgtaccagatacagagccaaatccttaatagatacaatattctaaaaatccaaaccccacctgaagtgggtactattattggcaccatattatagaagagaaaagtaagagatagagaaattatgtaattactaggccctggaaacatgtaccttaacatcttacaatgtggaattggtttaaatctgagatgcatacaaattgctacacttctcattttcccttttcttcagtagaggttttatctgatcagatagcgatttagatctttgtcccactggagggttttaaatcaggaaacttggcctttttaaaatctctagccatttttaagaatcactcattggtgaacacttctaatttatatggcttcatggaagcatgttgtattaaaattaatctataatttatctgtgagttagcacgagtgtggaaataacattaatggaaggccagtattgggtgtaagagaggtaggcttctgctctataaaactgaatgaaatgcatctgagagaaatcattgatttaaaaggtgaaaaagtggccggatgcgatggctcatgcctgtaatcccagcattttgggagccaaaggtgggtggatcacttgaagtcaggagtttgagaccagcctgagtaacatggtgaaaccctgtctcttcaaaaaataaaaaaattagcgcaacatgatggcaggtgcctgtaacccaagctactcgggaggctgaggcaagagaaccatctgaacccaggaggcagaggttgcagtgagctgagatcgcaccattgcaccacttttttttttttttgagacactgtcaaaaaaaaaaaaaaaaagaaaaaagaaaacaagaataaccaatctctgggcaaatttaaacaacattttttatggggaaaattgatttttgtccgggaaaagtttatcataacttctaaataatctatataaatttcttctagaatggcacaaattctgttgtcaacccctccaatagagctacatagtagccatatttaacacaactccaaatattgcaaagatgttttaaatgtgttcataactgatgaaagaaatttaaaatagttcatataaaagtataggtaaaatttttaataagtgaatgggggtttatttttagtgtgacatgaaaagttaaccacatgaaatcttttaccagcaaagaaaattacattgtcatcacgtgtgatgaatgttgataggacagatatgtatcattcacaaaggaaatcaggatagctatatataaatgtatgtgcagataacatattaaatccatatcctagattgtttgggtgttttcagccctcataatatgaagtgaatctctctttcacaataaataatatttctgcaagttcaggatttgtttatttctgggatggttggtgggtgtgcgtgtgcgtgtgtgtgtgtgtgtgtgtgtgtgtgagagagagagagagagagagataaatgaagtaaagttgcctgcaaatagtagattcagaacttcctccccaaaatatgcattcccctcttctggtaaatgtctgaagtctaccttgcagcttgttttatttcttttgtttaaaactttgctaatgtgttcagatgtagaattcatttgaataggatatgttttcagcagtttgcagtctaatgaacaacggggcttttggggtcacacagagctggagttgacccttgccagtagctggctgagtggccacagggaaattatttataccctaaggtctcctcaattatctctacaggaaaataaggtaatggtagttacttcagagttggtatgaaaaagaaatgagaaaactataacaatgatcacaatggctggtgtttggaaggtgcttaaaactcaatgtgaacggctttctgagattcttctctaacttcggttttcaatacccgcaataagggaaagaaaatatggtatcagtaggtctccagaggatgctaaagtgttggagaggtgaggaaggggaaatattaggtcctgctaataaacttgatcagcttttaagtatcgtcaggtttagataactggagcacatttgccttatcaataagtaccatattttaaaatagatatgaattttattctgtgtatttttacctggtggaatatgtataaagtacacttaatttcttgtatataacacatttcctatagaaatgctattttagcacctcttgtgggaaaaaaacaaagtatagatagcttttaaagagtaccaacagcggcaaattgcttggagaaggtatagaagcatacccaaatagtttctcatagccagtaatttaaaaaattacgttataaatgctgtttgagaagttgaaagacagatcaccttggaatactaataaaatttaaaattgagatgacggaggttctaaccttcgacatccagaactttgagcagcttaagaaagttatatgactcaagtttttgttattgttgttaaagcttgtatttgaaaaaaacattttgaagtattagaaacataacaacttattattttagattggtagtttttccatgagtatatgtaacctcctaaattacatgaattctattgaataagcttttatactgtgactgtggggtgtcacactttatgccagatgacagcaatgaataaaacacagaagatctatctatctatctatctatctatctatctatctatctatctatctgtctatctatctatctatcacatttgaaatataatttggtgaatgcagtgataaagtagaatttgggtacagaatagggaaatcatatttcttggattcagcattcatttggaaacttgcgaagtattgccagataagatagccggagtttcttcccactaaacattttgtttgagtcccaaataattttttaaacttgtgattctgtggtatctctgccttgctaaacacaactttccactcttggaaagtaataggttttagtgtttctctgtttactgagcaagtgcttcacataggtgagttactctgctgttgctccccataattgctttttgatgtgttatgttatactgttggccaataaagtgcttgatcaatatgcactacatcccagataatcctgttattttcattggctctactatgctttgtttggcatgtggctttccaagcacttaagattgggaacatctcaaacgtaacatcagaactgaatgcctactgtttttttattttttgattatggccattttggcaggagtaaagtgatatcacattgtggttttgattggcatttccctggtcattagtgatgttgagtattttctcatgtttgttggccatttgtatatcttcttttgagaattgtctcttcttgtccttagccaacttttcgataggattgtttgtttttttgctgattttttttgagtttgttgtcgattctgggtattagtcccttgtcaaatatatatatagtgaagattttctcccactctgtgggttgtctgtttactctgctgactgttccttttgccatgcaaaagctctttaggttaattaagtcccagctatttatctttgtttttattgcatttgcttttgggttcttggtcatgaaatctttgcctaagccaatgtttagaagggtttttccaatgtaattttctagaatttttatagtttcaggtcttaggtttaagtccttaatccatattgaggtgatttttatataaggtgagagatgaggatccagtttcattctcctacctgtgacttgccaattatcccagcaccatttttgaataggctgtcctttttccactttatgttttttttgctttgtcaaagatcagttggctgtaagtatttgggtttacttctgggttctctattctgttccattggcctatgtgcctatttttataccagtaccatgctgttttggtgactgtggccttatagtatagtttgaaatcaggtagtgtgatgccctcagatttgtcctttttgctttgtcttgctttggctatgcgggctcttttttggtttcatatgaattttagaatagtttttttctaattctgtgaagaattatggtggtattttgatggggattgcattgaatttgtagattggctttggcagtatggttattttcaccatattgattctccccgtccttcacaatattgattctccccatccatgagcatgggatgtgtttccatttgtttgtgtcatctattatttctttcaggagtgttttatagttttccttgtggaggtcttacacctccttggttaggtatattcctaagtttttgttgttgttgttgttgttgttgtttgtttgtttttagctattgtaaaaggggttgagttcttgatttgattctccgcttggttgctgttggtgtataggagaactactgatttttgtacgttagtcttgtatccggaaactttgctcaattattttattctaggagctttctggaagagtcattagggttttcacgataaacgatcatatcatcagcaaactgtgacagtttgacttcctctttaccagtttggatgcccttactttctcttgtctgattactctggctaggacttccagtactatgttgaagaggagtggtgagagtggacatcttatcttgttccagttctcagagggaatgctttcagcttttccccattcagtattatgttggtagtgagtttgtcatagatgacttttattacattgaggtatatcccttttatgccgattttgctgagagttttaatcataaagggtgctggattttatggaatgctttttctgcatctattgagatgatcatgtgatttttgtttttaattctgtttatatggtgcatcacatttattgacttccctggtatgaaacccacttgatcatggtggattccgttagctagtattgtgttaaggattttagcatctatgttcatcagggatatcagtcagtagttttcttttttggttgtatcctttcctggttttagcattagggtgatgctggcttcatagaatgaattagggagggttccctctgtctctgtcttgtggaatagtgtcaataggattggtagcaattcttcattgaatgtctggtagaattctgctgtgaatccatctgatcctagatgttgatgtggatgcggtgattggggaacacttctacactgctggtgggaatggaaactactacagccactatggaaaacagtgtggagattccttaaagagctgaaagtagaactaccatttgatccagcaatcccactactgggtatctacccagaggaaaagaagccattatacaaaaaagatactagcacacacatttttatagcagcacaattcacaattgcaaaatcatggaaccaacccaaatgcccatcaatcaacaagtagataaagaaacttatatatatatatatatatatatatatatatatatatgatggaatactactcagccatagaaaaggaatgaattgacagcatttacagtgacctggataagagtggagactattattctatgtgaagtaactcaggaatggaaaaccaaacattgtatgttctcacagatatgtttcagctaagctatgaggacgcaaaagcataagaatgatacaatacaatgaactttggggacttgagaagacgagtaggagggaggtgagggataaaagacaacaaatactgtgcagcgtatactgcttgggtgatgggtgctccaaaacctcaccaatcaccactaaagaacttactcatgtaaccaaataccacctgcaccccaataacctatggaaaaataaaaaagataaaaataaaaaaagaactgaatgcctgattttccctcactggacctgctcttctagacttttgtttttttctcagtaagtgataaattcattcttttagttgctcaggtcaaaaaccttgactcccttttttctctccagaccaaattccaacctgtcagcatagttctgcttctacaaatatccagaatccagccggtttctctgctactaccctcatccaagtcacatgtcatcacctgtcaactgaatcacagacaagatcctaactagtctcctgcttcttccctgtgcccctccagtctgttttcagtacagcagccagagtgattcttttaaaacttacttttacatctttcagctgcttagaactttccagtgactccttgtcttattcagagaaaagccaaagatctttacagtggcatagcagttctatatgatcaggcccttgttgcctctgaatttcctttttacagtgcctatctcctactaatatagccacctggactttctgctcagtgttcttcatatatggacgtgcattcacccatttcacagcctttttatttgtatttgttattccctttgtttgaatgttcttccctacgagcctcacttagaattttctcgtgaacatcatatgctctcaaatatttttgcaagaatgtatggatttagtgggacctacacaaaagttgacatataagttgccttactgatgtctgtctgaggatcatgttacataattaggattatttgtttctcacagttctgtccagaaaaaagtggaaaagtcttaataaaagatgcgcaattcacgaggaactacttgtgcttattcctaagccagtgtctatgagaaatgatacatgctatgcatcattcagtgatatctttcccaccatgagttaaaggtattactcaatggagattaaactgttattttattgggcttacattatgtctctcaaaccattaccagtgacattgtggtcatggaaatgtaaaagaaaatcatagtaatttaaataatgacaagtcttttagagctttgtattttttattattaggaaaaaacaataaatgtaagtttatcagaaaaaaaaatggctgtgatgcaattcaaagtattaccacaatgcttgcttttatcatattatgaacacttttcctgtggggctggattaggccatttctaatatacacaagagtattaacctcttttaagtattcagatagccattgactacttatttgaacatactgaattaagtttgcttattaaccagttttataaaatacatatcccatatcccctctggcctacatgatgcaatcaaaaccacttactctggatgcaaggaacttcctgctttgtccattgatctgatgacctcactaccctattgcttgcaaggaccctctaaccccctgccctctatgccctcaaaattcagctcattgacttgtatgttatgaaccaaaactgctgccattgatctttggtgtccaaccatacaatttgaaccatttcccagtttaaaatgtttattttaaaactaaaggcacagaagattgtatttaaatttttattttgcctaaggaatagttatgttgatatatagcaactaaaataaccttatattttccttcttagctgcagtaaaattcaagaaaggtgaaaaataagtggatgaacaaggttcatatatcactagttgtaatgttttcttaaactataaatgaaattgaaatacctatctttgtaaatatgcactttattttcttcttttccccatgctgatctctttcataggagagtaaagaagttacagagatttggaagcagcacatatctggagatgaatgtcaggcaatttgtgttctgctaaagtgtgcaatataatagagaaccataggtttttttccttgggtatttatatcttataacaaatcttaactttcaaagtaatttgactcttgctagtcattgaccaaataatctttagcaaacaatagtgcaaattttttaaaattaaggtgttgaaaaattttcctctaccatttaaaatttagaaaaaattagttacaccagtgcgtgtgttttctttattcaggcatcctaatgttgtaacttttacctatacaggacattttttgtattactcattaagctgctaataaaatggcaaagtttaagcagtagggaaaaccggtgaattattttacaaaattctctgtgcttcatggagcgaggcatttcagttttacagaagatgcatgctttctgactcactcacagcagctctttttgtcctacaaaccatttcttcccagtgggaaacagatcatatcatacatctttataagtatactgtgcactgtagggaagggtggtgcattttcaaagtaatatggtggatctgctgacacaaggcaaacagtacctttagtatttagcctcagatgtaagtttttagctggaggccatgattccaagattgctacacacagtcaggtctcaattacccctactgatggagaagtgcaggtatctcatgttctgacatgtgataaatataataaatacatttaaacatatagaatatatatttagcttttgaattaaattgtgttccacacaatagatacaatttaaaaagtttcattaggcccatatcaaaatttagctttctttttggagtactgatgttgacagaaaagcaagagattccaaattatgtgtcaggaagaaattacgtgggattaaatactttagcctggctggtagatcaactttgcactttctatatctagttcatttgtccagttcatgcaacaaacacatatgttctagatactaaggacataatagtgagtatggaaaggaaggtccttgatctcataaactattaatttagttggagggaaataaataataaataagtcaacaaattaaaatgcaaggtaatttcagctaatgatatgtgttatgtaaaatagtgtatcagattaatatttaacacactaatttgggcaacaggcaccattagatatggtgtttgaagacggcctctttgattcagcaccatgaaggaagagacttggatgatgaccaggagatggccctttgtgtggactgagcatatttgagataaaccaaggccacactaaagagtgggaagggagataaggagagatggggaaggaattggattactgggggcattacattatgaaatatgtgtataccgtatgatcaaatggcaatagagattttgaaaacctactgtaaaatcaaatttgccttttgtgggggattatcagtcctcaatttttggaaaggtattccacaaacgtccttcagaacttaaagtgattttgaggaattctgattaatcttttttttttcattgtaaccattataaagcttatctataacactatgggaacattgggcattgccttaattttcctgccttgaatatttgctgggctgatttgatgtgattttctccattctggcaagtgatcttattctatctgtaatgtttatagaaaaatgtgaaagatacagcagtttctgatcttctgtttaccagctgagtcatccattcccgtgtgtctatacatctctcttgtagttaggacttctacattttagtacataaagtccttgtagctataataaaaagtgtgtgcatgtgcatccatatgcacacatatacaaacacacaaatattgccacttaactatttttcttcttatctataagtgaaaaagaatgattgccttcatctgtctcgttgaaaatttaaatgaattcatggggtcctggtcaagtgctgtgttactcattgaaaaaaaatgatttgccaaaggcaaataaataaacctaagggaactcttatgactagacaaatgtctgtagcattggtagcacagggcattttaaactatgggggaaaagagagaggaggagtaaaagaaaatgagacactgaaaatggagtctttcagttatgcatgcgttcacagcatacaccccccccaaccaagtttagtggtttaaaaaaaaaccatgaatttgtgaatggtgtggtggttcttctgctggtcttgcttgtactgtgtaatgagcagtcctgtgcaggtaggtcagctgggatggctgggcttttctctatgtggcatttcagcctcaaaaagaaagccagagcaggcttcctgagagcaggcaatctcaaagtaccaaaaggttgagaatgaggtctttttggaaattgcaagatcatttccactgaaagtcatagaaccagcccagactaaaaggatgtggaaataaattcccgttcttgacaaaaggggctgcaaagaatatgtggtcctttaaaatttgagagagagtaaaaccaagattgaagactaggttgggtgtggtggctcacacctgtaatcctagcacttttgggaggctgagactagaggatcacttgaagccaggagtttgagaccagccatggcaacaaagaaagatcttgtctttataggggggtgagggtgggggggggtggggaagctgtgaatggtggaacacgcctatagttccagctacttggtaagctgaggtgagaggatagcttgagtccagcagtttaaggctgcagagagctaagattgtgccactgaactccagcctgggtgacagagcaagaccccatctcttaaaaaaataaaaataaaaactaaagaaaaataataaacatgggatgagagtggtggaggggagagaaagggatggaggtgggaaggaaaggagaaagtgacatttgaactgccaacatgaaggttacaaatattccttccaagttttattctgttaatcagccatatgtaagttaagaaaagtcttccaaaggcttggaggctgtgtttggctgttttcatattgctataaagtaatacctgtgaccaggtaatttataaagaaataaaagacatttatttgactcatggttccgcaggctgtgtacaagcatggcaccggcacctgctcagcttctggggaagcctcaaggaagcttttacctaaggtggaaggtgaagagggagcaggcacttcacatggcaagagcaggagcaagaaagagagcagggaaggtaccacacacttctaaacaaccagatcttgcgtgaactcacaaatagaaagcactcgttaccaaggggatggtgctaagccatccactggatctgcccctgtgatccagtcacccctcacccggccctgcctccagaattggagattacatttcaacatgatatttagaggggacacatccaaatcatatcagagactatgggtgctgggtaggagaaggaaacgaggaagggaagagagcagaaagagagaacaagagaaacagagagagagagagagagactatgagggataagtgggggaactggaaacaaatcctcattctaattttagctcaatcattggacaaaataaaagtatttgctaatcagcattatgcagaatataggtatcttgttagttcggtggaatgaccgggcatagcactttgcagtgtgatatcaaatatgaccccctttgaagaagctagtctttcgacagtgatgattttatgtctatggtatacaatttgaagatgtactctgatgttttggactgatacatcattatgtggaagtagtgcagactgatctattcgtgtaataaagcattcaaatgaaatccgatagtttcattaatgactaagaaaggattataaaagcaaagtcaattagtagtgagacaggaaaaattaggattcctttatttaaatctttgaaggtggaaaaagtaaaaatattgcctgtctctgcatcttggcagacagactgtgttgttacttagagagttgtggtcccaattcttattggggtagattatatatagactcatcaatttaaacccctaaattggctagatgaacttgtaagaagaagcaggctcccaaggctttgtgtgggcaacaactggaagtcctatataggctctacttaatgtaggactgatggtccatcttgtttccttcttattgataactttagccattcagacgtaccaagtacttcacttggactccagtgatatattcaatcagaacaaagttcagaagtgttatgcaggactaatcctaacgttccgcactgtggagccatttctctatatagtacaacgtatttcacagtccttgagccctgaataagggaaatgtatatgttgggctacttttcaccaagctctctcttttgtctggtttgcatgctacagacaaactggtggtaagttttcctgccattggaggcctcaaggaaaaagtctaacaattttctgtctgtcacttttatcctccaagggggcaaaaagaaattcctgtgcaaactcttccttactgtaaatagtttttgatagagacattgcaggaaactaaaaatatgcacatttcaacctaaaaagagaaggaacataggtggtctcttttttcctgttgtttttagaaaaattgtgatttttttttttaaataaagagcttcagagctctgtaaacaccctgtaaaataaagttgaattattctactgttttaatgagtgattcatctgatcagagttaatgctgttcatttctcttggctcaccatgatctggaagcaggcattaattagtgcttttagtgcactcactccatgctgggactctaggtcttacccgtgtttttggattttagaatgactggcactcatagggcacttttgtgactgggtctgtcgattggttgtttaacatggtcatttcatagaaacattacattgctggtagaagatggaagcaaaatatgtgtcacttactttaaaaaaatagtttgttagcattcaaaatagtcacaagttttcagtcccgagaggagctttcttaggttaataatgtagcgtagattgtatcatttattctgcatcataaatgtatcattgtttctgaatgagtaaatttcctatagtagccatacataaaacagtgcatagcgactccaggaaaataagcctaaatcaaaactccgaagctgggggagagaatataatttttgtacttttatggattcaatagatttccttgtagttaaatcaagttcaactttcattaaagaatgtcttttagcataggcccatacatacacagactcgctttcatatgcactgggctaacagatctaaacactattcactgatgtagctaaaacatgaccctttgaccttgtctcagatgccactgaaatgggaatgaaaaaatcttttacccacattttttaggaacaacattttagttttatctcaactatgtatataactctgacatgctattgtctttcttatttaaaataagaaatgttttaaataaaaccatttcatttcactgttgaataatggaaaaggaaatgaatagagctgttttatcctacactagtaacagaaaatagctttatatgtaagcatcctttatagtttaagggtcataccttaaactatttctttttaatcctttgtcatcttccagaaagataactgcctttgatcaatacagatttttttttaaaaaaatttgcttctaaacctaggatgtagagactggtgaagaaagtcacaaaagtattcacttcatggcctgtcacctcaaaggagtcctttatcttgccctataaccacagctgttccaaacagcctctcttcattgttctctttaaatattagagaccttcactactttcttcatgcctcctgtctcactcctcatctctatttagctgatggccctgactagtatttattcgacagagcaaaaggaggttgccaatatacaacatagtcagtgctcaaaaatatttgttaaattaagatgcttaggatttctgtttgacttcatataaaatattttgtcagcctgtactctaaaaaacttctgaaaacatacttatactgttactctagatagctatacagtcttataaacagtagatattttgtaccacatatctctgtatgttgtaagaaagtgctatattaacagcatacaattttggtatcactaaatttaaaattcttgttaaagttgctcattaaatcatgggaaacctactggctaacattacttttttcattacttggagatgacttctgagcaatcagacagacagttgaaagctgccttttggcagtagggatggattgataattgaagtgcagtgcactcttccctactttttttttttttaatgatccgatgagaaaagacacaactcgtgtagtttaccaggacaaggatgactgaggttggagttgtgaaacataagcatcctcacctgtgggtttagatgcattccttttatctcaacagcatagaactccaataaatcaagactacagagagtcctggaaaaagtttggacacaattcttactacctttaaaaggaaccatgtagacattcattcaataagaattaggtcaagtattagactattttcctgggacaaccatatacgatatttttaaaattttttttgagacaatatcttgctctgtcatccgagctggagtgtggtggcgtgattgccgctgactgcaaactctgtctcccggattcaagtgtttctcatgcctcagcctctctagtagctgggattgcaggtggacgccaccacctgcaatccccaaaaaatacaaaatacgaaaaaatacaaaaagctgcttttttgtatttttagtgcagacagggtttcaccatgttggcgaggctagtctcaaactcctgagctcaagcaatccacctacctcagcctcccaaagtgctgggattagaagcatgagccaccgcgcctggcccatatgcaatattatagaagagaaaattcaatgtagccatgtcgtctatatggctataagtcatgtatgtcacatttccttgaaaatttgaattacacttctttattctgtatagtgtaaactaacaaccaaatcagctcttattttggctctgtggagtgacattattgaggatatgtgaaatatgcagtaggttgtctatataaatatattaaatctttaatttgtatatattttatacattccaaaaagacctcttcttcattttaaaacacagagttgaagggacgatgacacagaataatccatcagtagacttgattccgagccctggctctagcactgacccactcactgaccagcagagcaaccttgagaatgtaatttacatgctcttgtccttatttatctgtgaaaggaagagatggggacacacttatttttaaaaatctattccagttctacattagtataattttagaccagaaactcgcaaaatgtatgcaggaaatgttgtcaaagggggaaatggaggcaaagtcagtaacttttttaaggcctattgtttggtatgggatcaaattcattggtggggtcaaatgaaaatctcatgactccttattctaagcaagtgctactttctactacttcttagaataaataaaatattgaatgcagtaaatagctgtgtgtaagtgctttgagttccatatattgccttttccttttgtgcctaagtatacatcagtaattatcttaatttgatttgatgccatttgaataaaatgcaaaaaaaaaaacagcatttgtcttagtttccaactgacttcattctttcctgatagcagattttctatgtagttatgttttagatggaatggcttaacagattcgttttaagttaaaatcattgactcaattacagaatatcttctttgtgcataatgatattttgaggcatactagaagaggacaggcataatgtcttcccaaatggtcttagtatctagtttaggagatgaaataaactgatgggaaacaaatagagaatgacatatggtggttgtagcacacgagattcgtaatttgaactcagacactttctactaaactaggtatatattcactaggtattgtgtctagatttttaaaataacacttccttacaatgtatctcatatcagttagttctcctaattattgtttctgtggagaaagtctttgaaccttatttaggtggggaagagtgtagagacagttgtagcttgaaatacatagaacatactgtttatcattttaattctttgtcagtatacagattcagtggcattaaatacactcacagtgttgtgcaaccatcaccactatctatacccaaatcttttcagaaattatctctaacataaactgtacccattaaacaataacttccccttccctttttcctcctagcctttggttatctctattctactttctgtctctgtgaatttgcctattccagatacctcatgtgagtgaagtcacagaatatttgtacttttgtgtctgaattattcactaaacatgttttcaaggtctatccatgttgtcacatgtatcaaaatttcattatttttatggctgaacaatacttgattgtatgtatatatcactttctatttatccatttatctgtggatggatacttgagttgttttcaacatttggctattgtgaataatgcagctacaaacaccagtgtacaaatatttgttcaaattcctgctttcagttattttgaatatgtacctgggagtagaattgacgggctatgtagtagttctatgtttaaccttttgaggaagcaccagactgttttccacagcagctgtaatattttatgttttcatcaacaatacataaggattgcaatttttcaatatccttactaacatttgttattttctattctttttaaaatgataaccttcataataggtgtgaatttgtgaagtcctagctttgtggctctggtttgcattgccttaatgaataatgatgttgaatgcctttttgcatggttatggcagcttgtttttccagcatgtatactaaagcacactttatgactatgtcttatagacactttacttgtaaaggtttatacgcacgctcaatgtcttaatcaatcaatgtttttttcttgggtaattatatctagaagtggcaagtccagactctgtgttttgtgtgtgtgtgtgtgtgtgtgtgtgtgtgtgtgtgtgtatgtgtgtgtggtgtgcgtctctgtgtgtgtttaaggaatcttccatatatttaactctctctaaaataaactataattgactatattttttaaaggaagccatagtagcaactactaaacccaaccaaagatgtgtgaaagtattttaaagttgttataataattaggagaaaggtgtttggcaaaggtctattgtgattcaaatgactataaacttgtcatatttatattcataagcaatgaatataaaagaaagggagatattataaagttattttttacattttccaatttctgagatataaaaatacaaagttaaaagacttaatgtattccatgacacccccggggctagtcatattatagttggaaaattttaccaacattattaacttacgttcattattgaaaaagaattttggtgaatttgctggaaagaaaaaaaatacaggaaattgtcacctataatatttttcccaattgacttcagttttactgaagaaaaaaagtaatttctttaattaaaatattcattttgtttaaaagttggatagattacttcatatatatcatttattgattacccaatcttgataaatctgtgatacataatcttgaatttattttaatgattctcttagattttttaaaccgattacccagaagatttaacctttaaggggaaattttcatgaccagagtttagtaatgaaagtgtctcataactgcttgaacatacccctctatcacagaaactctcagtcatctatatagtaagaaggttttgatgggattttgaatgtatggtctcagtgtagtaacacagtgagtcgctaacaccttagcatgaatccttgattttatttagctactgattaaggcagagcagggctcttacagaatgggcttatctaccaggatatattagttatggatacaggctcttgatttggacttgaatcaagactccatgacttactaatttttaggagttaggaaagcttcctaacctctacaggactagtttcttcatctgcacaaaggggaataacaaaatactaacctcacaaggatattttaaaaattaaataaaccactccacttagcagaatgcctgggagatgttacatgtttaggtagtattagctgttaatcatattggtagtaatttttggtaggggtatgaggatagaaggaaaacagaaaagtacaatttctaggcacttgctgtttatttatgtcacaaggagcccttcaggacagccaaggataaaacgggcttcctgggaggagacagagtggggaaggtgaggctgaaagtgaagctggataatggtcaaaaacaaacgtcacgtgcatgatacttttactgtggtccctgaatatatgaaacatcaaagaaaaacataaatatggaaataagcctctaaaatggactttccagaatgagtcagaaatgctttctgaagatgatgaagagctaaatctttatctgttttcaggtttcagttcttagggtgagtcaaatgcttaaagttagttaattctcatgaaagtcctacttcttgactctagaattactagaacaaaactgtatgtgttttggcttcctttttatttaactttaaatttcatttagatataattagcatgcaataaaatgcacttattttaagtttgtaggcccatgagttttgacaaatgtgtacatctgtgtaactaccctcacggtgaaaatatagaatacttccattatgtccccaaattatctagctttcctttgcagccaggttccccaacctggcctcaggaagcaacttacctactttccagaattatagattagttttctgtgttctatgattttataaaaatgtaattaaatagaatataacctttcatatttggcttgtttcattccctatggggatcttattaaagtcagatttgttcccatagaaaaaacattacaccttatgcagatgtctgtttctttacttggggctttgaaaactacctaatcatataagaacattgagttatggggcagagatcactatatgtcactatatgccttatgcccttgcctagagtgggcactttcccagtgactcattccaggtaataaacatttaagattcatggctgagggtggctccttcaaagaatataattcatgcctctcacttcattatgctgtcatgtccttcagtgaatccttcacttcgattcagctaaaaacatagtaggatgagtttttatgggttgctgggttttttttttttttgtttttttttgttttttggtttttttagaaggagtttcactcgtcacctaggctggagcgtgatggtgtgatcttggctcactgaaacctccacctcccaggttcaagcgattctcgtgcctcagcctcccgagtagctgggattacaggcgcccaccaccgtgcccagctatttttgtatttttagtagaaaaggggtttcgccaaattggccacgctgatctcaaactcctgacctcaggtaatctgcccgccttggcctcccaaagggctgggattactaatttcttaaagtatatcagtttttctttttttttttctctaatgctatagatctgcaagaaaaatggcttgaaaatctctccccaattattacattagtcacttgccatgtccaaatacaacaggcctttatagtatgcaaactttttgttagtctctttcggggataagagagtaacttgttacaggctttgttctagataagcacgtgtatatcagtctgggatttgtgaaaaaaatgtttagctgtaccttgaaagtggggaaggttttaattacgaggagtggggaagcattcactggtgaggagaataagtactaataaaggccaaaaggtttgagggagatggaggaaatcagggagttgatagataatttgtgatctacaccatacagtctttcttacccattgtgctacaagcaacttaagaacaaagatgctttttggctccatttgatcaccagcatctagcacagttctggttacacagttggcactcaatacatattggtttaaaaatgaaagggtgcatggcacctcgcagtgggaactaggcctagtgggaatggctctgaatctacagtacctacctggtgaagaatcatggttaaagagtctttaagtaactagcacaattgtttctgacttctgagaataccagcaacacttagggggcagtatttcctcctctaacttttgaggagcactggacctagagtatttcataaaatgaaagagtcctcttttgctcaaattgaaacttaatgtgtctattaatttattatacctttccaatgaaaacaactctgtgggtccttcagagaaatctgtacatgaagctttgctttcttgggactgttgaatttatgcacatgctctcaagacattatgctaacacttaatgatgaaaatcacagtaggattagttatcaccagcagtagctattataaatgtatgggagaaaatatgttaaaatagaggaaaatattcatctccatctcctcaccatgttctaacaaactgggtctttaacagtatgaccacctactctaatgtttgtcctacacaaaatcagaaattctttaaagggagcaagccttaatttaggaattaattatactttgtacgaggactattgcttcactctatgctgaatctaaattcttttctgagggagaaaagtgcgctgattgatttattttgaaaaaattgtaagttttatcctgaaaagtcctagcacttctacagttttgctagtcattcagttatattttaaatatttaaaatgtgaaagtcactgacacaaatctctctgcaagaaatatttgcagtaactaacctcacaaatcggcaaagttttgtttttaacaagtattttatgttattttattttattttaaattacgggatacatgtgcaggacgtgcaggtttgttagataggtaaacgtgtgccatggtggtttgctgcacagatcagcccttcacctaggtattaaggcctgcatccattagctatttatcctgatgctcaccctcccccatcccccaacaggccctagtgtgtgttgttcccctccctgggtcatgtgttctcattgttcagttcacacttatgagtgagaacatgtggtgtttgattttctgttcctgtggtagttggctgagaataatggcttccaactccatccatgtccctgcaaaggacatggtctcgttccttttctggctgcatagtattccatggtgtctatgtaccacattttctttatccagtctatcattgatggacatttagtttcattccatgtccttgttaatgtgaatagcgtggcgtgaacaaacgcatgcatgtatctttataatagaatgatacattcctttgggtatacacccagtaatgggattgatgggtcaaatggtatttctggttctaggtctttgaggaattgccacattgtcttctacaatgtttgaactaatttacattcccaccaacagtgtaaaagcattcctgtttctccacagccttgccagcatctgttgtttcttgactttttagtaattgccattcagacgggcgtgaaatggtatctcactgaggttctgatttgcatttctcaaataattagcgacgttgaacttttattcatgtgtttgttggctttgtaaatgtcttcttttgagaagtgtctgttcatatcctttgcccactattaatggatttttttttcttgtaaatttgtttgagttccttgtagattcaggatatgagccctttgtcagatggatagattgcaaaaattttctcccactgtatagattgtttgttcactccagtgagagttacttttgctgtgcagaagttctttagtttaattagatatcatttgccagtttttacttttgttgcaattacttttgacattttcgtcatgaaatctttgcccatgcctatgtcccagatggtattgcctagattatttttccagggtttttatagctttcggttttacatttaagtttttaatccatcttgagttaatttttgtgtaaggtgtaaggaaatggttcagtttcaattttctgcatatggctagccagttttcccagcaccatttattaaatagggaatcctttccccattgcttgtttttgtcaggtttgtcgaagatcagattgttgtagatgtatagtcttacttctgagatctctattccatcccattggtgtgtctgttttcataccaataccatgctcttttggttactgtagccttgtggtatagtttgaagtcaggtaacaggatgcctccagctttgttctttttgcttaggattgtcttggctatacaggctctgttttggttctgtatgaattttaaagttttttttttattctgtaaagaatggcaatggtagtttaatgggaatagcatcgaatgtataaattgctttgggaaatatggccattttcatgatattgattcttcctatccatgagcatggaatgtttttccatttgtttgtgtgctctttgatttccttgagcagtggtttgtagttctcctagaagaggttcttcacttccattgtttgttgtattcctaggtattttattctctttgcggcagtaatgaatgggagttcattcatgatttggctctctgcttgtctgttgttggtttataggaatacttgtgatttttgcacatcgattttttttccttagattttgttgaagttgcttatcagcttaagaagcttttggactaggattatgggcacacttcaactttctctttctatttgaatacactttatttctttctattgcctgattgccctggccagaatttccaatactatgttgaataggagtgagagagggcatctttgtcttgtgccggttttcaaaaggaatgcttttagcttttgcccattcaatatgatattggctgagggtttgtcatatatggctcttattattttgacatatgttacatcaatgcctagtttattgagaatttttaacatgaagggatgttgaattttattgaaggctctttctgagtctattgagatattgtctttagttttgtttatgtgatgaattatgtttattgatttgcgtattttgaaccagacttgcatcctggagatgaagccaacttgatcatggtagaagctttttgatgtgctgctggattcggtttgccagtactttattggggattttcacatcgatgtttatcagggatattggcttgaagttttctttttttgttgtatctctgccaggtttgggtatcagtatgttgctggcttcataaaatgagttaggaagaagtcactccatttaaattgtttggaatggtttcagaagaaatggtaccagctcctctttgtacctctggtagaattcagctataaatgtcatgctgtcttaactaaactgctgcctttgcatggcagtgagcttttcagcttgtttgaatttctgccaaactttaacaaataagtgtgagagcatgaatgggagatgtacaatcccagaatttaaacctgaattttcacatcagacattagcggttttcttttgccgtaaggatgagcagagagagaaattctcctttgtaaagctggtactaaaatgttataagattccatagactagaatcatttcttttgacttatcaaagttctattcattgccagtttaaaggtgaaatgtcctgtcctgttccagagttaggctgtaattgggttaaattgactttttttttctaacaattcatcattatttgttgattagtcatcaaatttagaaaatgttactttgtgaagtcaatggaaaattatccttctgactgtggttgatcagtgaacatactggaaaatattgtttaatgcagtgctaatataattctcctgaaatactgcttatgaaattttctttattttattctattcagaaaaatttttgtggttacatagtaggcttgtatatttatggggtacatgagatatttcaatacaggcatacaatgtacaataatcacatcagccatcatgtcaagcatttatcctttgtttttgttacaaacaatccaattataatcttttagttattttaaaatgtacaataaattattgttgactgtagttaccctgtagtgctatcagatatcttgacttaaacaatctatattatattcttggtattttaataattaaatttaataaaatgaagacagacctccaatttttctgatctgtaaaaattgtacctagtattcataatcatgccctgtattttctttctaaatgtatttttttacacctttccctctaccttgaatgtgtcttactttgtcaaattccaactcatccttagggatctaggccatggtcttttatttctactaataagtgataactacatctcctgaaatgtctaattgcatctttcttttggcattttttatgttttgctttttacaattaaaataaaaagtggtatctgctcctactacttctggttaacattatactgtagggtgtggctagagcagttaagcaaataaaagaaagaaagaaatggtatctagattggaaaggaagaagtaaagctatctctgtaaatagacaacatgcttttgtttatagaaaaccgtaaggaatacacacacgcacacacacacaaatacacacacacaaaattagaactaataaactagttcattaagtttgtagggtacaagatcaatacacaaaaatcactcatgtttttatacactggcaaatgaacaatccaaaaatggtattaagaaagcaattgcatttataacaccatgaaaaaagaataaagtacttaagagtaaatctcacaaaagtgcaagatttgtacactgaaaactacaaaatattattgaaagaagttaaagaatacctaaatacatagaaaaatatctcgtgttcgtggattggaagacttactcttattaagatgacagtaattctcaaattaatctatagcttccatacaatctacatcaaaaccccctctgccttttttgcagaaattaacaagctaattcaaaaactcaaatgaaaatttgaaggacccagaatacctaaaacagtgttgcaaaagactaacaaatttggaggattcatgtgacctgatataaaaacttactacaaaactgcagtaatcaagaaaatgtgatatgatatgtagcatagatcaatggattagagtctggcaataaactcatatttttggtaagttgatttttcataagggtgctaagacaattctatgagaaaagcagtcttctgaactaataatggtactgggacaaatggatgtgcacatgcaaaagaatgacattggacttgtcctttacaccatatgcagaaattaatgccaaatgaattatagacctaaatgtaagaactaaaactatacaacttttagaagaaaatgtaggcctaaatcttcatgagtttaggttaggcaatgatttcttagaaacaacatcaaaagcataagtgacaaaagaaaaaatagagtgtgattgttaaaataactgccccacaaagatgtcgacatttgaatcttcaaagcctgcaattatcttacatgataaaagggactttgtggatgtgattaagttagggatctcaacatggggagataatccttgattatctaggtgagcccaatgtaacctcaagattacaagagaaaaaacaaggcaggagagttgtaatcagaggaggaaatgtaaagatggaaccagagggtggaatgatgcagggccaaaagccaatacatgcagcctctagagctgaatggacaaggaaacagatactttcctagagcctccagaagtcatgcagtcctgccaaatttgagtgagatccattttgcctagaactgtaatatgataattctgtattagtttcagccattaggtttgtggtaatttattacagcaacaatagaaacctaatatatatagataaattggacttcattagaattgaaccatttgtgcttcaaaggacaacatcaagcgagtgaaaggacaacttcaaaaatgggagcaaatatttgaaaatcattatctgatgagggactcacatgtagaaaatataaagaactttaaaactcaacaagaaaaagataaattactcaattaaaaaatggccaaagaatttgactatcttcttcaaggaagatacacagattgttaataggcatatggaaagatatccaacattattgttcattaaggacatgcaattcatgcactaggatgactgtaatgaaaatgatgaacaatagcaatgttgacaaggatgttagaaattgataccctcatacattgttggtagaaatataaaatgttttggccattttggaaaacagtggtttttcaaaatgttaatcattaaattacttatgagccaccaatttgtgtgtgtgtgtgtgtgtgtgtgtgtatatatatatatatatatatatatctatctatctccaagagatttgaaaatatagttttacacaaaatttgtatatgactgttcatgacagcattattcataatacttcaaatgtagaaacaacaaaatgttcatccacctataagtagataaataaaatatgggccatttatataattgaatattattcagtaatagaaagaaatgcagtaataatatatgccacaatatggatgaaccttgaaaacaagttaagtgaaagaaaccagacataaatggcatttcttatatgaattcatttatatgaaatgtttggaataggcaaattcataggaaaagacagtagataagaggtgcaaggagtgtctaatgggtggcaagagaaatggaaagagattgttattgagtatggagtttcttttgggatgatgaaaacattctggaattagattgtggcaatggatgcagaattctgcgaatatactaaacaaagactcctgaattgtacacaaaattgtgaagtttatggcttgcagattgtatctgagtagagctgttattaaaaatatgttaaaaaataaaattcagggcaatgaatactttgaacagaaacatgcaagtatttccataacttaggagtgctacctcaacatgactcgggttgttatgaaagacttctttatagaagagatatctaagtaggaacataaaataatttgtttactcatattctcttgtagccagtgacctccctaacaacaagaagtgcatttttgggagacacagtgtcagataaaatagacagttcaagggtgtataaatggcacagtgaagccaacaggaatagctagatgccctcattatatatattttttcaattttaacatgaatatgtttattactttttttaaaaaaagtaataaatatatattccaaaaatatctcaggtttttattttaagttttattttaagttctggggtacacgtgcaggttgtttcgtaggtaaacttgtgaaatgggtcgtttttgtacagattatttcctcacccaggtattaagcctagtacccatttgttatttttcctcatcccctccaacctctgataggccccagcgtattttgttaccttctatgtgtccctgtgttctcattatttagcttccatttgtaagtgagaacaggcagtgtttgattttctggtcctgatgccttcattattgtaggagcacatagcataaattcagctgcgtgaccaaaactaaaaaaatccaagaattaatagctatttgtagttaagtctaaggtactgacctctgaaagaaagacaatgcaatggacaatgactactaaggaagtttgaacatcactggaaacggacagatgttcatgatgaaagagtgcttggacagagcaaagcatgtggagaccacttatagatgattttgtgtggttcagcccatgtctgctaggtactcaatttccttatgttgctgtcctcctgcaagcttctgtgactttggcttttgaagggctttctttcaaccctcatggagggtgggtgtgaggaaatgcttggggacagacataccctagagctgccctcaaccactgccaaatgaatgctggaggataaatattccctgattttctattctttggaaacaacaactctgggaagagtggtagaccatttcccagatgtgcccagtggacttgagtcctgatgtctgcagatataacctgttctttgatgcctatcatgttggctgacttgcattcattgtcttgctttattttattctaagctttctaagatcatcctagcaaagactcagctatactcaaatcccagtattttgggtctgcatctgaataaaaaaagttttagataccactgaaacaggaaccatgagtgaagacattacagaacaatcagaatgacaaactaaatctcattgactaacataggtggtcaggtagagtgtgaagacattgtgttgttggtcagggttatggtagtagtagtattaagtgcagtctcgtgttgacggttaatgctatacaccaattctttagggagtagtcaattaaaatgaatcattgaaacaagcttaatttaactaagaccaagtgggaaatggagatattattgagaagaataaaataataaatactatttacatctgtccaatatacctcctttcccgttctggtaacagacatcagcctccagaactcaggagtaaacatgtgacctaggttgaacaagttgtagttacttctcctcccatctgcaataattgcttcagagctgaccagtcagaggccttcccagagactgtatatactgagatgaaggaagaaaatgtttcttgcctcttgttttgctaagattgaatgatgtgtaagctgagagctcccggactgaggaaggtgatacacagtggaagacaattggaaaaaatgtacataggaatattaggaaaatatatttatgtataagggaaggatgaaaggggaataggtagagagagggagatgggtagatcgagtctgaaagtgaaagagaattaagaaattatggcagcctattagatgccttatacttcctagttatgggagccggtgaatcactctccttttggcttctgttggcttacattgagtaatcagttgcacctgagagactcttaactgtcaatatctctctttcctgcgcattaccgtacgccatactttcttataagccctgtgtttgtattctcatttaatccttatagcactttccgaaatgtgtattgttattactcaattttatagataagaaaactggggttagagatcagtaatttgctcaagtttttttgttgttatcagtagaagcaggatcttaaacataaagtacaagttctgtggtaacccatcattattctggaagctgagtggtgctaatgctgcagagaagctattgggtgaaccaacatctggagagttggggaaaaggcagccatcctattttacatatatttttgtttcctacaggacctctatactgtctttcaaatagtcactcaatatattttcatttagtgccaaattacctatttggaataaacagttaagactgtaaaccttagcaaattatattcaaccaggaatagacactcctgtatgcatatatgtttctaaaagtatgttagagtctgggcattacaacttaagttgatattaactgttataaggaacattaagtaggaaataaagttttgcttgaatggggaagtgggattcagaaaaagctttattgagtgtcatcctgatatgaataaatgtgtaccattcaggttgaagaggaaggcattctaaggacagggagcaagtgggaagggtatgaagccatgaaacaaaatgagtgttatggaaactgtaacagcttggctgagttgtggggtattaatgggatgtaggcaatgattaattcatggaggaacttctatgggattataagaagtttgaattttattagtagggaaaaagaaatcactgaagattggatattcacaaagatggcataagaagataaacctttaaaaatggaggatgattttgatttatgcaataggggagatttaggagattttgtgataatccaggcaggaggctctaaatttctgaatcagtgccatagcagaaggaatggaaaggatgcgtatgagagtttttaagatatttaagaaatatgaaatttggttatctgtactacaacgacagaacagtgcttttctctacataaagctctgtcttatttatggttctgctacttaaattatatctacataacaaaatataatcagtcatcaagtattgattgaacaaccatcatgttctcagatttaaggttaatctgtagcaaacagatagttattcacaagtgtgatcatgttttacattgtataacatattacattaaaaaaatcagtgacttgattgccagaagagaacacatttgattcacatttgtatcctcagtacctagcacaatgtgcagataatagaaggtacatagtaaatgcttgttcaatgggtgagtgaaatattaacaaatttcatggaatcactgaattaaaaattaaagcgttttataaaatatggatgattttattatttaaataaacatttacaagtttctcaaatatattgtcatcagagggataactggctaggtgcttactttttaccagacactttgtgaccgtgaaaatgcaggagatagagtaatcagaataagtaacttaattgcctagtgcctcagtttacgcattagcacagtagggataagattgtcttccctttacataactaaaatgtgttgaggattatgtggatttaaagtaattaaaaataaaagactaaagggacgactaagctcttcggagaaaatgctgtttacacataaggtaatcatttcaaattctaaagacagctaataaagaagttgtctttaaaagtaatcacatatcatctggggaccagattccagcctgaagacagaaggagttttagatgattttaatccaagatccaaatacagagatttaaataaagaacaggtagttattaataaacagacataatgtaaaatttatcattttctccatcctccagaaagttaaaggcagataattagctttattgctgggtgttaagatatttatcaatttttcaaggttgagagaactcaacatacgtatttgaaatatatttcaagaaaatcttgattattcaacatcccaaagtctgacagctgaaagtctctgaaaataaatgagaaatcaattaaatgcttttaatgagaattgtcaaggtgaatcaaaggctcatattgccatttaaatcaggagttgcaaagttctctgttctcactggctagctgcttcttgtcattcagagctcagctttaatctcatctcctgatagacaggtccttcctgaccatacagtctaatctagccattctccctcacgtcattctatcttaagtctctgcattacactacacttgctcatttatttacttgcacattgtctgtttcacctcaagctctgtgagaatagagaccttttctgtctggcttacttatctctctccagtgtcaaaaaccatacattatgtgttcccagtaaaatttgattgaattaatgagttatgaatcaaaatcataatttggattgtctttagaagaaatatcttaagcttttacaatttggtgttatttacccatcaaagagagtgctgtggcattcacgataagatgtacatttgctcacttgcggtaattagaagcttatgcagtgagagactgagttgaacctgacaaagaggttgaagttgttactaattctggattaagagaagatgttttgaataattctatatcatcaaagagtactgatgaataaagtacaattttattgagaatataaacaaaccccaaggaaaactgctgcttcctttgattgatttatctgggtagaataatggttatgtagcactgtagcacaagcctagcatcgatacatcctgctttgatatttaagctaaacaatggaaaagattgtatgtgatttgatttagaagtagaagccataatgtttgctctagaatcagtgctgacactctatattgaaaatacaaaatattataatcactaaaaattaataagaaactaagacatggagtcatcgaagatgattaggtttccaaaaagtccgtacactgaacaagcaaggtttagcatataaattgagacatttccatcaaaaggactgaaaataatttcagtgtaaatatcagattcagccacatgtaaaagccattctcatcacatttttaaaacatgaattgattgtgattccatctttgctgttgcatgttttatgaaaaatcttgaatgaaatatagaggtccattttcatgacactattatggaggactggccgttggaagagcattcctttcttcctccctcttttatgtctcatatcctacttagacctttaagagcagtgtgtgccataatactgtgtcaggaattaagacataagtaatgaaaaaacaacaacaccatagctaatgtttagtgaatctttactgtatatcaaacactgtactaagaattttaagtctgttatcttacttggcactaacaataacaatatgagatagataatattattatgtcagttttacaattgaataagcttgcagaagttaatttactgaaggtccattttatttcagaacttgcatgcttaactgctgtttctttacctacaataatgaatgcagcactgggcagaatgagggaaacagctatgtaaaataatttttgaaacccagtgtgtattagccaggttatatgctagaaagcgctaactaacaacaaaatttcagagacttataatggtaaacatttactttcctgcataaattcaggttgttgcgcctgtgttttcattttgggaccattggccactggggcatgttctttccacgaagaagcaaaagagaagaagagttttatacctactaaagaaggctttactctgaattggcaaatggtcacctctgctcaggttctggttatcaacacaagtcatgtgaccaagtccaaaatcaatgggacaacaaaatataaggatttagagtgggaatatgcactgtacgtatttcatacggtagaactttctatgttctttccatgttactcagctaagttcattctaaagtgtatcccccagattatttgattctttttaaaagactatatttgaacatatttccataaaaacttgattgttcacaattcccaattcttatatcctcaaataatcaaaacagtcatcctttaccagagcttggattattgaaaatgaggattgagtgaagttagcaggcagaggtaatgtggaaatgatgcttttttatctgactcttattctcaaatcctgttgagaactactttctaaaaatgctacttttctcaagtcagtaagtgagctcaaatgcagaaagtaataaaggagaggttggagagagaattctctttcctgtatgttcatgaaaatacatgcttagggctttcatgagcttgaaagctggatgaagggataaaagcttttaaagcaaattattgaagaaatttaaggcattttgataagttgtaagtgctttcctgatttcacgtgattaaaattttgctttgctcagtgtggttgagctattcaaacttattagcaatcatttttcttttctaaaatgacacaagttagagaaatctggtaagccagccaactactgttgatatatgctcctttgatgtgtaacctgtggagacggccattgtcaccaagttggctaagaggaaacaggcagcatgttatgtagtggaagcattatttcccataattgcaaaccatagagtaagaaaaccagtgccttgttctgatgtaaagcctcaggaaattgtaaatacatattgtttcaaagaaaaaaaaatgacttccaagagacatactggctttttttttctttgtgctttcaaatatatagagactccatgtagtctcctcttttcagagattactggcaggtggaatatttcccctttaaatttctgtttctacaatctcagatcttctgttgatagagcttaaaatagtggctcgaatggaatcttgttgatatggtgacattttgtaaagactcattgctgtggtctagatatttgtataccctcaaaattgatatgttgaaacctactaccaaatgcaaaatgattaagagatggagccattaggaggagattagatcataagggcaatgccctcatgaatgggattagcagctttataaaagaggtgtgagggagcttctttgctccttcaccacatgaggacatagaaggcaaaaatctatgaggagtgggccctcacaagacactgaatcttgtgtcttgatcttggacttccctgcctcagaaacgtaagcaataaatttctgttgtgtataaattacccagtctaagatattttattatagtagtaggaacaaactaagacattaatttacatgtaaaaacttgagctttggagagtattcaatagagctgggttcaagtttttgctctaccatttaattggggtgtgaatttgacaaagaaaaacaatctctttggatctgctttcacatctgtaatataagaataataattcctccctctttgaacctactatgtaaattagatgtaaatacatatattcacatagcatagtaacatgtaataatactaataatgggtatccaatagttttagtgattgctatcactttttaaaaaatgttttcacctggaaaatggatgtgtagcaaggactaccttccctctgtatagcgttgagtctactggattcaattgtagattttagtgtcttttgagagcaatcctaactttctgtaaagattgatgtatcatgatttttattatttttagatgtcttccaaagcacaaagagaacacatatttcattttaaaagtgagaataaaacttaccctatctttttaaattatcatatcagtccattggcccttattataaatttaagatatattatgggattttagcggtatcatttttcctgtatcttgaaacacattgctgtttcatcattcctagggattatttctttattcatcattaatgttcaactatcataaaattactaaaaaatacaattaaaagggaagataatctgcaattattaaatgagtgaaaagaaacagcagcactatagactttgattatgttgctgaaatttctaagcaaaatctcaaaccatgaatcttcagattaccatatcctagatgaattttctcaaaatcaagaataagtggatgaataatatctttttaaggacaaaaataaatatggcattctcacttcattagtcattcaactggaaggacattatcatgtcatactttactacaaaaacttgatccattctattttgataaaaggttatcttttgtaatatttttatccaagaattcatttggaaaagaggttagtatgtttcaatatttttacaaattgtaacttttcaattgtctttcctgttctgtaaattattcataaaacttaaaaatatatttaagatatttgtattaaaaaattgaacccaaatagcaaatggtgatgattatttttcctggaatgctaagggtaagatattcatatactttgacctaacatggtactcccagaagtttgccttaagaaaatctttcaactaaagcaagaataaattcattgcagtacaaaatgtaaacaagctaactggataacatagggaatgctttgataaattgtgatgtatcaacagcatagcacatcatgtagcctctaacaatgatagttatgaagatcatgcaaacttagaaaaacacttctgatgttgactaaaaacaacatttaaagaatccaaaagaacttaataagtcagtactttttgtaggaattatggtagtggatgaattaaaaagaaaaatattaactctgctgtttttccattatttgagaagaaagacaattagtaaaactagcaaacttaattttgccctattttggtgatgtctcactatcgtcattgcttggctggggaactgaatttagattttgataatttccatagagtaagatggaaattcaccatacttttgggacattgtgtattgggacatcattttgctcaagcagtttatttctttttttaaattttttattttactttaagttccaagatacaagtgcagaatgtgtaggtttgttacataggtatatgtgtgcaatggtgtgctgggcctatcaacctgtcatctaggttttaggccccacatgcattagctatttgtcctaatgctctccttcccctcacccccaccccctgactggctctgatgtgtgttgttcccctctctgtgtccatctgtctcacttacgagtgagaacatgtagtgtttggttttctgtttctgtgttagtttgtggaggataatgactcccagcttcatccatgtccatgaaaaggacatgatctcattcctttttatggctgcatagtattccatggtgtatatatactgctttttctttatccagtctatcattgatggacatttgggtgggttctatgtctttgctattgtaaatagctctccagtaaacaagtgtgcatgtgtctttgccgtaggatggtttatattcctttgggtatatacccagtaatgggattgctcagtcaaatggtatttctggttctagatctttgaggaatcaccacactgtcttctgcagtggttgaactaatttacattcctaccaacagaattaaagcatttctatttctaaacagccttgccagcatctattgtttattgaatttttaataatcgccattctgactggcgtgcagttttgatttgcatttctctaatgatcagtgatgttgagcttttttccatatgtttgttggctgcataaatgtcttcttttgagaagtatctgttcatatcctttgcccactttttgatggggttgttttttcttgtaaatttgtttaagttacttgtagattctggatactagacctttgtcacatgggtagattgcacaaattttctcccattctgtaggttgtctgttccctctgatgatagtttcttttgctgtgcagaagctttttagtttaattagatcctatttgtcagttttggcttgtattgcaattgcttttggcgtttgcatcatgaagtctttgcccgtgcctatgtcctgaatgctattgcctaggttttcttctagggtttttatggtttggggttttacatttacgtctttaacccatctggagttaatttttatataaaatgtatgaggtgtaaggaagggattcagcttcaattttctgcatatagctagccagttttcccagcaccatttattaaatagggaatcctttccccattgtcaagcagcttatttctactctttactctacttttgtctcctgtctcatatatcttcctcctttacagaaatatgcacagtaacatgattaactttaccatctttctttaagaatagtctaggctgggcatggtggctcgtgcttgtaatcttagcactttgggaggcagaggcaagagggttgcttaaacataggcatttgagaccagcctgggcaatatagtgagaccacatctctataaaaaaataaacaaaattaggggggtatagtggcacatgcccgtggtcccagatacttaggaggctgaggcaggaggattgcttaggcctgggaggtcgaggctgcagtgagctgaaatcgcagcctgggtgacagaatgagaatctgcctcctaaggcactgatacactgatgcacagactagagatagaaaatatatcttagatttttgagatgagctaaagaagttatcagttaaatgagtatttggcccatagtaagccatttatactatttttgttattatcaatactaacatttgtcttcacccacagtaataaactagtatatttttgcaaggctcccttctcatgtatgcacctcattggctcctttaaatttgtactcttccaatacagtacagattgactttggagattgaacactggggaaatatggctgtttgtttttataatgattgatttgacatttgcaccatcatgcataccttaattctgagatatgacaaaagcagggaaatgaagagccaaattcatgtggaaggaatctctctatttttagttgtttttaaaatcataccagtaattcacattaaaactccattatggaagcagttttaacaatactggtctatactgtagaaatacatatttaattctttctagagtaagctgatttttatgttttttgtttttgcttacagcttaaatatttcataaaaactttgatactggtttaaaaatagtatctgtaatgaaatgggaaaatagaaattaagttagaaaatctgtttcaaatatatagaagccaagttataagcatacatataaacagtctctgtgattgacattcagatttgtacttcagcttctaggaaactggagttggggttaaggaggaagcaaacatgatgtaattatgtaatttataacactgataaaggaatatatataatagttcttcagaggaagcccagatttctttagcactgaattccaaaatgcatcatgtgggtttttgtgtgctaaatataaattgataggaaatgtcctaaattatatttttacataatatcagtattaaattttatgtatattttatgtgaccttcaaaattagaagcacaatattaaattgtcttttagtaaagttgattctgtgagggacaaaatttatgtaattgaaattcaaatccttacagtagctgatcttgatctctgataaaatttaaagtaccaagggaaagggtggctcacacacatgttccctaaacattacttcttgtccttcatggatagtagatggcaaaacatccaaagttttattttctaatgattacctatgaggttggcatggcaaaagtaatttttgcctggaaatactttaaaacttgtattaatagtcagcatgttcggccagtcaatcagcagttccaagtgacatggtggaatttctctcagagtctacacagttttaaagatagactagatggttttggttatttgccagaaaatatgtttatgcttttgatagaattaatgtgtgactcatttcttcaaatatttagataatgggaccagatttttttgcttgctattttatatgaaagctgttcattaaaatgatgaaaatcatatcatcagtatttaaaaggaaattactcttcactgtagtactgggatttgatttttttctgtttttcaattatctaataaaatgtcctctccattatttcgtttactacagttgtccatttgcaaagttaatatattgattgcgttttgtaaaatggacacaatgattagaaattatctactcagaaaagtaatctggaagagtaaactcagaagtcactcatactaaaataagccatgggtgttccaaaaatagaagacacctacctatataaactttatacacacagacctatgtacactttatacacacagacccacgtatactcatgcacttatgccccttaatgatagaagatagagggtgtgggtagcccagggccacatagcagctggaatagagcagtgaggagcacagactctggggccagacttgctggcttcaaattccagctctagtgactggcttcataactttgggcagattatttgctctttagtgcctcagttttgccatctgtaaacagagctaacagtagcaactaccttacagtgttggtgttcaggttaaataattagtatatgtaaagtattaagaagtttttctcattcataataagcactgaataaattttatctattatttttattattagtaataatagcagtggtactagacatgaaggcaaagaacattcttcattttaaaggcagaaatcagatattacaattgacctgtcatgactggattaactagaattagggtacaattcatagttaagaatatgaaagcaaaaagaatatttgaaaattgtatttagtccatcaaactggactaagaaatacagagttggaatataagggtggctgaatataagggaagccagggacaaagcatatgaaagttccgttgctgggccaagcccaggaacccaggagaggaaagatgcacttgcaaagctggccagtgtataggattctggcatggggaccttggcaagcagcccaggaagtaagaccgcaaaggagtagtaaagtacctttacttaggcttgtgatatggatagggccacagttgctgatcttcagcaaggacaatagtgtttgaatcgcctaatacctacttgggtttaatctgctctcttccttggtctgactctagcatgtaaaaaaagccacgatccacagaacccattttcttctccataagaacttgccatatataacctaatgtttttgcttgtacttatatacaccatgtgaagtttattatcagcataacaaagagaaaagagaatagcgaataaagacaaaaaatgttcattttgattcaaagcacttttgatgcagtccatagaattgaaagtattttttttttctattaactttgaagttttactctctactgtttcacctttctggaatttctgaaaacagcagcattctacaatgaaatcacttcttaatttttaaaataaggttaacaaatgcatgagttgtaaaacactccttccatgtcatttcttccaatcagctcttcatatgcttttagctgattttctcctgcttattaagagcagctgtgtttaagcagctggagcacaagttggccagtaaatgcatgttatatagacatttaataccacttggtgctttatcaggctttacaacctctaattagttaaaccacagaatacccgagcacattaggtaattattacttttcccccatttcacagataaggaaactgagcgtgagaaagatttgttttctattagactctaatggttaaagaccagtgtgtaagatgaacactgggtttgtgaaaaaacgtgctgtctagtgatatggcaagtcctcagggccctggaaatgagaaatgtaataacattgctgccagtattatccaaaagattataatgtggctgatagcaagctactttttcagagctagtaatagtctatgtatattatgctggattctctaaccaacagttcatactcaactgcttggaaaacactccccaaaagaataatgctcatttcttcagtgttgttatcttaatcaactctcatcttttcattgatattttgatggaacttatatctgttaatgtttccaggggtgtaaaatgagtcggagaagcaaattccttaatggatatatttggttatgggattacgcattaaattagagaaataatcagttgcagaggggttggtcgttggtattgtttcatagggatctgctaaaaaaaacagaagactgtggtaaatgaattagattgtctgtttcttagcataatttctgcctttaattattgctttacactgaactagaaagaaaatattaaaataaccaaaaaataaagagcatttatattaaaattctaatcaaagtcgggtaaatttgtttcatatatgaagtttaaattagtctgctgttctgattggtttacactattggattgtgctgctgaggccagaatttctggttccatttatatatgggccagttaattttccattgtgaaaaaatatattactgtttctgaggtctgtattcctaagtccagctagttgccttcccagaaacttggctgcctctcttgagtagtaccattggaggtagagagttcctcccagaggacctagagaagacatgctgcctattttaggatttggtggaatttctacctgaaatatttggtcctttgtaagccaactctgcaaaaacctgagtattgacctaggggataccaccaattcatcccttaaacatttttgatgatcgattcttatgtttgaatcgggtcagaatttgtttaaaattatgcaatcaaagtttaatagccttaatcatattcaagcaattgttataattaataacatgatcccaaatatttctgatttaagcaagatgtacagctagcagttaatctaatacataaaatatggcccatgatttagataaagtttgtgtggggacattaaaaatatacaagcggcttttataaagtaataagagagcacatggaagtcaaaattgttgttcatagtcactgtacacgcacataccttgtattttgtagagaagaaaaatcagcaatgtaataaatcataaatgccacaagcagtgcaacaatttggaacagcaagggatgggattgaatagcctcagattctatttggaacttctttctgcagtaaaacagacatggaagacatgctatgtggaaggagtaataagaataaatggtggagaccaaaaaccagattctgtattctgactgcatatacttttatttaacaaatgagcaaagtatgtatgtgtgtgcataagaatgtactgttcaggtgtgtttgtgtgaatgtatgcagtatttttttaattatactttaagttctgggatacgtgtgtggaacttgcaggtttgttacataggtatacacgtgccctggtggtttgctgcacccatcaacccgtcatctacattaggtatttctcctaatgctatgcctcccctatcccccgaccgccccccgacaggccccactgtgtgatgttccccgccttatgtccatgtgttctcattgatcaattcccacttatgaatgagaacatgcagtgtttggttttctgttcttgtgttagtttgctgagaatgatggtttccagcttcatccatgtccctgcaaaggacatgaactcatccttttttatggctgcatagtattccatggtgtatatgtgccacattttcttaatccagtctatcattaatggacatttgggttggtcccaagtctttgctattgtgaatagtgtcacaataaatatacgtgtgcatgtgactttatagtagaatgatttataatcctttgggtatatacccagtaatgggattgctgtgtcaaatggtatttctacttctagatccttgaggaattgccacactgtcttccacaatggttgaactaatttacactcccaccaacagtgtaaaagcattcctatttctccacatcttctccagcatctattgtttcctggctttttaatgatcacaattctaaccagcatgagatggtatctcattgtggttttgatttgcatttctgtaacgaccagtgatgatgaagtttttttcatgtttgttggctgcataaatgtcttcttttgagaagtgcctgtttatatccttcacctactttttgatggggttgtttgtttttttcttgtaaattggtttaagttctttgtagattctggatactagccctttttcagatggatggattgcaaaaattttctcccattctgtaggttgcctgttcactctgatgatagtttcttttgctgtgcggaagctctgtagtttaatcaggtcccatttgtcaattttgacttttgttcccattgcttttgtattttagtcatgaagtctttgcctatgcctatgtcctgaatggtattgcctaggttttcttctagggtttttatggttttaggtcttatgtttcagtctttaatccatcttgaattaatttttgtataaggtgtaaggaagggatccagtttcagctttctgcatatggctagacagttttcccaacaccatttattaaatagggaatcctttccccattgcttgtttctgtaaggtttgtcaaatatcagatggttgtagatgtgtagtgttgtttctggggctgtatatttttaagagaatatatacctttggttgataatatgaaatggaaatacagaaaaaagtatcacttacaaagtaatatatcatttaatcttctaacaactccatgaaaggaaaattattatcctcattttgcacatgagtatactgacttaaagaggttaaagaacttgtctaagttgaacatatatctctaactccaaaatctgtgcttatttgaatatgatagtagcagctttggtttagagaatgttcacgttaggttggttttgccattgaaagtaatggcaaaaaccgcaattacatttgcaccaagaatataatatattgaggatactaagtgggtcctatgtctattatttctttaagtagaaaagcattctttcttttaattttagtttttgtaattaattctgtggcatatttgagaaagaagataacatttttaaggttaatattttatggcatcttatctggacacattctaatattatatattgatttaaaaaaaaccttttcctttattcattagatttgatcaatgtgtgaggttacacttaattccagtttaaatattttcctatcttcaacaatgaagatttattttgcctaaacattttattcaatacttcattaaagtttttgctctatgaatgtaaccatagatctttaaaagcagatttacagttcctcatgcttaagatgaacctttctttaaaagtgacctttttgaaattaaaacattagaagttattaattgtacataagtggaatacaaaacaacaaatgaataatctgtacctgaaatatacttaagtttgatttatccattggattattcttttagtaaactgaatgaattaggacactgtgagctgtagtaatggaaattctgacagaactggcctaaataagaagagaatttcttatctccagaatttctcagtgctcgataattgattgttgactgaaccatagcatcaggacctctctacttactgccctaccatttttggtgtatagtttcttcctttggctggtttccattgtgcttgcaagatggctgagaacttgacctgggactgtgttgggtttttcttcatagtcaatgagagacagaaaatctgttccccaatcacgaaatgtaaataatttttttaacctgactggaccagattaactgcagttgccatgttaatgccatgcactggtgcaagccagcagtactcaagatccatcccctggaggcagttgtggggaagatgcatgaacaaaattgtggattaaaatgaggagaatgattattagattttggccctggacactaaaaacacatattatttcataatccagtattaatgtgagtttcaaccttagtttttatataagatctctgattatcaaagagttgaattttgttttgtttttttctcaccctgtcttatggtgctgacagagagtgttattttgaaaagcaaataaaggtattaaaaacaaaaaactccacaaggttagatatattatttatttcagtaatcagccgattttatatcaaaaatgacaataaatgtgatagtaagttcaaaaccagcctgggcaacatactgagactctgttaaaaaaaaaaaagacattaattttatgttttagtaagatgtgagggaagaaattaccctaccaaaagaaagttaaaaactctccaaatagaagcttacttcataaacatcagtgcaaacttaaaaaaaaattggaagtacatgttttatagccagcaaagtaaatgtcatcaaaagttgatcatgaaaaaaattctgcattaaaaaatattctgaccccagcaacaatttacaatataacaggattattttttatagactataacgattggcagaaagataattttaccaatctacaaatatttcttaacagaaattatttaaatactctttaactttattctccttagaaaatataagcttaatagtgtttggggcaatatctatgaaatttaaattggaataaatgatcagttaaacagactttaagtggtgtaaatcatccatgccaccttctctaaagacatatttgaaatttctctttactgtgaagaaaatgctcttttatcttggtgatgtatttttgctaaaaattggttattaatccgtagtccatgcagtcatattcagtatttagttgtacttgtcaaaaaatgaattccaaaataactgcattttgttatatttgtatgattcattaagttttatatgttatattaaaagaatgactgctgatgaatgctttaagtggacaggaataagggatgctgaagagctttaacattcttacttgcggtactggagtaaaatcccccagaacagcagttggttgatgactttagtctatatagacagcatgagttccataaaatccacatgtgattttaaaacttctaactttaataacctcgctgtgtcataattcaggcaagctggaacataatccatattattagggccccagcagtactgactaatgaagaaaagaaggaaaatgggatttagtggacacatgggagtgagcccaggaaacctgtaaggctagattcttattgggagctagcatgggagtagcccagaacgtccaaaaacatatccaggtgtttggaacatgccagcaagcagaggaatacgaggttttagacaatctgacaattcatagtgaatttcagccatgcctggaagtacaacaaataaaattttgtactttttgttgatgaggtgaatgttaaaatcaaaataaacaaaaactatacatagagttaaggccttagtttagtggaacactcttagatcaggttccctggcccaataagaaacaggggtgttagggaagtggaattggaagtctaggcattttctgggtcaagcaaatgcagatgatagcagctaccccagaagagcatgtgttcagccctcccacaaatgctgtagacactggatctcataatggaagacttaattttaccttacctacaagtgttttgcatatgaaggcattctctgtcatagttggaatgagctcagaaagatgaaatttagtttctagacaaacagtattgctgcttgtttgggcaagcaaatgttgaatggttgctagagtgtgtcattcaacatgtagcatttctaggataatgtatgataagtgtttttccttcagttgttatgttcctcattttagcttgccataagtaaagcttaccatcttattccattacagatactttttgtcacaggttctataataaacatgaattgcaaataattacatatgatagatgtttggatggatatcttctaaaatattttaaaataatactttattgggctgggcatgatgactcaggcctatagtcccagcactttgggaggctgaggtgggaggatcacttgagcccatgagttccaacctgggcaatatagtgagaccccatctctacaaaaattaaaaaaagatagctgggcgtagtggcacatgcctgtagtctgatttactcaggatgctgaggcaggaagatcacttccaggagtttgaggctgcaatgtgctgtgatcacgccactgcatttcaatcttggcaacagagcaaaaccttctctcaaaaaaaagaaaaaaaaaaaggaagatggatgactagatgcaacaaggaggagagtctaccaccaaggaactgggacaccaggaagactagcatactccaagcagatctgcacacggaaggcattgagagtggacagagggaggacacagatgctgggctgaagagggaggaagctgggaactctgcaaggggctaccacatactaggactagttcctggcccccagtgactcctggggaatgagtgtgttaagcaggcatggtgcaacctgctcatgcacagacctctggaaccctggcaggagaagtctccccaacccccatggaaacttgagggaaactggcaggaagagctacttagagaagtgacaagtgcaagactccagcatgtgtgcagcccagagggtttaatgtgggaacatgtgccagggagcacatccagggacattcatctcctaggattgccttgctcccctgggatactctagctttaagtgaactgtcagacctgaagagaccagggtgatcttgcctgtgagacagggccagtctgacctgagcatgcttctgtctgctgacctctcctgggatcccagcctggatgtgcctgcttgctgtacagccttggatgcccaattgaggtgcctttcaagggcatacatcatagctcctgtactagcagaccataccttaccatcagagagctctagtagagcagcccttgctgacacacaccagcctacacatgtccttcttccaccacagctgcccgtgttacttcactggcacacactcatccacagtcatcacccatcactttgcttgtgtgcatatgtgcaggcaaaccttgcctctccttccctgctggcatgtggatgtatgtgcacccaccatgccattgctgctgttgtgagtgcaccacctgccctgcatcacgatgctgccattgctggcgcaaacacatgcacagacaccagcaacaccacccccactccaaactaccattgctgccagagtgaatgaacacaaggacatccgcacccccattccctgccccacattgtcacagctgctggcacgaacacctggacagaaattgccagccctacacctgccagtgccctgtccccatgccagcacggccatgggtatgaatgtgtgcacatggaccccagtggattcagcccccagggctgcctatgccaccactgccaacaaccttatggagactggtgcccaggacccaccagaatctcaccccatccaatgagcatgcactctgtcgtatggccacaactggtggcacaagaagcaaggaagtcagatcctgctgctactactcaacaaagaactttgtctggcaccaccctcagagaattgtgaccaacggtttgggaatgcggactcactcggcccctccagctcagcaggtttccaacctccagccagagaacaaagctgggggcctgataacagccccccaaagttaaagtacacagcccaataatactgagctgaaccttggccctcaaaaacctacaagaaacaaagccagtcaactggacctaccttatgccacaatcaaactgccaaggacatcaaagaagatagaaaagcaaacaaaacaaaacaaaataacaacaacaatccaaaaggcagcaacttgaaagattgaaggaacatcagcccacacaatgagaaagaaccagcacaagaactctggcaactcaaaaagcaagagagtcttctcacctccaaatgactgcactacttccccagagcagtggttcttaactaggctgaaatggctgaaataaccaaaacagaattcagaatacagataggagcaaagataatcaacatccaggaaagagttgaaacccaatccaaggattctacagaatacaataaaactatacaggagatgagaaaaaaaaaagtggccattttaagaaagagccaaactgagctgatggagttgaaaaactcaacaagaatttcaaaatacaatcacaggtattaacagcaaaatccaccaagctgaggaaagaatctcagagcttgaagaccagctctcctcaataactcagtgagacaaaaaataaagaataaagaagaatgaacaaaacctctgagaaatattggatgatgtaaagagaccaaatctgtgactcattgacatccccgacagagagggagagaaaacaagcaatgtggacaacatatttcagtatattgttcatgaaaatttcctcactacagacgccagctgatatggtttggctctgtgtccccacccaaatctgatcttgaattgaacttccataattctcacatgtgggagggacctggtgggagataattaaatcatgggagcaatttctgccatactgctttcatggtagtgaataattctcctgagatttgagggttttataaggagaaaccccttttgcttggctctctttgcctgctgccatctgtgaaagacgtgacctgctcttccttgccttccaccatgattgtgaggcttccccagcctcgtggaaccataagtagattaagcctctttctttagcaaattgcccagcctcaggtatgcctttgtcagcagcatggaaacagactaatacatcaacagtcaaattcagaaaatgcagagaacccatgtgaaatactacaaaagaccatccccaagacatatagtcatcagattctccaaggtcaaagtgaaagaaaaaatgttaaagacagctagagagaaggggcagccacctacaaagggaaccccatcaggctaacagtggaccttttagcagaaaacctacaagccaaaagagatgagggcctatattcatcattcttgaagaaaatagtttccaaccaataatttcacaaacagccaaactaagcttcataagtggagagaaataagattcttttcagacaagcaagtgctaaaggatttcaataccactagaattgtcttgcaagagatcctgaggggagtgctaaacatggaagggaaagaacattactcactgctacaaaaacacatacagtacataaaccagtgataccataaagcaaccacacaaacaagtctgcatgataaccagctaacaacatgatgacaggaacaaatctgtatatatcgatattaacttttaatttaaaggggctaaatggcccaattaaaaggcacagaatggcaagttggataaaaaagcaagattcagtggtatgtgagacccatctcacgtgtggtgacatcataggctcaaagtaaagagatggaaaaaaaaaatctaccaagcaaaaaaaaaaaaaaaaaaaaaaaaaaaaaaacagaaaaaagcaggggttgctattctaatttcagacaaaacagactttaaaccaacaaaaatttttttaaaggtgaagaagggcattgcttaatagtaaaggaataaattcaacaggaagacctaactaaccatcctaaatatatatgcacctaacacaggagcacccagattcataaagcaagttcttagaaacctatgaagatacttaggtcactacaaaataatagtgggagactgcagcatgcccattgacagtattacagatcattgaggcagaaaactaacaaaaatattcagggcctgaatttgacatttgacaaaattgacctaatagacatctaaagaacactccacccaaaaacaacagaatatacattcctcttatctgcacataacacatattgtaaaattaatcacataatcagacatcaagcaatcctcagaaatttttttttaaaaaaatgaaatcataccaaccatgctttcagaccacaatgcaatggaaatagaaattgatactaaaaaaatgactcaaaaccataacattatatggaaattcaacagcctgctcctgaatgacttttgagtaaataatgagattaaggcagagatcaagaaattctttaaaattaatgagaacaacgataagatacaatataccagcattactgggacacagctaaggcagtgttaagacggacatttatagcactaaactcccaccaaaaaaagatagcagagtctcaaattaacaacctaacatcacaagtggaggaattggagaaacaagagcaaaccaaccccaaagctagcagaagacaagaaacaaccaaaatcaaagttgaactgaaggaaattgaaatgcaaaaacccacaccaaagcaacaaattcaggactttgctttttgagaaaattaagataaacagaacactagctagaccaataaaggaaaaaagattcaactaaacgtaatcggaaataaaacatgagacattaccaccaatcccccagaaatacaaaaatcctcagaggctgtgatgaacacctcagtgcacacaagctagaaaacctagaagaaactgatgaattcctggacacacacaaccttccaagactgaaccaggaagaaatagaatccctggataccaataatgagttctgatattgaatcagtaataaaaagcctgccaaccaaccaaacaaacaaacaaactcccaggacaagatggatttacaaccaaattctgccagctgtatcaagaagatctagtaccattcctactgaaactattccaaaacattgagaaggagggaatcctccctaactcactctatgaggccagcaccatgctgataccaaaacctggcagacacaacaacaaaaaaatacaacttcaggctgctatccttgaagaacttagatgccaaaaccctcaacaaaatactaccaaactgaatccagcaacacatgaagaagttaatctaccatgatgaagtagactttatccgtgggatgcaaagttggttcaatatttgcaaatcagtaaatgggatttatcctgtagacagaactaaaaacaaaaatcacatgatcatcttaatagatgtggaaaaggtttttggtaaatttcaacatctcctcatgttaaaaaccctcaacaaactaggcattgaaggaatatactttaaaataataagagccatctatgacagatttacagctaacatcatgctaaatgggcaaaagctagaaatattccccttcaaaactggaacaagacaaggatgtcctccctcaccactcctgttcaacatagtactgcaagtcctggacagtgcaatcaagcaaggtaaagaaacaaaaggcatcaaaataggaagagaggaagtcaaactattcctgtttgcagactatatgattcaacacctagaaaaccccatggtctctgcccaaaagctccttgactggataaacaacttcagcaaagtttcaggacaaaatcaatgtacataaatcagtagcattcccatacaccaacaacgtgcaagctgggagccaaatcaagaatgtaatcccactcacaaaacttagaaaaagaataaaataactaagaatacagttaaccggggaggtgagggatctctataatgacaattacaaaacactgctgaaaggaatcagcgatatgaacaattaggaaaacattccatgctcatggatgggaagattcaatatcgttaaaatggctatgctgcccaaagtaatttacagattcaatgctatttctgtaaaactaccaatgacattcttcacaaaactagaacaaactattttaaaattgatatggaaacaaaaaagagccagattagttaaggcaatcctaagcaaaaaaaaacaaacaaacaaaaaaacaaaacaaaacaaaaaaaaaaacaaagatagaggtatcatgctagcctatttcaaactatactatagggccaaagtaaccaaaatagcgtggcacaatacagaatcagacatgcagaacaatggaacagaatagagggcccagaaataatgctgcacacctataaccatcaaatcttcaacaaaattgacaaaaacaagcaatggagaaaaattctgtattcaataaatgatgctgggataattggctagccaaatgcagaagattgaaactgaaccccttccttaccccatatataaaaaatcaattcaagatgtactaacaacttaaatgtaaaacctaaaactgtgaaaaccttggaggattacctaggatataggacctggcaaagatttcatgatgaagatgccaaaagcaatttcaacaaaaacaaaaattgacaactaggatctaattaaactaaagagcttctgcacagcaaaagaaactatcaacagagtaaacagcctacagaataagagaaaaatatttgcaaactgtgcacctgacaaaggtctaatatccagaatctataagcaactttacaaagcaaatttacaagcaaaaaacaaacaaccacattaaaaagcgggccaaggacatgaacagacacttttcaaaagaagacataaacatgaccaagaaacatgaaaaatgctcaatatcactaattataagagaaatgcaaatcaaaaccacaatgagataccacctcacaacagtcagaaagcctattattaaaaaatcctaaaataggctgggcgcggtggctaacgcctgtaatcccagcactttgggaggccgaggcgggcagatcacgaggtcaggaggtcgagaccatcctggctaacacggtgaaaccccgtttctactaaaaatgcaaaaaaaaaattagtcgggcgtggtggcgggcgcctgtagtcccagctactcggaaggctgacgcaggagaatggcgtgaacccgggaggtggagcttgcagtgacccgagatagcaccactgcactccaggctgggcgacagaacgagactccgtctaaaaaaaaaaaaaatcctaagataacagatgccagtgaggttgcagagaaaagggaacacttattcactgttggcagaagtgtaaattagttcagccattgtggaaaacaatgttgcgatttttcaaagaacttagacgtgccatttgacccagcaatcccattactgcatatattcccaaaggaatataaatcattccaccataaaaatacttggctgggcatggtggctcatgcctgtaatcccagcactttgggaggcctaggcgggtggatcacctgaggtcaggagtttgagaccagcctgaccaacatggtgaaacttcgtctctgctaaaaatacaaaaattagctgggcgtggtggtgggcacctgtaatcctagctactcgggaggctgaggtaggagaattgcttgaacccgggaggcgggggttgcagtgagccaagatcgtgccattgcactccagcctgggcgacagagtgagactttgtctaaaaaaaaaaaaaaagaaaagaaaaaaaaacttgtactcatatgttcatcacagcaccattcacagtagcaaagacacgagattaacccaaatgcccatgaatagtagaatggataaagaaaatgtgatgcatatacaccatagaatagccataaaaaagaacaagatcatgtcctttgcgctttgcaggaggaacatggatggagctggaagccattatcctaagtgaactaacacagcaacagaaaaccaaataccacttgctcttataaaccacagctaaacatcaagtatatatggacacaaagaagggaacaacagactactgggacctacttgatggtagagggagggaggagggtgaagattgaaaaactgtctgccgtgtactatgcttattacctgggtgaaaaaataatctatacaccaaacccttgcaacacgcaatttacctatgtaataaatctgcacgtgtacccttgaacctaaaagtttaaaaaaagattaaaaattcatctcaacttttcatctaaggtcttattgattaatgttttaaagtactttattatttgagactcctgtataaaatctcaaacaatttaatataaagctcttttgcagaatcatatgtgtatcgtatgtatatattcaaattttaaagaaaatataaaatttacagattatagctgcctattttacttctttaaaaaaatcaaacaggaatgatagaaaattatctaatcagcattctgtgagaagctctattgttaaaaataatcatttctcatcataaatacacccccaagattttattataattgtcattatttaatatctatttcttctctgcccttggtgaaagggttaaatttatatgcacttataaaaaggataagcatgttttcattgactggcaggaaacagttatttcataaaaggcagaaaacttgtcaagatggacaaagaggatgtgcacgtgtgctctccctgaaagcagaggctaattatgaaatccactacttaaaagcctgttttattttgtcaatttacatcacttatttatttctgaaatccagagatgtttacttattatttttggaaacttgactgttgttcttcatttgttgaggtacaaataatgtactcccccagaaaactgcagagtgagtcagtcattttcagtaagcattacttttatattgaaaatataacttcctccagatgctgggttaaaatcaaaactagcattatattagcctagacctaaaatttctccaggatatcaaagtggactaattcttttcttacccctgcccaaccctatcacaggttattttaaaccaggattggatactgtttgaagagtaatgttatttttagaaaacattacatttgtatccataggcatagatgggaatagagtcttcacccaaccatagtctttttttctaggtgctctggcattatggtgtcagtcataccttcttcctgccacactccccacttgccttcattttcactgtcgactattccacaggattctactttttaaagtcatgatgactcatatttattagaaagtagactattcacactgatatctcaactatgtaagataagtgaagtatttataatgacaaatgtggataatccaaaaatctatttacccatcttatggatctgtttgaagctcttttatataacaatgtggagaggtgagttttgaatgtacaaattaataaagggaggccaaatcaaatgtttgttaaagatgactcataagtcaatcatatacatttataatacaagttatagacatagggctaaggatactattcctaacaaatcttttattcacattatatctatagtgcctgacgtagaacatgatgccatatagcaggtacttagtaaaaggtttttgattgagaaatggatttagtttgatgcaatataacatttgtgaaaatttttctccattttgaactgttgaatgttgactcaagctttttaacattgtatctgcctcccctccctttcctaccagatgttggaaatctctcactttctctggttcttaaagacctgtcatgaaagggtcttttctcacaattgatttgtcagcctagactactgggatgttctgtagacctaaggaactgtagaaccaaacctatttattttataattgcaaattacacccttaaattttcccagagataaaatgacacaccaatttctgacatgttcctgattttatcatgatctttagaatcatttgaatactaaaacgtgtccatcctcaaagttctgtaaattttacttccattagatttgtaaatcttgcctcccttatagtgccatttttcttccttggttaaattagtccaggaaacacagtcattctggggatagttcaattttactcctgaataataatttgtgaaatgtgtattatgtacctactttctacaaaaataaaatgaactatgcgccctggggaatggaaagattccaaatgcatggttgttccctcccaaagaagctatgccattgtggagcttgctgaggctagtgtcagagagtgtggcattcactggatacatgtgtctttggatcaatcactttgtctctcagtcttttctttattagcaaactggggagaaatcctcgattacagagctattgtgtgcattaaattttttaatgcagaaattttagcaaataatcaaacaccacataaagatactaaacatcccagaaaagcttacagaaggagcgaggaactgtaccaattaaacgttttagttttattttagtaaaagtgccatagagctataatagcaactatttactgagcttgtattatatgccaggcacttttcattttaaactcagataattttacaataactgtatgaagttgcaactattattttctccattctgcagactgggatgcaaaggttaaagaaacttaacttgaccaggctgttccagctggtgtattagggatccaaacttacataatctagtttctctgttgttctgctcaaggtgatgaaattttggaagctgagtttacttctggctgtaatccagaaaaattgtctttaaaatgcaaccttggaaaatacatagaattctaacaagtgcagatgaatttctgagaagatcattcctgacccaggggattgtgtgaagaaaggatcaggagtgggaatgtattgggcaggatttggaatgacttttgcagatgtctggagagaattgaagaggcaattaattacaggttctgatagttgggatagatcagattgtggagtcttaaatgtcactgtctggagtttgtgtttgattaagtgggcaacagagtcctataagctgtgctatgtgtcacttgcaatgacagaaccaacttagaagccaggcacaacctaaggtctgatgctgggaaatttgagtgaagctacccacccgaatatagccagaaaagcttgagcaaaagaactgggggtcaggtgtctggaagggagtcactcagtaagagtgaatgttaagaacctagctcaagataggccctaaattcagaaatgtcaaaacttttaagcaaaggaaactttaaagcccaagcaacaattttgtttgtttgcagcctgtttgaagaaccagtttgctctcactgatggctagggggatggaggagctttcttagggtttacaagcagggcttacatggaaaggaaggtaaatgatagagttgtgtttgtggaaaaaataattaccaaagggtcgagatggatagaagagactgaagatagaaggagcagtttaaatgaaatctagtggagtttttgtcaacttaattatttaattgtgggaggtggagaagatctagtgactaatttttgctgattcactattgctctattttcttatcttcatttttctgggaaaatgtctcttgcagtgtaaatatttttaactcttaaaaatatgattgtggtggattgttacttacattcctgcctcttgagtcttccttctgaggatatgggatgattatgactttaagttgaacatacatggcaacttaatgacaacactgagtatggcatcatcaaatatccccagcacacatattggtcagaataaaatgctgtgtctttcccagactcaggagtgtatagtcttagttccattctatgtccagtttcatcagtctctcttatacacaacttacaaactctccacagccacacactctcagttcttataagaatgagactccagtgactgagaaagttgcagcattgttgaatataaagcaatgaaaatcaaagtttctgagttctaattctagtactactgctagatagttgtacgaccttggttaaaaatattggagagatatttgccttcaacttgactaagaaagccagagaaagcattggtaatgctttttttttggtcagtgagaacacacacaataggaattgtatctcttgttgccagcttgtactttgacaaaggtagccattctgttctaataatctcctttcccataacgtttataggccacaactcaggattcagaatgtcattttggcttagttgaacttatttgcttgtctggactttgccttattctgtaactccactgggaaaaattagaaaagagaaatatgggaataaggaaaagagaggtcagataggtccataacagctagtggtgaataacttttgttctcagtttccacactgataaaagaaagcatttgaaggaagtgattgctaaagccaaagtgtaaagactctgtattctaagtcttctaagactctgtatttgaatgtaaccaaagtttagaggtagtggattagaatagaaagagtccagtctcaaccagagactcttaggtgaaatggaaaactattttttgtcattaaaattaggaaattggatcaactcattattcaaacaaaacacgtaacattaaaaattatttatcatgaatacaattagggaaacagatttattaaaaaatgtactagtaataaaattaccctgttctttggaaattttcccaagaattattaccaacttctaagctgtttagtattcctatccaccagatattcattcatccagaatgagttagttcttatgttgtcagggtagtctctgaagacaagataatttttcaaggttttgccattatttgagtgcatcacacaaaaacataagagaaaacgaacaaacatgcatttcaaaaaatatcttcaaagttatttttcctagcagcaaaattcatatccatatatttgcttttctggaaaataaaacagagacaaactactaggtatgtgatatactcatcatcagagacagtcagatggcaaatgcagactgcagctcagagaaaggaacacagcccaaatcaatatcacctctaatggaactcccacgccaaaatccaggacataggcatccagagaatcaaatgctcttccataatggagagtgatttcagcaactgaacattcattgaaagaaaatggatttcttaaatgataacggggggtggacggggaaaggaggaaggattaaaacaacaaaacccagacgaaaatacatagaactgctgttttcccacctgaaaaataaacagaatgcttcatttcatttcacctgtgacttagctattaggaaagtataggtagttagatattatcttcattactgataaatatttattgaacacctaacgtgtgcaaaatattggcaagtttcagagatgcaataaaatataagacaacatatatacttttatgccatattttttctattatgaactatatcctatagtattgtttttataagtatatatacacatacacacatatataaatacattacagtcacacacatatgtatacacatacttgtatgtatgcaatgtatatgtaggaaaatatcaggaataaatatttcaaaatgtcagtaacattaaaatagaggtgacattttcttttaccttttagtgttttccaaaagctttcaaatgtccacactattatttgaaaaaattagctatttaaacattaaataaataataaagatataattcatttcagatattacttaacaagttaattatctattcatgttacataataatagaaattgttgaatgcctagaaggagttccaaggaactgaccataatatactagttgatttctagacatcacatgtcatagccatagttataatgttttttagacatctattctgtgccgaacacttttcttgttgccagaagcagtgaaaaagtacacaaaattctttgccctcagaaagttcacattctagcggggagagttagataatgataatagaagccaataaatatgcagtacatcagatgataataaatgtatagataaaataaatcaacgaggtggcacagagtgccaaagcagaggttagggccgcctcaggttagggccgcctcaggttagggccgcctcaggttagacctgcctcaggttaggcctgccttaggttagggctgccttttaaaataggttgatgagtgaaagtcttcctgagagggtaatatttgagtaaatatctgaacgaagtcagggaaccagccagcagatagctgagggaaaagcaatccatggggaaggaacgtaagtacaaagatgatgtagcaagagcttgcttagtgtgtttgaggtatacaaaggagtcacatggagactgaaaaaaggcaagattaggggtagtaagagatgttattgtgcttttagtaagaaagaaaaaatttgactattactttgaatttaaaattttttaaaaagccattggtgggtttttaccaaaggagtgacatgatctgactttttctcttacattttttttttaacagagagaaagaaaaagaccagttaggaggctgttgtagttcaggggtgaaaagatggtgatggtttggaccattataaaagtggtggaagttatgaggtgtgatcagattctaactgtattttgacattataataaataggatttgctgaaagattggatactgtagtataagagaaagtattcaggaacttcctcaatatttttggcctgaacaatggaaaggacatagttgcaatttcctaaggagggttaaactgtggaagagctttagctcaaagccagttttggacatactagtttggaaatgcccatttaatatccaggtggagtcattgagtagacagttggatagtcaggtctggaattcagaagaaagcttgaggctggagggatacatacgacagtcaaaggtggtatttaagtctgtggacctaggtaagatctctggcagagtgagtgcttatacagtagaaatgaaggtcaagggctaatcctgggagaactacaatatatagggtcactgaattgagataaaagcagggtaatatgaaatggcaagggaggaggaaagaaaactagaaaagttgatatcttgaaatattatttttagtctggtttaaaataagccccaaatgatcataaatctttcagaaataacgtatcctttcttgctggaaaacagaaaaataactggagtccttttgtaaatactattgttgatgttatttctcctactgtttttcactttcctctttcacatatattaatttcctcttaccgctccaaaaataataaagataagatctaccgggaaaggacaaatgggaattgatttgtacctcgtaagtattacatgaaaaaaaaaattcttaaatatggctacaaattcttttgaacttgtttgttttgtgttccaatatgtcaaggaatagatatccacatgtaatactaaggtcttgggagacctggctttgcatctattaatatttctattgctttttattttgtgtgaattcttgggagatgcaggattgatatataaaatgtctgataatgcagagatgtctatcagtgattaataagagatcaaattgggggaaaggttgaaattattaatgtaggatggcatggacatcctttatttaaataaaatgtcagggtgtttcatggaaacccagaagaacaatatgtttgtatttaggtatggtgtgaagaagtgagaacatcatgatatttagcctgaagtgcagctgcatgcagtagatatgttttgatagaacagaaaagcatagaaagcaaaagtgtttatccccaggcaaagaacaggcttcagttatttctgagctggtcatcagaaatcaccctaataagttaaaggctggtctgtgataaaaggctaaaggaaaaccacctacctaagcagtctggaggcagaatttagagctatgcatttcaaaatatttttttaatcaaaaacaatattatcctcttaattatattaaacaattattaaagttgatttgtattttaacttaatatttacatatatactaatacattaatattacacatatctttctcattttaataagtactttcacctttatgaatgcccttcaaaagtgtaaattaataagactctatttgtgctttaaaaaggctaggttggtttgcctcctacatgttccatagagatcaattcagcctggtggccgcaacttgacttggactctgccactctcagtgtgaatgctgggccaacctctgctctttaaattaaacaagggagtgttttcctgtgtgttacccggttatcaaaaataagattcccctaaacagaactgattataactggtaacagaagcaaaaccattgtcccatctggcaatattcatataatttcaggaattctgctttattattaaatgcaggggcagtgtttacaaagatgcagtctcatatagtgagacaagaatttggtcttttctttttttcaggatagtgaatttaaaagtgaaaaaaaaaacagtgaatgaatcatgtattaacttacataacatctaagaatttctgtgattttcttcaccaaatcatctactctactgataggttgttcaacagtactgtagactcatttagtgtcacatacacattctctgcaatatcagtgtctgtgatagtggttttatatttatagagtatggcttttatatgcttgatactgttgattccgaaataagtgaaggaatattaacatattgaagtggtttgccaaacatattgtactgtatcctatagccacagccacagtgggattataatcattttattcacaaagaagtcactagtaaagaaaataaaatgctatttagccttaaatatctagtttagaaattgtcactaaatatctttgaaagacattttataaaattaactttactagagtatatgaacctgagtacctgggagtgtgaatcattagctcaaattaggaaagacgtgggggcaggggtactgatttagttatgagttctttttggaacttgttgaaatcatgaggacaaaagaacatcaatgaagcaatacccagcaggaagtttttttaaagtatgctaacaattcacaagtgagcttaggagttgagaaggagatttggggatagtagctgtgtttgtcagcttgggctgccataacaaaataccacagattaaatggcttaaacaacagcaaaattattgtctcacagttctggaggccagaagtcgcagatcagggtgcagcatagtcgctttctggtgagggctctcttcttggcttatagacagccaccttcttgctgtgtgctcatggggcctttccttaatgcatgcatatgtggagggttggcagtatgagagcaaaagagtgctctttggtgtctctgcttataaggacaaccagtcctatcagatcagggctcttcacccttattacctcatttaacctcaattacattcttataggccatatctccaaatacagtcacattgaatattaggggtccaacctatgaattttggaaggaacttaattttgttcataatagtcagcaaagccaaggaataggtagaattgctgatgctttgcatattgaaaatataagagtataagagccaaaggaaaagtctgatagtaaagaatgatgaagactaagagaaaccattgactctgggtagtaaagtgccatcatgagagaaccacactggaatggtggaaaaaggacctccaaaaaaaactgttcttcagagagagagagagagagagagagagagataatactggtgaaacctatcaacatgaacttttttagaattctagaagtaactcaaaaagctgcaacaatccagagtatttatttgagaaaaatcattgaatttcaaaaagagcaaagaactttgtggcatttttttgctttctctatgttcatcccactctcccttaccaaccagcagcttcctgaaagcagtagctatggaaaccagcagggtatcatccattggtgagagacaacagatttggaacccctcaaaaaactccatcctcactgatttgtcactatttgacctgtctggcagatccctgaaaaagccccattcacaagttctatgtttttttacctcacgtagagctcattcagtgaggaaaggcctatcactcaggagtttgttgaaaaaaaataaataacctcagctgcagttgtgaacattgttgctgtctgaagtagtgataccatttgggccaaacaatagactgactacaactttaaaggacaatttaaggaaagagaagaccataggagatatgataatgtccgccatacttctggagatctagaaggccgcaggcatgtgcacgctggccacattcagggttgtgtgcatgcccagaaaggaattcagaagaccttaatttctcacccttgactgatctcgaggctttgcacaaacaagaagtgaagtctaagacagtttttaaatgttagaattttgaaaacacacctccaatacacacagagagctcctattcaaaagctaagaaacttactggttcaatgcatttaagaaatctctgtctcatcatttgctgctcatatgctaactaagcagagacttctatggatgcatgtaacaaagtatatagactttctggattagtccttaagcaaaaaaattagtcattaagcaaacagcagcaacaacaaactatggggatggaggaatctgtttcttaaattgtcccgttttcaaccaaaaaaaaagaaaaaaagtcgcaagaaacaggaaagcaatgctcatacagaggtttaaaaaaaaagtcaaaacaaactattcttgaggaagttcagatgatgggttcaattgagaaagacttcaagttagttattttacatatgttcaccaaactaaaggaaactatgtaataaactaaatgagagagctctagacagtaacctgagaccacatgaagtaataaagaacgcaggtaaaagttactctacacatgcatgtaaaagagagtacaaatatattttagtttgtaacttttttatctgatttaaaaggcaacagtatagttttagaaattgggttggtggatttatcatatataaggatgtaatttgtgtgacaataatagcagaaagcaggggaggggcgaacatagttatattggatcaaagtttttgcatggaaattaagttgttattaattttaactagatggttaagattttagattaatcgtatttaataataacaaccacatctaaacctagggatataatttttatgcatttacaaatgctcaattgatgctttacagaatttacagttatagaatttaactaacttgttcgtggtcataccaagagtaagcacagagccagattttaaatccaagacttcttatttgagaatctctgtgtttaacatattttaggctttgaaagaagtttataaagcagtaagcaacttttatgcttttacctgggcaaacctgggaatgtcaagtagctgtgaaaaatgctatttctctcttagctgcagccagtttctctgactgtcacccttacttggcatgactgattcccaactcctgtcctcccaactttgtattccgttcagaccaaaccctggatggaaacacataaaacctaggaaaggaaaacaggaagatgaggaagttggagaaatcatgttcttaggatctccccttcagtttttgattctgttgagcaccaacagtgatacaaaatagaggtgcaaggatgaaaaaccaaggggctagtgttcaaaggtttcaaagcctgtaatgaatgcatgtggcaactgatgactgcaattctgcccattaccttttattgttgccctggccctcttctgtatatactggatgcagtctttctttcatgtatagaagagtcttaattcaatcttgttgtgctgtcactgtcttatcaataatgaaaaaattaggttaggactaaagtagagctgttttagtctagatttccttttggtaattcatgtgagacaccctcattaaaaactgaatgggcctaaataacatgcttcaggaaaatatacactggggataattttttttaaaaaacaacttgttttgttcctttgtgaatcatggaggacaaataaccttggttaaaataagttactgacagctttaacattaattcattccatttactgtgtgcctaaaatgaatcaggtactgttctaggcatcaggctctaaagtgaacaagatttaactccctgactttctggagatccactgaaggtaaaaaagggaataacccaggagctagagagaccaagaaacattctcaaggttttaaattaatttgaaatcccagacactcagcccctgtttctggagctcccacaacccttctttgatggccagatccctggtcaaaaccaaagggattttcctgtgtgtctcattttggagcctttccatttctcatgttctttggatagagttagtggcaaagcaaaacttctacatttgtatggaattacttcctgatggtccaaatacagtccttgaatttgttttcccatagaaatatgatggttctcttcatattcaatattcagtaaatattgtagcctgcttcaataatactatgatgagtagattctgtaggtaaacatatacctgtatgtgtgtggatattacacaaaattagtccacattattagttgattaataactgtgtcttctaatctttccccagagcaaccacctgacccccttgagtgttttccagcaggactcctttcttcgcagcatacctagttacatgctgctctcacactgtatcttattagtctctatttcctatccttactagattctcatgcctgttaagctatatcattctgcttaaatcatgttttccaagttcatgttaaaatgaagcttctatataaagtatttttctccccatctgtaacttctcttcttctgaattatcataaaattatgtttggatttattttagcataccaatatactacttggcataatagttttgtttttctcctaaatacagtacttttttctccattccaccattaaaccagtcatttaaaaggcagaaattctgcttaaagcatctaaatgtttcccaaaagtgcttagcacagcactgcatactgagatgaacacttaaaatacaacctgttcataaagtgggctacattaattccagccaggcatctcaataaacactatttttaaattgatcagatgcacttgaagggcattgctttcacgcccccacactatctccttgatttctttttgtagcccaccactgtacatgagactgctgctgtttttttttcttattatcattattaaatacttgatgttagaatccaagcagcttcttttttcctttgaccatgacgatttcttaaatgtcattgattgaaaccacagagttgaaatgtgttttagggaataaagctttgttggaagaaagtcacctgtgtaaataaaacattataagtagaaccctgcatagttttcctttgcttttggtatgtgcagacctttaatctatagctttcattcttctttataatgtatatcaaatcatgaacatgttcttttttgagaaataaagtgtattctacctctctcacatgatccctgcccctctttctaatcttttgtgatctatagaaacatgagatgttttcaaaccaaatattgagtctatctgaccacaaaatggagatttcctctttagtgaaagtgtgtgttgatggattttatgttgtgcaatttaaactgcttctcaaccattaaatatggacacttaaatgcatttaggatttagacatcagcttttagtggcatcagccttcctattttgttctctttttttgcacaagtattaaacacagccaacagtgacttcagattaattcatggatatgaaactcatttgtcacagaacctgacagattttcacaatactaatagaaggccagcatttttcatttaaatattgaacttggtgttgcatagttgaataatgaaaatgattcttctttcttaaaaaattaaaatcaattttggttggcacagaatttagataataattttatactcacttaccttggtatcattctgttagtaaattagattaaatttagaaaagattgttttacttttaaaaataaatccagtctgaaactgcagccatccttggtgatctaaagggttctgggaataagctatttcatattggccctgtaatattactgtcatggtatctacaggtttgatcccattagacagtcttctttgtattatctagtacagactggatgggagaaacaatgtgattggctttgctaattaacctcacctcttgtgggaagacagagtcctcacagcccagcacttcacaggtcattaaccagttgacctggtattcagtgtactcctctggacccatcagtgactaccctctgtacaaaaaataaaccaaccaatagcattaacaacaaagcaaacacacacaaaaaaacaaacagcatagcactatcttacgaggaagcatctttgctggagaggggagtattaggcttggcagacacatgattgacatatcccatccacccattcattcagaattggatttgaagaggcaacaattacctcacattgagctttcctggcaattaaaaaaatatgcaatttaggaagcatatattttattatagttgttagcccataactacaagttttaaataggaaaattgtatattttaccttaggaaagcaagttagtaaaatgcactttaacctgctaatggtttttttaaaaatcagggagcttacacacgtagtctcatgactggttaggcatgaacacaatttgacttttaataacagttattttctcactggtgatattaatcttaaaatttagtctctgacatactttctatagtctttatatttcaaatgtgtggacattatctttaattcttttgactatatttagtattagaactttataagacccgttctcaaagcttcaagatatgcctgaggaggaccaaagaagtttggctaaatgtttcctagtaaatataatggaaagacactggattaaacaaagttaatcaggttttttgcaatacatgttctcaaagcctttctatgttacatattttgggactctggactctggcagagaaggttaagaaaccgacccctgctcttctttatacttagaaagctcactggactaatgctctgtagttttcactttgccaaatgatattttagtgcttaatctcttagatagcatctttcaaaacatctcccttgatgatttatagatttttatgaagtctggtgactagattagatgatttatgactatacctctagcagggtgcatgagtgaacacaagatatttttgaattatctgagtatattcatttgaagtggcaagaacaagggtcattaacttattaaccatgtggaaaaactagaaaattgatggtgtcatctgctcagaagttatattcagttcattgctttggatcatgcttatgtcctaaactcttttatactgaagtgtcaacgatttaaccagccatctccttatttcaaggttagtgtttactttctgcttgtacatcttaagacaataaggcaaattataataatccatgagacagtgaactccgttcctgatgttgtttgtcacactttcataattgcaattattattttctgcattttttaaatatttttctacttcccattctttttgtttttttagagtgcgtgcattactctataacctaaaagataaaatacttttatagatctattttctctgctgttgtcgctgggacagggtcttactgtgttacctaggctggagtgcagtggtgcaatcatggcttacagcagcttcgacctcccaggctcaagtgattgccccacctcagctcccaagtagctgggactacagatgtgcaccaccatgcctggctaatttttctatttttttgtaaagacaggtttttgccatgtttctcaggaaggtctcaaagtcttgggctcaagcaatttgcctagcttggcctcctgaagtgttggaactacaggtgtgagccagtgcacccagcctatacatctattttctaattcaacacagtgtctgacacatctttgtattatccagttgtcaatatccacaaattagttaatgccaaatataagaagcaattattgcttgttaattaaaataaaacaatactaaaatgtatataaagtagcatttttataatagcaccttagaattgttttgtcaaaatttttttaaaatctgatttaactggtttatttttactccagttgacttgtaggtacatagcaatttttaaatgatattattatgtcttcaacctactaatgacttaaaatactgtctctctttaaactatactagagtgtaaaggatatagtaacagtcttgactctgaatttaccagtaagagtataaatatcactaaaattaaataaaaactgaaaaagcatcaactacactaatcataatcaacctctgacttatattgtgtaccaaccgattcatcgaattgcttctcagaggtttttacaaaactcacaggaaattgtctaaatacaaatcttttcagaaataaagatgagtttttaaatgtctgttaaaggcataataacagaagatattgtgagtagaatatcctaaggagaaacatgtgcttttcaaaaaataaatattttggctccctataaaatacaatcttaattatttattatgaccatgtagtcgcagaatcatggaacacaagtggtgctttaagattatgctttaaggctacatcatccattcttttgccttgaatgagggataattcgtaacaaaataataattgtttcttattccttatcctcctccttcatggttttcctatctttgtgtctttctcttttcctaactctttctctctctgtgtctctatattagtcagtttcttcttctttcccttttgtgttagacgaagtaaggaaagtagatgataatgcgttgagagagcagttcagtaatccagaacagtatgtggtaaaatgagtgacagcaccagtattttactttccgaagaagacaaaggagccttgtgtgattctccctataaagcagaagacagattcaggctgctcaggggaggagcagccagagccctggaggacaacctaagaacagtattgggaagtgattgcaaggcttaagaagaggataaaatggagtggtttccaggggaactcaaacactgtaagaaaattagagattgtagatgaagacatttcttcaagctctcagagcgattaagaggtaaaactataattcaactgtcccctccccactttttttctgattccaaagcagatgttccttctgaaaatttactatgtgtgggctactggcagaaaaggctgaaagaatagagaatgtaaagaggaaaaagggaagagacagtgatgtctttatggggacaagagcttatgggtaagagagagaactgcaacattaagagtttgagcatcagtacagaaagggtaaatttagaaaccaaacgaggaattaaattaatataccccaagcatgggaaaattatgtggcctcctaactgctgtgactgctttctgcctctggacatatttcgtttgtcttgcaaagtgttttggttttatttttggattcttcttgttctcaaattgaattagtgcctacatttacagactagattataccccaaagtgctcattttattccacttttgaaaagtctgaaaatgacaatacatgattcttattcctatatggtcacaattttcagtagagatcataaataattactcttttcagacacacattcatcacttcactcagggactcaccccagcctgcttcagtcatttgtctgccttggtatctaggtggatttgaattttttgaaatctgaagtaaggagcaagcaataatctaatcttagattgtaggatgagtcatttgacatgtatttactgatcaggcagtaatctaggacataaaatataatatagtgaagaaaccagaaaaaaattccttcatggtgattgtgttttaatgtgcatggcagataattaccaatcaaataaaatatatagtgtggttgggtgtagtagttcatacctgtaatccttgcactttgggaggtcaagctgggaggattacttgagatcaggagttcaagaccaacctgcactacatagtgagaccctgtatctaaaaaaatacatgtttttaattagccaggcatgggggtgcatacctgtggtcctagcttggaaggctgaggcaggaggattgcttgacctcaggagtttgaggttacagtgagctatgagcacacactgaactccagcctgagtgaaagagcaagatcctgtctctctctctatgtgtgtgtgtatatatatacatatatatatatacacacacacacacacacacatatacatatacatatacaaacacacacacgtatacacacagaaagaaaaaataggggagggacggagtgtgtgtgttggtgataaatgcttaagagaaaaagcaggaaaggggacaggaagtatcagtggcttgctattttaaataggatagttaggaaaagtcttactgtggaagtaccacttgagtcactttaaaataagtggatgggccgggcacggtggcccacgcctgtaatcccagcactttgggaggccgaggcgggcggatcacgaggtcaggagatcgagacgatcctggctaacacggtgaaaccccgtctctaccaaaaatacaaaaaattagccgggcgaggtggcgggcgcctgtagtcccagctactcgggaggctgaggcagatgaatggcgtgaaccccggggggcggagcctgcagtgagccgagatcgtgccaccgcactccagcctgggcggcagcgagactccgtctcaaaaaaaaaagaaaaagaaaatgagtggatgatccctgtggctcttttaaggaaaagagttctgagcagagggcaaaaccaagggcagatgccctgaatggatttgctagtgtgttctaggaaccttgacgaggccagtgtggtgagcatggaatgaaccagtgggagaagtaacaagggtccagatttggaacgccttacaggtgactgctactacttcagctttcactgactgtggtatgaaccatatataactgtaaatattaggctgtaaagaaagtgagtttatgccaaatctactctaagctacaccatgaagctggatatgatttaccttatataactatcccccacttctctcagatacaagtaagggtaaactgtgctctttaaacaatctgtatagttcactgtgatcgattgtttggaagaaaggatgcaggtaggtcccaaagataacagaatagaaatgatcaggtcttaaaatgggtgcttgttgagtacaaattcctcttttgattgttgagtgatgttctgggtatctattcactgcctgtcagctccatagccacccttcattatctgctccgctgtaatggagttagaccctccaagtgtttctcctttgtacatcttaaaattaagctttgtcagtagagggcactaaagcaacattgcagaaggaaaagggtttcttttcctggttctggtgtgatttggttttgctttttgctactattgcaagaatgcctgcatgggaacatccggtggcactctgctttagccacacacccagtgcatgcagtccggggcaccaggttcttgctgtggctgtccctggtttatagatggtctcctatgtacagttggtctcctgctgctctgctggtgagcaagctccaatgctctgactccatttgtgtgtgcaccaaccagccctcaccagcctgtaccctgagggaagtttccactaggctagacaaatgtggatcaattctggtctggacaattcagcagacttctccactatctaccgggctgcagccataccttctccagtgatctgaatcctagacttggggaggtctcccacttacccaagttgttccttcttaggtactccgttacccctgagatatataatgagccctgatttatataatatatatgggagagagagaatatgtgtatgcatacgtgtgtatcactaattaagtgctggcacccagatacgtgctgtataattgctatgctaatcacatagggtagagtagacaaggggatttttacctttcaaatatcttagagttcagtgggagagagagagaaaaagaaagaaacatatacacacacaatcacatcatgtggtaagacttatgatggaagtgacagagtaaatgtaataggaaggtcaagtacatctgatagggagagttagagatgttttgagtgtgagaaaacgctgcctttaaggaccacccaatcaagagttgttgtgttgttatctttgtatataacacgaaatctcaacacaaaagataatttctaaagatgcttagtcttgttatagactgaaacactttgacttacccattattgttccagaactataatttactgggaatcacctggtagttgaataatgaagtcgactttttagatgcttacttaacactcatgaaattatgcactgaccagattctcctaattgtagaaaaaaaaataattcacaaatttgaaagctcatgtcaattatttagtcatactttaataaaatattggggcaggaaaagctctcaattttattttatcactaagccatatatatccagggcacatatttgcatatggttacaacgtgctagcacagattcgaaacatcatacatttgtttaactactgcttcttttaaataattaggacttaaaagagtctagcaattatagtttaaattgcaaatggaaaaacatagaggttctatttatctgaatctgtattgtcttaaacatcagtgctggtagaattactttgcatttagcagtatttttccttatcatataaataatacattaaggtataaaactgcccacctgtgctgtacatggttattgttcattatgttgtccttgggaagtctggttcctaaatatttattactatgaactcatccagttgctttaattcataaggaatatgtggaaatcctaatcttgttcttttgaaatgcagtgaaccctggaattaatgtggtagctgaagtagggggaagtttaaaccacaattcttttgcacaggatcaatggatcagttccagtgtaaacaaaggttggtttagtcaaattagccatctgtctctgatgaatttaaacagtaatgtgacacatttagtactgtaacaagcttttgcttatttttaagttttttttttttttttttttttttttttttttttttttttaacagagagaaggtaacagtggataatagcagccctgggtttcctctttagattaactcttgagctgcatagtagcatctttctttcatgtacaacagttggcagaatttttttttattattatactctaagttttagggtacatgtgcacaacgtgcaggtttgttacatatgtatacatgtgccatgttggtgtgctgcacccgttaactcgtcatttacattaggtatatctcctaatgctatccctcccccctccccccacccgacaacaggccctggtgtgtgatgttcctcttcctgtgtccatgtgttctcattgttcaattcccacctatgagtgagaacatgcggtgtttggtttttttgtccttgcgatagtttgctgagaatgacagttggcagaatttgtaacggttgcacgtttgaaggaacttccatttctagatgctacagttctcaaattttttcacagtcacttgacatctgttcaaagtctttttttcttcatggattaaccagttaagtctgccattcttccataaagtggtctataagctttaattacatgcatgaatttagtgtcatattttacttttgaacagacagaaagatgtctacttcttttgttatgtggctaactttaaggcaaggtcatacatttagggaaattggacctctgaaatctcttgatggcaaggctatatggaatatatatgcttagctattaaaactattggttatttaacccatttcctgtttagaaacagtgcagcctgctgccagtactcatttatcagggcaaaggggaaatggtttaagtaaaatccttttactattcatagaagttagtagtagtgcaatagagcgagactccatctcaaaggaaaaaaaaagttagtagtagttctggattgtcttgctggataattttcacttcattacaaactcccaattatttcttacaacggtataaatatattctggtacttattcttctccattgttaaaactggtatgatggttgattggtgtgattaacaagtcaatagaggacttgtaaactcttaactcttaagtgacaaaatgcttggaaactcccatctgctgcagcaatgtgagactcacagttacctccatacttcagaatagacagaacataggacaattattacttattcatttctttgtgctaatatttacatcacctttggacatacaatcccccagatcacagatgtgctctataaatatacaaccaccatctggaggagaaatatacctttaagtttgtttttaatgattcatttgtacatatttcatttggtaatttgtatttgcttgactgtgtctttgtgatagattgaattttccaccctaattcttcaccctaccttacatccacacccattgttttgggtctttgtagtttctccacctagagggagggttccatttcttgatttgagttcagccatgttacttggttggatcaatgagatgttaacagatgtggacacacttaatgactttcaaggtatgcctgggcttgccctcctgggttctgccattgccatgagggctcagttaacctcttcctccaagaagtaaaagagacatgtgaagccctcttggaaggcaagactagctgacagcagcctagaccagccaatccccagccgactggcagtcatgggagtgagaataaacaattgttgttttaaaccactgagtttgtgggtggtttgttatgtatcacatttgtgtctaaaattttgattgattcagtggcttttattatgaagaacactgcctttagaactattgtactggaagttaaagaagatgaaaaatttcagtctgcacctatttcatgtttatttgtgtcctcctttttgtttgaatttacttatatcaaacatcaccacttctgagttccattatctgcttctatttttagcctgtcactttattattgaaatgcactccttcccgactcagagccacttcttccacgtcctttctaacacagagctgactaaaccctggcctgtagtcttggagaaaaatggcaaactcctcacaatgactgccagttacctctcaaagtctttcacaaaagcagcccctttgcctgactgctaatataagacatgacattacttccattccatttatactgtttgcatttgacttaatttcccaaagttaggtgttaacctaaataaactagtacctaacttacatctgcatgcccaagagaggaaaacaaaatggcttcttccagaacaatgaatttgccctaaaaaggacatcgtgtttctgctcttagaaccatcaaaagcaagtaattgtcctgttatatgaaagaaattgtgtaagtgatataaatggaatgtacatagctgctttttaatttttttttttcattttgttaggaattaaaatacagactgaatacccaacacctggaaatcctaacgttgacaaataggttctgaagaaacagaagtaaaaaacatgttgacatattaaaatagaacttttcacaattcagtttctaattttgagacacaatctggattttcctaggatttagctgagtggcattcaaaaacagctgcaacaggagcagcaatattgtgttccttcagctgtgtccaaacggatctgtgagacatttaggtgcttcagtttctctccagatagtctgggagttactggggaggttttccattatatgtttcactgtagttctaaaatttgtcatgtgttatctgatattgtctaccttttctgctattggtgccgcaatataccagacttggttcagagtgccaggacaacctgtgcttttgaagctactgatatggttaggctctgggtccccacccaaatctcatctcaaactataacccccacatgtggagggggggacttggtgggaggtgattggagcatgagggtggtttcttccatgctattcttgtgataatgagcgagttctcacgagatctgatggttttgtaagtggcggtttctcctggctctctctcacttgctgctatgtaagacatgcctgcttccccttccaccaggattttaagctttctgaggcctcctcagccatccagaactgtgagtcaattaaacctcttttctttataaattacccagtctcgggtagtatctttatagcagtgtgagaatggactaatacagctgctatttttgttggcaccaaagctattgaatctaaagccagcccttttcattgttacttgatcttttattgaagctaccagcttctccctcaatcacacctctactctggggtttaaatattatgagttcatgaagactgggctataaatcaacccgagtaatagatgtttcccctattttaaagcactcttacctaaccaaaattagctcactgtctttgaacttctattgagccccatgtctcacccattggatactttttttcccagtagttttctaagttacatgaggctccctacacatatccagacccatttaattactatagtggaaaaggtttaggctgcttaaactaggacctcatgtagattataaatattttatagtgatgaattttaccttttaagctgcatttatcatgataagggaatgccatatttgtactttttgcttactgtctttactaatcaaataacaatataataattaatgctatttaacaaatagatatttgggacctactgtgtaccatatcttttgctaaactctggagctaataaaatgataagtcagaagttacttattttttctaaataagtgtccagtctactaaagacacacatatccattaaaaatacacaggagtgataggaggataccgtgacacagtcagtgtaatgaggtcactattcttaaaattccaaattaggacacaggcatgatagcatatgctgatttcaaattatattctaatatgtggtggtgttttgagccttctccatatgtgtgtggaggcagacaatacgtgtggaaagagacatcatctcctatttctgtatcttccaagcctcttagtcccagatgaatttatgtaaaatgtttgatccaatatgtgtctttcagattggaattttacttgttgatcaatcaataaatcccaacatatatactaagaatcagctggtgggtcttccacagtgctggatattgtgggaatggaagggcagacaagaataaggaagactggaatgtatgcaacatgatctgtgctcagagtttgtaatctaattggcgcatgtctcagacatatgttgctttctttcctggtgtttatttctccttcctccagcaccctgatattcctttgaaggattcatcctgccaccattctaagctatgtgtagtgggaagatttgaggacaccactgactcaatagaaccatctctggtctcagtgattgactttaatgatggatatgtgacctaaatcaggacaagaaataaataatcccaggattaagtggatgctgtcagaaaagatgctgacttcaacggagctgtaatatggggattggagaactagggctgatgcagccatgttgctaccataagggaaggcatgatgttttggaggccataggatggagcctaagatgcagcctattccaaggaaggaagaacaggaaagcatagcaaaatcagatcactgataacattgtttgaggcactggataaaacctagaattgaacctaatctgtactacatctggattttaatttgcttgagctaattattcccttaaaaaatgactttggattagttctactgttactggcagcaataaaaagttttaactgatacaaagaaaaaaatattcagtggtatgacttgtgaaaaagagctcagtagcaagaaaattagaagaaagtagtatcactgaaaagcacagattaattctaatgtgatagtgcaaggaggtgaatatgatgtagtggaaatatactaaacttgatttgctctattggtccctggaattactggactgaaatagaagagagagcagggctagaggtatggccctatgggtaactattaagatgacagttaaattcattagaaatgaactcacaaataataaacagtaaaatgcagtggacttagtgagaaaaatttattgttagggcaaaattggtgggtgagaagataatgaaggcaataataaagaaggaaagaccaagtcaggacctgtcaaggttataaaaaccaaagaaagagaaacatttataatgccaattaaaatggatagatctaatgcatttctttaatgctaatgactgcaatcgtaattgacttggaagatgaaaactggaaatttttctctgcctttaaagggcttggtaattaatcataaatatgtagaggcgaagactgctgtttgatgcaattataagagtctgtagctcatctcccctcactttgcactgttagcctcaaattatgtgaaagacttagcacccttataaggagctcctgaggtggactagagaatctagatgtggtggtttctgttgaataacccttatggtggtcaattttctacaacatttgctttgatcgtagtaatatgtttgttggtcttttcctcattaaattattttcagaatctttctcccttgattttatagacttctaaatataaatgcacacaattctctgaaccaaatagaatacatgttttcaaatttatatggtttttacctacatagaaataagtgcttcaaataagaaaccattatttccttaatttcaaagggtaaatgcattcagtgttgcagtcaacatttgacaagtctttatcaacatgtcttgggtttaaggaagagtctccccgactaagatgaaagaatactgcttagtttagtgctatagaatgacaacagtgaacatgctatgctcctagagataaattcatttaattctcataacaattctatgtgcagatgttattattatccaaggtttacaagcaagggattgaagttcagataggttaagtcacatatataataataatacattttctaatggctgcctaaaataggtcaaatacttcttttcccttttaatatgagtcgctgctagtattgtcttttgaaggaccataaaacacatacacattttatgtgattgtgcgtcttgtatcctcattttgagagtgatcatatttgaagtctttctaaaggagaaataccagatccaaagaattatatcctctactgggaatgtaatgttaattaggtggtttttgtttgtttgtttgttttgaggtggagtctcgctctgtcgcccaggctggagtgcagtggcatgatcttggctcactgcaagctctgcctcctgggttcacgccattctcctgcctcagcctcccgagtagctgggactacaggcgcccaccaccacgcctggctaactttttgtatttttagtagagacggggtttcatcgtgttagccaggatggtctcaatctcctgaccttgtgatccgcccacctcggcctcccaaagtgctgggattacaggcatgagctcctaggtgtttttaaatcttatacggaaaattaactttagtctaaaaacttaaaggtgtgcagattacatgaacttaatttacttataatttaggtaaggtgaacactagaaaaaatatttgttttattttacctatcattttgatgttgctcattcatgtttctaagtagcaaaaaattcaagtgaaaatgtgattcgtctaactattgtgggatctagccagcagcctgcaatgcaacatgactctttctttgttcccaggcagattggcaggtcgagaagtaatagacacacacaagatagggggtccaggggggtcactgccttctggtcctgcgatgccgccaatgcacttggtataccggcatttattattaagtttagtgaggatgggggtaagttaatgagggatttaggatcgtttgattatgaggtgagaaggtcacatggggatgaagtaattctttagcataacatctgtatgcagaagtacagtatacagagataagaatttacaatatagtgtgtatatcagtaatttctaacagagccttaaaacagaaacagactttccataacctatgattagcaagatattaatcagcagtaacagtggcaggaaaagctggttacaaacaatcagtagaaacaggacgtgaagctagacaactggttagaccagaaattctccgaagggagtatgccttaaccctaaagaggcctagaagagccgtggcaagatgagggcatttatagccctatcttatccatatgaacaggcgcccctcatgcatctgtttataggctctccacaagggttgcattccattcccagagctatgaacatctgctttcctgggataggaatcttggtgatgtgaaacctccctgactacacgtctgttcataggctctctgcagggggaagcacatcatgcactgttggctcattctggcagcccaacctggcattgtttttacacaatcctgcatgctattttgtatttacaataatcaggaggatttcatcttttattccgtagcagtagtttcagggggtctccctacagtctaaccactatggcaaacaggaatggtgaaaaatgcttggaactgtataaatgtcatattcatacatatcctacaacttctaaaaagtcttcaggaaagtttctaactgtgacatgcataacggcatttagccaaacatgtaacttacccctacccatcaaaacaactgcttctccaggtatagttctagctgaccattctcagtatgtttcatgaaataaaataattcagcaatttaagtcaagggttcagaatgctggagtagagttctttgttaatgatcactaagaatgtttaaaaaaaattagaaagagagatttttaattttacctttacaagaatacatgtttttctttattattatttaattaaatcttctctattataataaaataactaaaagtatataattggattgtttgtaacacaaaagataaatacctgaggggggggatacttcatttactctgatgtgattattatgcattgcatgcctatatcaaagtatctcatgtactcccataaatatatatacctgctatgtactcacaaaattaaaaataaatttaaaaagtgataattgctcatgatagaatttctaagaaaggatagagttgatatctgtctatgatttatagaagtttttctgtgatggttatctgaaaataaactcgctaaagttatgcaccaatgagctttattgcagatgtagtttataaaaaagtttgtaaaaaaaaaattagccaggtgtggtggcgggcatctgtagtcccagctactcaggaggctgagacaggagaatggtgtgaacccggggggcggagcttgtagtgagcccagatcgtgccactgcactccagcctgggagacagggagactccatctcaaaaaaaaaaaaaagtttaaagtttgtaaaatctcccttgacactataggaggtaatgatctatgtccctttcctagaaagttttctgaaattattttttggaatatatatagtttgtacctgagagtagatatttagattattttcttggtgtagtagatagattgttttacaagataaaatatattgatgatcttattcatgagtttcaaaatcagatgcaaaaagagagaatttatttaaggctatgtaaagttagaagagaattatttgatttgatcaatttggtctaaaaaaactaatgcaccccaaagcaaataaatattaatctaatcaatactttccgttatatagatcatttaaaaactggttaaatgtagcttttaaaacatttgttttacttaatgttgttgccataatatgtctatactttttgtggattattattttctagtcttatttgcaaatctactggaaatctattctcaggcaatgacagaagagaccatgatctccttcttttattggaaggtggaaagttgccacaagtttcaacagccactgaccaaagaacttccatattttggattcttatcaatatgtatgatgactgtttgatgagataatatatcatgagctgtaaacaactagaagataagctctcagagggcagaacagagtttgttttgtactgctttattctgcatgctaacatcatgctctgcctacgataagcactgattaaatttgattgaatgagagcatggtgggtcagaggtgtgactgttagcagtgccgtgtttaggtacaggagaaaggcttctagaggacttaggcactgagaagaacaggcctgacctggcctcagttcttgtgaaaaggatgtggtggttttatttggccttaagtttcatgtgtgcttgctctgaaatgtggatacaaaaaaggtcaagggtaatcgtattacatattataacatctaaagaaggagtcttattttgttagcttcatgctcttgccagcattttctgtttttgccttctgtttactccttgcccttagtgtgtaaacatgctcaagtttctccagcattaaaactaaagaacttatttggcttttacccactccttttatctctttcctctctctcatgtccaaattattaaggaggataattggtagtggatgtcttcaatttctcctttctcatttccgcttaacctctctgcagtctggcattgccaccactgctgtgctcaaaatagttccattgaagcctccaaggctgatattatgagggtcaaatgcagagggtatttctaagaaattcttgctgcatttgaggcttctcctcatatccacttcttgaaactctgttctcttgctccagacttcagagtttcctcttttctaactacccaacctcacgccacatcactcctgctgtatactttagctttccccaaggttctgccctcagtttttggctcacttgttttctcatgtacacatgcttcacagattatcctttccactgcaagtatttttaacacaacctctataataactgtcttttcctttctttcctacctcctgcccttcctttttctactccttccatcctcctttcttttgttccttccaagaatccatctataaaattcttgacagatacacaacaaaacaatggctgtttcctagtgggaaccaagagattgtgtctagtttctttttatagttttatttattttctgatttattttacaatgaatgtgaattagctttaaagtcagaagtaaaaaacaaaattatttccaactagaaacaaacagaaatagtgattattctcaagaataaataccctgtttgactctcccgtaatcatctcacacacttgaccttaccctctgtgtgaattaagtgaagggcaggaaccatgtcttaatcacctttgtaggttgttcagtatggtgcttgggacttagtaaatactcagtgagcatgctgatactgtgataagctcactgcactctctacaattaaaatgacataccaaaatcttgggagacgtgggtgaaaactcaaagcagatggggcttggaacaacattctggagaggagagtgcaccatggtgatctcaacaattgttctacttttttcttaccaaaatctgtctattttcagcaaagagaagagagcctgaggaggaagtataaagtcagacgcttacaacagacttgctgggttggagagagagactgtcacagccagggctgccaagtaaatcaggacttgagggtgaagaagaaatctcagagaactaaaccagaaataatatgcagtaggtgatttcctctgaaggcatttgccaattcttacactacacaagtgtagggtgaaactccttgaaatcaagcagaaacctgttcccgggagaccaaatagctgagcaaagatatcaccgtccagtcgtcctggggagagagaagttagagtttagtgcctaggaaagtggagtggtccttttaaataccactagcttacagttttgatcccaaaagtactatgatccaagaataagagcaaactggaagaaaacaccatccctaacaaatcccaaaactcacacttaactgaagatatcagtaccttacctgccttctagaataaaataaaattctatttggagaaaaatcagaccaaccagagcttttgtgcaatatcttgtgtactatttataatattcatttaaaattacctggcatgctgataaacaggttcagatgaccacaaatgaaaaaaacatatttaatagattatttagattttggagttatcaggaacgcctaagtatgattaatattttcaagaaatagagaaaaagatggagaattttcttaaagaactggaatctgaaaaatgcagtgattgaaaattaaaaattcaatatatggattcataacagatttggcaagtcaaaggagagggttagtgaactgaaagatcagtgcctagaaatatccagattaaagctcaaagaaggaaatgcctagaaaatgaagaagaatatttaaaaactggtgacatgtgcctacatatatataatttagagttctagaaagtgaagagcaagagaatgggacagaatcaataaaaaatttaaactgaagattaagccacaaatccaaagtctgtacactccaggagggtaaatataatggaaaaaaaacacatctggacacaccataataaaactgctgcaaaaaaagagagagagaaaaaaaaaaaacttaaaatcaattaagctttttttttattattttattttattttttgagacggtgtctcactgtcgtccagggtgaaatgcagtggtgcagtctcggttcaccgcaacctctgccttccgggttcaagtgattatcctgtcttagccacctgagtagctggggccacagctgtgtgccaccacgcccggataatttttgtatttttagtagaggcaggattttaccatgttgaccaggctagtctcaaactcctgacctcaggtgatctgcctgccttggcctcccagagtgctgggattccaggctgaaccactgtgcctggccagccaggctcttttaattttgttcattttgagttccacatttatagaaagtgactgaaaaagtagagaatatccagtggcaagtgtccagagatcataaaagaccaagagactggacctggaaaccagaaaaccataaaaaagtgagagatgtgggaacgttaaaccagaaacgagtaagtgagacaattaccgtagtcttaaaaaatttcgagtgttgtcaggatgaaaaggcaattttcttgttctgtgttatccagaggacagagttaggatgcaagctgcaaggaagcaatttgtgactcaacataggcaagtttaacaaatgaagctgaatgaaaatggaacagtgaacttccaatcattgagatttttaaactgggatttagaggacaaagcttcacaaatgtagaaggtattcttaaattgaatgtgagtttaatgagcactcctgtaagactccttgtaacttgaaggttaaataattctgtaatgtgcattctagtgactgatggttgtattttcatgaccacaactcgcttaagaaatcattcatttagtcattaacttagcaagtgttactgaagacccacctcatggaaggccccctcacaggcattggagctaccaagaggcataagacacagtccctgacattattttgattgtgcacatgagaaagcctattctggagagtttataacttattcaggtcactataatgtaacttagtacgagagaagacaggacatatattattaaaatggagctgaatagtgtaaaagataattcatcgccactaaatgggtattttattcctttttacagaggagattacgtgctgtttgtcatatattgaacaaaactgctataaatataacccttttcaggacactcagatgatcttagcatactgtagcttaattctctagaagccatacttggagcctcaatgttcttatcttaaattatctttcatttcttcaatgatctctactttctgtttcagttgtcagtgtaatgattccagttttctggcgtgaagtgatcaaataagtctttatgtaatggtagaagaaagatgttattaatagtaatttttaaatgtattttctgtgccattaaagtaaaatcctctgcacttatttcctgccccaaacattttctcctactcagtctaataggtttaacactccttgatcccattattttaataatctaggctgaagggttggcttacgttgtagtttgaaataaggatacaaatcttcaaaaatatgcttttcatactaaagtctattttaaaaactatcatctagtagaaaagatgctttacatttaaaagcacctttaaactggaggaggaaataaaagaaataccacatacctcagttgtgttctatctgtccttgattttgccctcaagcattactggaaagtattgtcagttccactgcctgaagatggtttttggaggaaaataaatgtttcaactgtgacgctgtgttcccatttgatacacctttcaacttgcaagctgctgaaggaagaaatagggacatttcgtttcagtgacaaactaaggcaaaagcagcttctaatatgatggatagcaaaataaaaacagatatctctgttgtgatcgtgtgctgaaggcttaatgaactcacccctagtctagctataggctcacatataggcaggcagacaggcctggagtcacctggagactgagcccacctggggattagagcaaagtgcaggtgcctttgcttcatctgtttccctgaatggtccttacctgttgtcatccctcacagtttcatttgaatttatatcgagacaacctgaagattccatggatcgattacagatgttaacctctaagtattctgaattccagtctctttgtcatcactttttccacttcagatagattttgctaaaagcatactaacacatagaactaagggcattctccaaatcactttaaaattataaaaaattaaaattaaaataatagataataattcagggtcaatatcaattaaattgtatttaacctctactttttgtgttgaacttctaatgtatatccagaactattttggtgattctaattaacgtaggttttaccataataactttgtgtacttaccgggtgttttgtcatgtgaaacctgaataagcgagaaatatggacttgattatattttcattatttttctttcgtcctttttggcctttgcttatttggcatgcctaggtagggagcacaggctgtttcctatttcaagagcatgttgttaatgtttgataactatataaatgtacacaacaatactgatgagccaaagaaattaagctttgcaaagggcagctttaatttgttgatctggagcttggaaatgtgggttattttgtgattgaataacgttcttgaatgtttaatgtatggccccatttaccttgattagctcagcaattcgtgacacattatttccaaagatgctaatcaattttaaatcaaaatagattgaattgcctctaaaattgtggagattacccgaaagtgtcaatctttttgggaaattgaaattctggcatcttaatgaatgcagcctagttatggaagtactgtatgagaataatgggttttcgaaatactataaagtagggataaacttctgaatgtaatagttacttttaaattaatttagcactagaattattttatctattacatttgaaggaaatacctctgctattattgctgattctattccttgtataactgttaaaatttgaaacttagaaatatcaccctcactagttattatctacctcattcacttcttctggattgttctaactttacagtttcagacattctctgtggtcagatggtagcaaaactactcagaactgcatgtataaaattatttaaagcagaaagagaaggcagtttctttagagaacacttccaactgaacatagcatttctactgatatttaattgtgtgtgtgtgtgtatatatacacatatatacatatatatacatatatacacacatacacaaatatatacatatatatacccacacatataaatatattctagatatttaattaaaacacaacattatgttgttttgattaatctatttcacatgttaacttgcatttctattgcaagagaaaaatcattggcatacctgtataaagaaagtgaaatgcaaagttttctaaccattggtttatattagttaatgtgtttaattttagttcagtggagtatttaaaataaggagaaatagaaaaggaaaatgttttccttttagagtcattcaggggcttaatatattaagaactagaaggacagttttttgtttcgttttgttttgtctgaaaagtaagtataaacatgcctatgggctgggtgcggtggttcacgtttgtaatcccagcactttgggagactgaggtgggcggatcacctgaggtcaggagttcgaaaccagcctggccaacatggtgaaacctcgtctctactaaaaatacaaaaattagccaggtgtggtggtgggcacctgttatcccagctactcgggaggctgaggtaggagaatcacttgaacccaggagaaagaggttgtggtgagctgagaccgtgccattgcactccagcctgggtgacagagtaagactccatctcaaaaataaaaataaaaaacaaacatgcgtatggagataaaaatcacaatttttaataacataaagatattttgaagagtggtcatagcattttggaatttgtatgatcccatctcatattgagctcctaccattactacctttggtgctttggacaaattattaaactctttgagcctcaattttttcattcataaaatgagcctaattactactgctctgtagaattttctgtttatttgtttgtttgttttttggagagggcaatggcaaggtcaggatttaataagatatatgtaaataacttagcagtgcatcactgcacctggtaaatgttcttgttaaaactgctcttaatgcatgaatgatgagtcagggaactttgcaaggtaccctgagaaagactgaaagaagtacatgtgatatcatctaaaaactgatcccccacatccagattctagtttcttattcaataattgaatataaaaaattacagtcattgaaccaatgactaagatgctctggaaggaggaagcaagtcttcccttaaaaagactggggtcagggaatgtgggaaatcaattttaatttctgtgtatgtgtgtgccttcaaagtggaagttattttcactaattattttatccatgacaggttttgctatccttggatttaaatcaatgacaaaatatcaatgtcttcaataagcattagaaaagaaataaaattctcgtgtaagttgaaattcatcctgtactgatattgtttgacaaattattgttccttaattctgaatgacaccattcctgtactttgaggaaggtcaatattagtttaaatctgaatttatctttaactcaagtgaagtttattcaagtttttcatgtaatgaatctaatagattggaatcatatttcaaggagtggtcactggttccttcagtgttctaaagtgtacattcatttccaacacgtcaagtgcttaatttaaaacacttattgattcttgatttttgcttggacgtgagctcatttattttaatggaattgttaataaaatgtcagctttctcctgttctgtgttctgtatctgttttctgactacacttacttgtgatgtgtcatagaaaaaaatgactaatataatttctcaggccttgaaaagtacttacactttaatgtccatattatagatttttacgttaggaagttcacatgggttcataatatgcagttttacttatcattgacatcagcctcttctgggaaattaatctcatgagttgcttgtagtgggataatagcagcaactgtgcttttggatgatcattttcagtgttttatgattttaggcagcatttttgttgcaggtatccattgcatttagcttgatttctcaaagtgtatatttgttgagtcagaaggatagagtgacttttcaaaagagaggaaaacatcattaaagagagaatagtacattgtgaatgcaaatccttagagagctcatagtggctcctgagaataagtgaagtaggtgatttgatgatgtgatgcttcctagggaatatggctcagaggtctgcacttcataatatctgagatctggaattagtctatctgttaagccaggtgtatagacatggcatttgccaaataagaaatgactttaaaaatatgaggttgttccaaaatagttccccttgttctcaagcagtggctctactgatttattatctggcttcatggagaggagagagtttattatcaagaaacataatgaccttctagctcagtgcactttatttacctgaagtaatactgagatgggggaaaatgtctttggactcttggtttatctcttaattccaaaaaagaggagaaaatagtccttactcatttggatatcattatctcacaaattatagcttattaaggtaagaatgcccatatatggtgtaaactcataattttttttccaaatgaaaagatgactccagaagattaaaacaatgtgacttggaaagtaattagggagggtaaagagggataaaatttttccacttccctctgacaaaataatcaaataaaaacttgggagaatttaacctttgccgtttttatacttgcgtttactcatcatttttaaaagaaaaccatcaactatttccattaagcattacatgtaaattcaaactctctaagatagagtaacaatgtaattgaccacatgagttgtatttttgagtcatatgctgtatacaaaattgcaatttaaaataattgcatggaggggaaaacaaaacaggtgacttaagacatgtggaccttccatcctatgaagagaactgtggagaaacaaataacaatcagctgcttaaattagaatgtaggtatgcatgaaatataaaatagattaagaactaaaaacaaaataaaaatattttaattggtagtgttttttatttgtttgtttgttttgttttgtttttgagactgagtcttgctctatcgcccaagctggagtaaaatggtgtgatctcggctcactgcaacctccgcctcccgggtctaagtgattctccctgcctcagcctcccaagtagctgggattacaggcacccaccaccactcctggccaatttttgtatttttagtagagacggggtttcaccatgtttgccagtttgatctcgaactcctgacctcagttgatctgcccgcctcagcttcccaaaatgctgggattacaggtatgagccactgtgcccagcctataacttgattttttaacaaccaagggcatatggcctccaaaagaggcaaaagttggaaaatgaaaacagtaaaaattatgatagcctagcacttagctaattatctatgtctcctgaatgtgtgtttgacagcttctagtgtcaccagactttatataaagcagactgatactatagatggcttatggctcctaagtagctttattgtcagattcctgtaagaggcttaaacatgttagtcatccaactttctttttaaaatgtttccctataaagatatctaatgttatagaatattagataagaagaaaaagcataaaagtagacataaaataacaaaatgttttttggcaaatgctttttgcatattgttgcaaattatgagcatattcttatctattttgtgtgtgatgtgatatgtagatcaataataaaaagcttaatgttttgttttattctaagcaattaattagtatcttataacagtttataccaagttttatatatttatcaacacacatatgcatatataacattaacgtgtgtttttttagaaattatttatctctatatagatatttttaaaattgcattattgttctcttcttattaaaaagaaatttagcacatttgttctcctgcagtatctgtgaagcctggtgaactcactaccacccgcccatcctccaccctcacaaatttagcaagtttttctggttacagtattctgcttctagaaatctagagtaccatcagtcagttgctgtgaaagaattatttctttgcctaccttagtaatatacatatacatgcccagttagcacacccatacctcttcactctttactgctccagtcacctacaatataaaaatctctttatttctattacataaccacccccatgaccacacacgataaagcatatacatttttctctcctcatcatgggcactcatcactttaattttttacactattgatatttttaaaagaaagaagaattacaaagtgaggaaatttaagacacacaacatttaagacacactttttctttatattaaaattttcagctttctagttgaaaaaacagtttcataaataggaacaaatgaactcatgtaaattaggttattaaacattttttgtcagtttcatgtatttaagtataagctattcttcatgatgtttgagtaatgtcagttcactctagccttatgcacaaatatgtgggtaactgaaggacagaggtgtctatgagctgcccaagttcattgagttgattgcatgggagaatctaagagtacattgcctctatctttctggaatagactaattttatactgagtcatttaacatcatattttgcatttaatataaatttacatatatgtgattttttttcaaatctcatctgtgatttgcatattgcttttttaaaatgaagattaaaaatagtatttttggaagttataacttactttctaaatattttgctgtaaatatcctttgttttcttctgccattttgtacttttgctatgagtgttcacatgatggcatgctaatatctctgcattaacttttactgaaggatatattttaacatcataattttccttcggagctctggggtgttttaagcttgacttctcttgattttagtcatcaaaagactcccacattgagagttaaactataaaagtcagctgaaagcattttttgcaggcatgatattttccttgcactaatttaaaaaattcaatctaagattcattttatctgactggtattttcagtctaaaaggaggataaataatcatatgtgaaaacatttattgacatatataaactatttgttaataatacaactatgctgagtctcaatctgtgattccttccaattgtttcttctgtttctctaatgaatgtatctatagtgcatggggcaatttttttattatcaataaagtgtccactttttttgttcttatggataacagtatattttctaatcattttctagcttacccttgaattagaagtctttcagttacatgtggtagaaaacttaaccaaaatgggctttaaaaattaaaagatcataattctgcctgcgtatctgcaaaataagatttttctaacttgatgtacatcttgatctaaaggttcctgatgtcatctttgaagtttggctttgcttatctgcagtgcttcagctatgcccgaccctatgaacagggacaatgtccaggtcagcttcccacatggcagctgaagttcagaggaagattagcatttcttctggtacttccccttaaaaagatggtgagattactctactgcaaaacccaacaaatatcttcttatggcttattggcttcatctgagatactcatccctgaatcaaactctgtactcaagaatatattcaagtctattaatcagtagtaatttagtacctggtttaaacatgtgtccctttgaatctaaggctccacacgctaagaataagttcaaaggaatttggcagaggaatatctgggggctactggtgaaagaaatggggattacatgctgagaaggtgacaataaatgtctgctacaggtcatttgtaaaagaccattttacaacactccttatgaaaaatgatcactggtttgtttttaatttcctgtaaactcatggttttacttggtaaaatttaatgcacaggaaggatatggttccaggatatgtgctataaaggactgatgaatatgcaaacaggggacataagcatcacctgcaagtcaggtcttatttccagaaaactatgcataaatggactttgtgcctaagaaaatgtactaagtctttgaactggggctaatgattgaactatggttattttccactggctttagaaataaagagtctcattctctttgatataatttcctgacagtggaatgcaggcagtctttaacttaataactgattatgattcaaaaatgtatttggtgtttcagaatttgaaataaacatgtagatattggttctgtactatttgcagatgagaaaactgaggtgcagaaaactcagtgaatttgaccagggccacacagccagtaagtgacagaaatggtatttatacctgtacagtctgtgttcttaattgctgcatatactgtccttcaaagttgggcctttttttattcctaaaaatatattgtggtacctgataacttatgtttctagacttgcccaccgtggcttatttatctttttgtactgctgagcatattattctgagagttaaaactaacccccttagttttaactagggtgttagattagattcacctctcatctctgtcttaagtacttgttgatatttggcacccagccactggatagtcattgattctattttcagtgtgtgaagattccggaagaatcaggaagcaatgccccattgatctctatacaaagatagcagacattctgctcactgactgcagtgatgtcaacatgcgacacaagcttggcctatcagatgtgaactttacatcttgatatgtgcagggtattcacaggttattcacagtagtggtaaccaaatggagagtccagcagcattactgaaaattactgtgatgttgccaggggaagcatcttaaatattcattgctgtggcatcatctttataatcaactagccagcccctcatccaggcgtaattctctagtctgctgtgcaagtctaggagtcactctaaatgctgaaataaattccttttctgcaaaagctctttaccattactttctaactatgactggcagagccacttttctactctgttcttcaactaatttgtttattcagtaaagtttataagaaaatacaaagtgagcataggaacaaaggtagaactttgtgtatatgaagagacaaaacatagttaatctatattttagagataactaggcttaaattacacagagcttcttatcacaggagatgggacagggccactggtcccctgctggcataagaatatctagagaggtgggaaagaagaaagaacttagcattgtcatgatgtgacccccttgtaatcagatgttttggctgacaagcagtatctaagagtatcaaagaaataaatgagttgtcttttgctaatcattggagaggagggataaaataaggggagggataggaagcacccttagttgggactattattcctatgtgatctttcaagtataaaggacaatttactttatatgtgtataaaataagaccccgtctgtataaaatggactgcaaggcatgagatataatggaagtatactgatggtagaattactgggtatcattctagtcccagggctggtgtcaataggtttgtgatttatggaaaaacatctcaagagtttcctgtgttcttgtttgtaaaacaaagattagagacatctaaatacccctccttctccaattattactacagaaaactcaaagggcagaattccaggagttaattttagtctagagtggctttctgatctaattttacttgcttcttaagtccaactaggagctcacaaatgaaagatggctcgtcagtgtcacatttctcaggaacttgggggcattgcccatctctcttttagacttaaaaaatgaggccggttgtttaaaggagaaaaaaaaatatgccaagtggagttttctcttcaactgcagctagtaattgtagtaagtcttccctccacctttctcaaaaacaaaacaaacgaattgaaaacagtaaaaggctgtcaaggtggtcaccttgttaaaaccaaaactccttgttgttaagtctgctgttggtggctttgttgtcaacttctgagtttcaactccccactccggtgtcactacattctacataatgttttagcctactagcctattcctagaaatcaacaagatttgttgagcttttgcattatttcagatgttacatattcatcttagactattccaatagtatctgagttcttacacaaagagggaaggtacataataaatgttgttgaattgattcatatgtgagttacttactgaatttggagaaaccatttaatattaatttttacagcattagaaacagaggtcaattaatttttaactcagaatatatgatagggaatgccaatttaatgtacttttagtttcttaaatttcactctccagctatcatttatttatggttcttagccttaggaacaatatgtatccgaagaaatgtttacattgtgattgattctgctattactggtgaaatgcttatttacccattcatttttccagaatgggtaaataaaattatctatttttctatgtgggtagaaaaaaatcactaaaaattgctagtgaaatgctcatttacccattcattcttccagatgaatgagtgggtaggaaaagtcactaaaaatactcgtgggaaagaattaaatgattcaacattttccacatcaggagatcttgcacaaaatattaaattgtcccatgtatatattaaagtgattgtttagaatatttctttcattgtaagcaccactagtacataaactattactgctttgttcactacagtatcagccatataaaaaaatgaaagaaagtcttcaataaacatttgagcaattagactgaatacttctcctatataatttgtaatagttcctattttattaaggtgatgctttctttcatcatgagctttacttcagtaacactgctgtataagaaacattgtttctgtaaaagtcatcagtattttagatttgttagaaaaaaagcataagctattgacatggaatgactatatataatagcaaatggtgaaacagttcttatcttgaagatgaggtacatgaagtgtacatcaaataaataatacaataactaactttgtgaatgtaaggatattattaaaagtttccttgaatactatttagtcaattttttgtggcattgtgtataaacgcagcagagttttgaagttcacctctgaatgctggttgagagctagaaaagatcgtgtgttaaatgaggatgataaaacatgggacctattttcttcccattctttcatctagctcaaagatggctgacaccctcacagtgagaaaaagccatggattttgagtggctctatagggaatctactttataagagactgacatcaataatttcaagattatgctgtcatctcctaagaaaatcattgaactgtggatttaaattagtatttcacagttaaaatactattaagtatggaccttggcatggactacgatagatttatgatgtcgatagaacaaagcatctcttaataagtcattcaaatctttggcatttgaaaggtgataccatttcagtaagtaaaatggagaatttgatttctgattttatagtcccccaactctggggtctatttgagtctttatgagtgattttgaactacagttgaattgagatcacattaaatgtttataatgaggaaattatcatgtatacccaaaattttactgaaaatttcctaatgcagaaaaatgagaagaaaaagctacaatgggtagtttcaaggtcactttttaaaaattctgacacttatttaatttaaattcattgttggacatcaaaatcagatataaacaggaaacgttttacactctaacatgtttatgtgtccacatatgccacctgaacttagaaagaaaataaaatactaagtcagttgatatgcatggtgttcaatgggcagttttcagtaattctcatggtgccccatgagacagtagcacatgccagctctgtgatccttgacaaagactttactgaaccaaagtttactgtttgtgggttattgtgcttaggtatgcaaaatggctagagcaatttggaatatgtaggcctgcaagtgtttaacattaaatacacacacacacaaacccctgtttctttgagcggtagacctgactctgtgttgccataagttgttcaccttcaccattcctttttcactgtcttcctgctcttcctttctcctcaattcaatgaagatagacttcctgcctgaactggctgctttaccagttgcattgatatttctagtttaaaagtgtttttgtctgtgtatctgtcttcatttgctacctttcctctcttaggtgtgtgcaatatacaaaaattttaaataataacttgaacgaaacaatttttatactcaggaaaatataagtcctgttttaagtccattagaattgaaacaataggaaaagggcaacaaacaaacaaaacaaccctcttgcacattaactgtttccacaaaaagaaactttaaaacagtttagttatttaatagatactttctgtgttataaacaaaacaatctcttccatgtatactatttaaatataaaataattttaaatgtttatttaatagattcagtatgtaaatacaagaacctcttatgtgttagctgtttccacatcatataaatttttaaatgtctaattatttaatagatatgttctgtattagaagtggttatgtttttttctataaacatatttaatgctgaacttatgacacagtctttcaaaattcaatttcatttccaccagtaatgaggtttcttttgggccaaaatgtaagttgtcttccttcattcattaattcattatagtaaggtttgtttactgaaggtcttcttcctgataggtactgtcccaagatctgaaggaacactaatgaatgaaatatagtttttgccttcatggagttaacatgtgtaggtcggttggtagacacaacacaaaccaataaaaataagaaaactgtggattacaatatctgccataataaagttgagacagggcaacagaatagagaacaacaacttgtagaggtaaggctgtttttgccaagatacttaatgaggcctgtaccaaagaaaaaacatttgagctgagatccacactatgggagcaaagcactcccattctgggctgagtaaatgacaactgcaaagtctctcaggcaggcatatgttggagcagggcagaaagaatcactattgatgggaggttaactgtgatgagatcagagagacaggagccagctcctgtaaggatttattgacaaccacaagcagtttggattttattgtaatcacaatggaaaatcactggaaggcttcccatttatccttatatcacctaggtgatatcagtcttccatttcaggaagaaaagggaggggaggaataactaaaaacagcaacatgactattcaaggatgttctgattacctcagattttttttaagacattgagttaaacaatcacaataaataaaattaggcagaactctcaagctaatatccaaaggctaaaggccaagataagttaaggtttgtagaattgcttaaaagggcttttcatgtcttatttagaaaatgttaaacaaggagaactctctttagttctcactgtatatttctgtcttagtttgggtttctataataaagttctatagactgggtggcttataaacaacaggaatttatttctcacagttccggaggctgcaggcttgaaatcaaggttttaatatggtttctggtgagggctctcttctaggttgcagactgctgtcttcttgcttcatccttatgtggtagaaagggtgagggagctctccggggccccttttatgaggatgctaatcccattcaggagggctctgcctgcatggcctaatcacctcccaaagtcccacctcctgttaccatcacaattgagagttaggaattcgacgtacgaattttcatgagacacaaatatcagactatagcattacacacctgtccccccaaaattcatgttcttcacatacacaaaataaattaacatccccacagccctaaaagttttaactcttcccagcatcaacactaaagtctaatctaaacatcatttgatcagacatggatgtaactcaaggtacgattcatccctaggcaaattgctgtcaagctgtgaatctgtgaaattaaacatgttatgtttccaaaatacaaacattggaggcagtcataagatagacatttcctgtccaaaagggggatagagaaaagaagacgtaatggatcctaactccaaactgcaagacaaatttcatgagatcttaatccttaggaataatcctcttgatttgatactctgctttccaggcccactggggtgaaaatgtcatccacatggcttggtaggaaggccccccaccccagtggctctctgtctaggtcccacagctattctgggctgcagtcccacacctgtggctgtgccaggtcgtcatatcctttgaaaggtaggtggaggcagccatgcccccagtgctctgctgggcacagctccttttgcctacatacttcaaataaaagagctccccacacttcccccttctgtgctttcataccactttccttcaatgatccgatccactttcatggataaccacttatgatctccaaactcattttttaactcattgtccttagttccagaataaacatttcaagggttttacaaaatatactcacgcacaatactatcccatcccatctcagcaaaggtgcttctagcattctatcttttttgtattatagtttacttaattactcaatgtagactaaattctgtcatctagacatgtctgtttttcacggcattctggtacaaatggcagctactttctcatgttctcttgtgtgtgtgaagtgtgtgaacgttgagtaacccaactttcttcatagaaacctgtctgtatctgcaaccatcttaactctttgcctatattctcataagaaggtgtgttccttggccggttgcagtagctcacgcctgtaatcccagcactttgggaggccgaggcgggtggatcacgaggtcaggagatcgagaccatccttgctaacacggtaaaacttcgtctctactaaaaatacaaaaaaaaatttaaaaattagccgggcatagtggtgggtgcctgtagtcccagctactcgggaggctgaggcagtagaatggcatgaacccgggaggcggagcttgcagtgagccgtgatggcaccacagcactccagcctgggcgacagtgtgagactctgtctcaaaaaaacaaacaaacaaacaaaaaagttgtgttcctttatgcacaagacttattttcatgtctgtgtttatcttattgcctcctatattgttctagtcaggatatctaagctacccactagatttcatatccatatggaaataaccaccaaaaacaatcaatgcaacagcaacaaataacctttcttacttatacgtggagactttgtttttataacaacaatgggagtaagtgttattcttttttcccttctgtttctcattcatatttttaaaaattcagaaaaactactggtagcaaatatatatatatacagagagagagagagagagagagagagagagtcaatcagcaaattaggaaatatgtggctgccactaattaactctacattactcagatatttttacaggaagcatgctccttaataaaggaccagtatagtaaaaatagagcaaacagctatataagaaatagtgtaaggaactggaaatatttagtctggaagtaagatttataggagagataactttcttcgaatatttgaattgtagccttgttgaaaagtagctatccttatgttggaagtcttccatagagaatggaaatgattacactactatatcaggaagacttcctaacaaatagagccattcaaaaatagaattctttttcactgatgtcaggaagtacccagtgatatttagatagaggcaagacttgtcaagagaggcatagtgggattcatgtatgaggatgagctggactacattaaagttgcagtcgttttttcagtccctgcttcagttctcagattctgtgttgcagcagagtataaagagtaacccaagcaatcaactgaaagatcttaagcccaaatttaattttcttcagttattgacataatctcagcagaaacaaaattttgtatgaattgtttaggcagttctgacactgaagataagatccatagaagtattatctgggaggaattctttaagtataaagaaaaatactaagagaataatgcattacctatatcactagggacaagttgaaatcactattcaaaacctttctttttctagtgtctgataatttatagccaacatgttatagctacttgaaagggactaaaagtgagaggtttatcagctcttttttagttaggatcaaacatggctatgtgaaatcttgttctctctccttttcaggtctggtctgttttgtacactctttacaattgatattacattgagcttattttcccaatttatttttatgcaaatggatttctaaactgatgtgtcagtcctgctctcctggtagttcatcttctgaatgtttaaatcaccattgaatgtattttttttcacaaaccatgttcataattctgtcttctaaatcctcttccttattccattacctaatttgaaagtaaccagtctccattatctcctaggttcctatggcagctggatagtcctttgttataaccatgattctacattctctgcaatttatctctctgttctcttttatattttcatttatgatattaagtagatttgatattatcatgtatcctcatttcaatccattatatgctcaactgccaacaagtgcttcttatcaaattctagtgaagtaacttggaagagcacaatgatggtacatggtaatgtgcaaaaaaaaaaaaaaagtaagcagcctttttgtctcttcttccactacctcctagtgaccataaaaacagaaaaaaaaaagtctaaactcacgctggcatccagagccataaaataaactctggattttagagatctaggctggctctgctgcaggaaaccatccagggacctcagttccatcctttgtttgacttcacaccttctgacctcaaatgatcctcccgcctcagcttcccaaagtgctgggattacaggcgtgagctgccccgcccggcctgcattcttttttcatactaagtgttggaaattcctgtgtgtattttatatttgcaacacatctcaattaggacttgtcttcaatagccacctgtttggctagtggctaccatactggacagcacaggacaggcctggaatggtggccactgttgcagaggcagtgaccttaacacattgttctcacatgcatagtgaagcctagtcaagtgtcagaaacttccagcctataaaggaaaagagagagaaacatacgaagtccggggcaagcaatttaatttaaaatactgagaagaaatttgcacacgacacttgcatttgtgtaccatgacaagaagtcgttcatgtggccatatctgggtgtgaacaaggttgggaaataaagcttctaaatgggtgtttgtaggaaaaatagatttttttagaggaaaattagctgtttttttaatcagttccattttttcatatttattttatcttatgtgtcagccttagttatgcgcctttgctcaaactggttagcccatttggatgtcttctctgacatccaaactccatttgcctaaacactttgtgctcaaaaaattactttctttatagagaagatgctgatcattccagacaataggaacttactgaactctcatagctctttatctatgctcctgtcatcactagtaactctgtattttagtagttatttatgtgcatgtcttatctctcctacaaactttttgtccacagagaataggacctgtgtcctattcataattttctcctacttcactgtgaagaatgtgctttgagcatcatttcttctcagtactcatttggtgaatgtgtgagtaaattgattattatttttctaaatttaggtccaaccaagtaaaaaatcaatagacaagactcataatggatatatgccgaacacatgaaggtcttaccatagattatgaattattccatagataaattaactctggatttcaattcaaattatattttttattgattttgtattaatgttgcaagaaatggcagtgtaagttgaaatttgggggttaactgaaaactaagggagaattaggacacattttgcaaataatgacataaaaatagtgtattttttactagaatggattattaaaaacttgatcaattatacattaattggttcatttcttcatttgacaaacacttgagtacatagtgatgcaacaggcattttttaaaaaaatattttgacacatcttaattgtacttatttatgagtataatttgatgtttttatacagatctatgttgtgtaatgagtcagtcagggtagttagtgcatacatgacctcacgcagttatttttttgcggtgagaacattcaaaagccccttttctagctattctgtaatatacaacattttactgctaatcttagtcatatcactatgcaataaaacaccagaatttattcctcctacttgtaagttcgcacctgttgaccaacctttctccatctttcccttccctctcccctttctgacaaccactgttctactctctgtttctgtgatgtccactttttcttttttaaagattccacatatgagtgagattatgtggtatttgcttttctgtgtctggcttattttactattttacttaacctgatgtcctgcaggttcatccatgttattgtaaatgacaggatttcattctttttcatggctgaatagtaagtccattgtgtatacagcacattttttttatccattaatttgttggtggacagctaggttgattccatgtattggctattacaaataatactgaatgaaccatgggagtgtggttatctcttcagcatgttgatttcatttactttgtatgtgtagccactactaagattgctggatcatatgatagttgaatttttagttttgtgtggaacttccgtactgttttccataatggctgtactagtttactatcccacgaacagtataaacagtttgttagtgttcccttttcacacatcctcgcctgcattttttttcttttttttatgatagcccttctaaatggaaggaagctgtatctcattgtggtgttgatttgcatttccctcaggatcagtaatgggcatttttgaatatacctgttagccatttgtatgtcttcttttagaaaatgtctattaagatctttctgcaacagacattctcgagacttcggatatagcatgaagaagtcagacatcatttttgtactccctcttgtaatattacaatataattcactataatgtgatggagaagaagagcattgaaaaaaaatatatgtatatgtaaaattacccaccaactgttgtaaatgttatcaaaactggtcacctatagcaggttcctagtccatagctcagtattcaaaattaacatctgcatccaaggaataataatggagaaaattaacaacggcatacaaagaataattatggtttaaaaaaccatttttagaatgaaaatatggcaatatggattactgagcaattaaaacaccaaagttttgaaagagttcatttagatttttttagagcaatttgatccttggtctcccttcacgtttaaccccagatatattcgttttattacaatgtaatcaataagtattgtgtcacctagctgtataaaaagcatcataaagttgccgtgtattctaggttattaaggagatattagggttacacattttgtacatctatttttggtactaggctctataaaagatgagaacccttacttagagagggaagctaggactaagcattcacaaactagatacaggttaaccacattttaaaagaatgtcacagatacatagtgaaaaaggagaaagtaaatgtcatcttgaacatcaataccactcaaccatattccagagaatatgcattggtattggcaaccaggaaaattgtattggtattgacaacaaaataaagggataagaagcaagggtaaagttaagatagtagaggaggccgggcgcagtggctcacgcctgtaatctcagccctttgggaggccgaggcgggcagatcacgaggtcaagagagagagaccatcctggctaacacggtgaaaccctgtctctactaaaaatacaaaaaattagctgggcgtggtggcgggtgcctgtagcccagctactagggaggctgaggcaggagaatggcgtgaacccaggagctgagattgcgccactgcactccagcctgggcaacagagcgagactccatctccaaaaaaaaaaaaaaaaaaggtagtagaggataatgtagtgagagagtggtgaatcaattaattttgctaatcatatcacttatctaggactgcttttactaagccacctaaatatgcctttttttttttatgatacctaaagcatgttttactctctgacctcttggcttttcctataactaattttggacatggaacccagctatatccactgtactgatcatcaacagattttaaaacagatttatatttcaagtacatattttttaaaaaagtaaaatggtctaaattgtctcattgcagtccatactataatggagaaacatcaggtaaccaagtgctactttgaaggatgaatttgaatttttaaatgttaaacggggcatttgtgtatgtgtgtttaaactttttctgaagcaggatgattttaataacataatatatattaaaaagtatcgtttagctggacacagtggctcaagcctataattccagcactttgggaggcaggaggaggatcacttaaagtcaggagtttgagaccagcctgggcaacaaagccagaccccttctctacaaaataataattaaaataaattactcgggcatggtgacaagcatctgcactcccagctgcttgggaggctgaggcagaaggattgcttgagtccagatgtttggaagctgcagtgatctatgatcacgccactgcacttcaactacagactgggtgacacagtgagactctgtcccccccaaaaaaatacaaataataaaacaaaaaaacccccaaaggattatctttgagatttaaaatgttatactggattcacaaactatttcagttctttgtgtagtatttaataaaaaccttctcagaaagttagttattagagtgggcttatcaatatcctaaaaggtatggcttgagatacaaatcttcatgataaaactgatgagtggcatttctctggctaggttctttggtttatgttttggtgttttacacatgagacagaatttagttctgtgagggagccttaatttcatcagtgtgatcattgagtatatgcatttattctttcttcatttgttggtttatttgtaatttttagaaatgagggtctcactctgtcacccagtctggattgcattgacatgatcgtaactcaaactcctggcttaagggatcctcctaaaagtaagggatactttttaatatatattatataattacaaacattcctggatgcttcagaaaaagttccttagcctcctgagtagcagaggctacaggcccagctattttgtctttttttaaacctttcaaatggaccttttaagtcaacttataaattaatatagcataattaattctatgtatccataactccagtaattatgaggctctcatcttatttcttctctttcacttttttgctagataattttactggaaatcttgcacatgttatttcatgtataaatacttatataatgtatttccaactaatatagacaattgaatggtgtgttagtttgctagggctgccatcaaaaactactataaacgagatggcttaacagcagaaaagtattgcctcacagtactggagtttacaaatctgaaatcaaggtttcagcaaggccatgccacttctgaaagttctggggaaagagctgttccttggattgtagatagctgtcttctggtgtctctccacatcatattacttttacttgtgtcaatctttgtatccagatctttccctttatgacatcagtcatactggataaaggcccactctaatgacctaattttaacttgaggttaattgacctcatttaactttacctctgtaatgactttctatccaaataagcccacattctgaggtattgagagttaggactcaaatatatcattttggggtgacacagttcaactcataataaacattaatctatctaacaccattatttacaaaatccttaacactatctaataccagttcttattcaggtttccttgatttgctctaaaatatcttagtagatatttgaaatattggagccaaagaatatctgctcattatatttatttgtgatgtctttttcattctgtaaaggactctatctcatcctcttttttagaaatgcccttcagttgtcaagaaactgatttacttgtcccatagaatgttgtgcattttgaatttgactgaatcatttcttaagaagtcatgtaacccattctactatcatctcttacccgtaaactggtagtaatattcagaggtttgatcatatttaagttcagattttttaaatgttacatcatatcatgaagcacataatatctgactattccactttcagtgaggataaaattcatcggtggtttcagggatggttacccttatttttgcattataaaatatacattaatatgtaatctaacaaaattcactgatgatcattacctagatctattattatttcactggggtttcaaaatagtaatttttattaccctttttgtatttttagctataatctttaatagagaagaactctcccaaattattcagaaaaagcagggtgaatgtttgatattttttctttttttaaccaactttgaatataagttgcttctaactaactacagttgtaatgaattggttctattaactttcgttagtctccttgtgaatatatggattttaaaatgtctgatgtgttttgatcaattgtagtcatgattatttctaatgctaaaattgttgcattctggacccattggaaccccttctgcttggttctggcaacttccaagcctgtcagcacatgccccaggttcatcttttatgtatcctcccaagagtccaaaagtcagctatttctctgggaagcactggttcaagtgagaattagtatttggataccacaaacttggtgctagttgttaaattttgaattttaatgaaatttcatttcagattttctggctcagctatctaaatcagtatatatttttcatgaccagttttctttctgttcttttgtagtgttgattttcttattaccaatgtatagagaagacccctggttacaactgtaatcatatacaaaataacctaaatagggaaagaattcctgttacgggctgaggcctctaaatggtcaattgttcagtcacaggattaatttaccttttgaaagacttttaaaatatccaaggagttcagtcaacaggagcagatgaggaaatgtgttcaacatagttttgaccgaattgaaggggtatgagccacacagatttatgtgtggggattatacatgttttcaagtatactttatcatactgttttgtgaaaatatgcaaatgatttttcaggggaagtagacatgcagatttttttttaaatcgctttaaacacttttagtattggtgtattttccaacaatgtctactactaaatttcacattttctttcatcttcaaattaaatatagacacatatatccctgtggttatctggacaaagataaatgcctggacacaaaatgagagaatgcacaattatagtagaataaattagatccgattgaaaatgaaaatctgtttataaattctcaagcatggaatcgcagtgcctacgaactgccccttctagggagacagagcctggatgtcgtgatttagtaagtacaacaactcatcaaaagataagttctgcttctgttgtgcctcttatttctcttattatctttggaatagccaatctttgctcatctctattgctggaagctgtaggtatataagctgatagtggtagggagctataggacaactgcactgttcagattctagcaatgcacataaaaataaattaattgcctatttacaatttatgaaatactttcttggtctagaagaatagggaataacagtgtttatgtatattgtgactattggtagaagggcattaacctggttaaattttaattctgtatcaatggggggagaaagaactatatttgcatagacatataaactagttttcaatgattttccaatgttaacaaatatataggcaaaatctacaataaaggataaagctcacctttatagcaaatcctggagtattgatatctccaatatgctaagatttgctcgggatttaagatatctcagtctaacaaagaccagtaagtgggaagacagccaggtacattttatgcaactttgttccattatattatattatggactagttccagctgaaataattaggaagaaatacgcctaaaaaatgaacacacacctttggtttcaaatatggactaagattagctgattagctatcctggagtgatatgaacatattggcatataatacaaggaaaataaatattgtagaataaaaaaaatgccagaatagctaagtattaaaatattgagtgactacttccctgctacatgatttataaactgtagtttcataaattataaatggtgatgtcagaacaataaataaggaaactgcttttataaaaagttttcggaccaaaatatgtaataatacacagggtatatatatatgccaaaaactgctatgccaaaatccttctcattagtactatatgcttttccttttcagtgcaagaattgaaatattttttcctaatatttttattttgttaagcattgggcccctttatttcatatacattgctaatgtggaaatacttgttccagtgcattcgataacaatttaagtaatgccattatttttttcctgacttgagtgtgttagaaatataacctttgttggtgaattcctgaaggaaagttttcgtgtgttcactcaaaagtatgatttctcttgtacctataatgatgggaaagacactgtgagcacatgtatatactaacagtagattagaatgaggatgccttcataatagcacagtctaacagcaaaaatcaagatcttctatgcctgccttgttccagtaacagcttcatgaaaaaaaaatatttatcctttgctcagcattttgttgtaggaatattagctcagtgaacaagttgcaatgcatataattagagttgataagagagggtaactgcctcagaatagtctatggaaatgaaaaggattatattacagcaaagaaaggtacatgaggaagattctggtatctggatattgatagaaaagttagagatttataactaacatgccaggtttcctgtccagtagacctagtttcatctctgctccttctgctgtttgctttctgcctcccatgtggagcctgttagatgattacttaactttcagaaaaagtacccaaaatagagtattatacctaatccttacttaaaggaatatttattagaaagtaacatacaaagtgaatttttgtgaattacattgtatttttccattgacttatgttaacatttcagacatagtgtttgtgatttatttttaaatttcagtagcctctgacagtgcaaattttattgcctcccaaatttgtagacgtcagaagttactgattgggtaacagaaatttcttagattatagataatcacaatttaaaggaaatgttctgataaagtagttataaagggaaaataccccaataacactaataattacacactaatatgtttatttttaaattttattattatgttactttaactagagcataatctatttatgtaatgttcaatttttaaaccctctattaaattgacatacaagcagactcagtaaattatccaggatctctcaccaaaccaatcagcggtaatgtttaacgagtctattaactgaatttgtatattaaaagactcaatattggccaggtgtggtggctcatgcctgtaatcccaacactttaggaggttgaggcgggcagatcacttgaggttaggagttcgagaccagcctggccaacatggtgagaccccttctctactaaaaaatagaaaaattagctgggcgtggtggtgcatgcctgtaatctcagttactcaggagactgaggcaggagaattgattgagccagagagatggtggttgcagtgagccgagattgggccactgcccttcagcctgggcaagacagtgaatctgtctcaaaaatgaaaaagactcaacattgaaaatcttaacagtagttaaatctcattctcaatgaacatttttaatggtttctaaatttatgaacataaataacctgtggaaaaaataactgatgtgaacttcagtcctttttcaggggtctccaacccgcagggtcacagactggcaccagtccatggcctattagcaactgggccccacacagcaggaggtgagcagcgtgtgagtgagcattaccaccttagctccacctgctgtcagatcagcacaaaccctattctaaactgcacgtgcatgagaggggtctaatttgcctgctccttatgagaatctaatgcctgatgatctgaggtggaacagtttcatccccaaaccatccccctgccaacaccagtccatggaaaactggtcttccagaaaactagtccctgttgccagaaaggttggggaccattgttttattttactgagcatatatgtataatatattatatatattatagtaaaatgtatagattactgagcatattatacatattatagtaacatatatgtatgctcagtaatatatatattataattaattaaacagtatatcagcatacttaatctctaattccaacaccaatcagatatctttcttttaaaatttctttggtaaattctccacattcatttttccacaactgaaagttaaaattttctataaaaaaggtggggaatcaggggcctgggcaaggtggctcatgcctgtaatcacagcactttgggaggctgatccaagggaattgcttaagaccaggagtttgagaccagtctgggcaacatagcctgaccccatttctacaaaaatatttaaaaattagccaggcttggtggtgtgtgcttgtagacccacctacttgggaggctgaggtggtaggattgttggagactaggagttagacattatagtgaaccatgattgcaccactgcactccagcctggacaatagcatgaaactctgtctgtaaaaataaataaaattttgtaagcatatggataggtacaaaagatattatttttccttcttccacctgcttgtggaaaatttatcacagcattaactcattcattcatttggttcaaaaatttttggtccattataaaaatatgacaagcaaataattattaatatattcaatgtgtagaatgaaaaaatatattttaattattaaatgtactaagtatgtgaagaggcaatttacccaaaaatgcaaatatccaatagctttgaaaaaaattcaatctcactaattttcaaagaaattaaaataaaattagggtgaaataatttttcgaacatcaaattaagaaatgtttttaaataagagataacctagtgattttgaaagaacaatgaaatgggtatttatgtacactgccactgaaaatgaaaatttgttcttctttgaaaagcaacttggaaatatctgtgtgaagcaatgataatttctttccttctattaaatgatcaccatcctcaatagacatgcactgtgagaaatactcgaatagttattcaacagcattagacataacaatagcgtttaatcaccacaaataacattccttgaaggtaggtctatcacattttgcagatagaaaattgaggctacgaggagtaaataaaactgctcaaaaccatgaagatggcaaatagggggtatataatttgaaaatagagttgtctgaggccaaacctggttgatttgatttattagactattacctgtgggggaattataaataaagtaaaagcagcatgatttctaattttccataacaatattgccaaatttctttcttttattttttttttctggatttagggatacaagtggagttgtgttacatggatgtattgtgtaatggtaaaatctgaacttcacacaaatagtgtacattgtaccaaataagtagtatttttcccctcatgccacccaaccacccacccacctaccttttgaagtcgccagtgtctattattacactctgtatgtccatgtgtatgcattatttactcccacttataagtgagaacaggtggtttttgactttctgcttctgagtcatttcactaaggataattgcttccagttccacccatgttgctgcaaaagagacaattttattctttttatggctgagtagtattctatgatgtatgtatgtgtgtatatacccatacaaatatctaatctattacctaatgtatacacacacatacatacactatagaatactactgaataaatgtgaaaatgtgacgtgtgtatatatatgtgtgtgtatatgtaaaatatatatatacacatatacacaatatatattttacatatatatatatatataatcacattttaaaattcagtcaacagttgatagatgcttcatacctacagccaactgatctttgacaaagtgaaaaaatatacactggagaaagacaccctattcaataaatggtgctgggaaaattggataaccatatacagaaaaatgaacatggacccctctctctcaccatatacaaacatcatctcaagttggattaaaaaactagatgtaagacctgaaactataaaaattctagaagaaaacctaggaaaaacttttctgggcattggtctagacaaataatttatggctaaaccctcaaaagaaaatgcaacaaaaacaaatgggacttaattaaactaaaaagcttctgcacagcaaaagaaataatcatcagaataaacagacaacctaaagaatgggagaaaatatttgcaaacaatgcaaatgtgtttctaaaggctttgttctgcatgctttgagggaatgtagctttggctgttagccttaattttaaaatagtaggatagcagccaaactatggtgattatagaatgagtttcaggaagattaagtttatataccaatccctgcacaaacatttctataaaactcaatttcatgtgttacacaatgtattagtctgatctcatgctgctataaagatctttccaagactgggcaatttataaagcaaagaggtttaattgattcacacagttcagtacggctggggaagcctcaggaaacttacaatcatggtgaaagggaaagcaaacatgtacttcttcacatggcagcaggaaggagaagtgcagagtaaagagaattaaagccccttataaaaccatcagatctcatgataactcacttactgtcacaagaaaagcatgggggaaccaaccttatgacctaatcacgaggtccctcctccaacacttgacgattacaattcgggttataattcaagatgaaattttggatgaggacacagccaaaccataccacacagcaatctatatctatatatatctcttgaatgactgctagaatgactttctagaatttatatttattgaaaaattataaatcaaaaattgcatttgttatatgcattggtaatgacaaaaataagccaaatgtttaaataatatacttaattatctatgggagagaaaaatactccaaagtggaattttaaaagtattcgatagttactttttgggaaataatattattcaaacagatacttaaaaactattttagatgatttaggccaggtccggtggctcacacctgtaatcccagcactttgggaggccgaggtgggtggatcatttgaggtcaggagttcaagaccagccatggacaacacggtgaaacttcatctctactaaaaatacaaaactcagcccaggcagtagtggtgcgcacctgtaatccagctattcaggagactgatgcaggagaattgcttgagcctgggaggcgaaggttgcagtgagccaagatcacagcattgcactcccatctgggtaacagagtgaggccttgtctcaaaatatatatatatattttatattatataaaattatatataaatatattttacatgattttgttataacagtcccagaaatatttttagttaataatattgtacatgtctattcaattctttcagagatggggaataactggatggcttaagtactatatatctgcttattattacaggtcttaccttaaagattgcaaagatagtttaaaatgtagaattaacaaatgttaggaagccacattcatgatacctatgcactgtattattttgatactggtaataagtattattagaatgattttttaaattttcttcaagaatatcaacaataattaaaagataaatgtagcattagagaaaataataaaatgaaacaaaatttccctagatgcatgtaaagtaagtattcttctggtttttggcttgatacttttaagatataactgtctcaccttgaattatgaaccaaaagactgtatatattgcacaagtctgtcatggaaataatacttttattgttgctcatataatttagcaaggtcatgggtggggtttgggacagtaaaaaaaatttcttgtatgttcctgataatattatagactgaactatatttaatgcagtgctttaaaatacttaactgtcctgtcaaagtaaaaataagcacagataatgtgatctgaaattgatcatattttaacttgtctatggtgatgaaaattaacttataagatttatgatcttttcctctgctaaagtacaaaacagtttctctgaatttcttttgtcatttttctcattttctgtcctgaatcataattttagatatatatatgtatatctatatgtatatccacacacacaaacacacacacacgtatataaaatgagcactcattataaactcattgagagtgtgatatctgtctgattaatatttgcattgtctgcagaacaaagattgaacattgtacttaaacagagacttaaatctttgtctaatggatgattgagtgaatatatcatctccaccttctgtttatgtccattgtgttagttgttgacaccaaaaaccatggcaaatttgatacgcactttgggttcattctgcatcgaaatcaacttcaacatattaatagtggaaaattaaagattaattaaagttgtaagcaaatgcacaattgggttcatttgagggttcttggaatgaggaagctttgaaagaaaagaagaatttatatttgtgttacatggttcaaagagaataaatgttctcgaatggtcacagattgctggaagctctgtagacaaatatatttgccgaccaaactcagattctagacaatgtcattgccataaatagaaaaataatttatttaattatagaatgaaaagtgtgtattaccaggatgtatgaaaacactaccccaacactgtggtcaaatgtgataactttatgttagaattttttttaggaataactattggacactttgaaaattaataatagctttaatgtcttttttttttcaatcagatttgtcacataactaccgtggcgtacacgtaaaataacaattgtccaaagttagtatttattgttgacaggtatttatcatcctggtggtattcttggggagaaaaaaagataattatttcttaatcatggctgtatatctgggataccagttcagcttaaaaaagcaaaaacaaaacaactacaccttctcaggcctccattttgatcttcatggtttttattatgagttctgcatactttggctaaggagtaagtcttctgcttaagcagagattctgggagataaagtactatctagtctttccttcgtataggcattcttaatctttattgttgatatcttggtgcctctttcatatggcttcaaataggataaagttcaacacgccccttattctcatagaggaaaggaaatctttaaaatgtttgtggttttacggcaaaatctgtactcctaagaccttcagagaaactctcaggaggtgttggtttattggtgttcagtggttttagggccagttgtgctcttcttaatcgattctgtagaaggcatttggtcacagcttgagggtctcacacattgctttaggatgtagacttattaatgaatttcatgtttagctataagccttagtgataattttaggataacaaaaaaaattctgcttaacattttgttataattatttcctaaaaatccatttgtccttggcatgtgattagatttgtttatctatctaatcctctatctgtttgtctacccactgtccgagtatcaaaggccaattcttccagttcttcaacagacaaaaaagaggactttcgacagcaatcttgtcacaggttctgtgaaatgttgttccctcttattgcatatacacagctcatcactgaaagagatacctacgccaggcctagccaactgattcccgtaagaaggttaattcattctactggaggatcagggaatcatacaacccttggaggggattcttcagagttccctgtaactagatgacatttcacttattacagctgatataatattttttattatcacttatgtttttagattttcaaagtttcttcctttgtaaattcttacatcatattcctgttctcttaaaattctacaatttaacacctttaatgttacttctattatagctttttagcacctccttttatgctcgccaatatgtatacgattgtgaaagtaaaacttggcaattactgagttaatgtgatgtgtgtagaggagacagactacaccacctgatttgatttcaaaatgaatcttcatttagtcctcaaagagttattaaatgatgctgttagtcactagttattgaacagcggcttattttcttgaaatgtattcagaataagattcttttctcaaatatttcatttaattaggttctttgatagtatttgctttaaataaaatgttttcaaattactgaaagtgatttctctatatatgcatactagtgctggggtagtcagtagagttcaacttttctgcaagtaagaaagtgattttgaataaataacagtaacaagcacagaaaactagaatgcaaaaatactttatatgagctaaccccaagagttggaatctttacacagtttattagcaaaaaggctgactaatctcactattgtaggcattcacttggggaataaattttattctactgctgacacactatatctcattaaggcagcaatcactgtctcaattttgttgttcaaattcaaagtaggtgcatatagtcattctttattctttgttagaatcctgtagaaaacaggcttcccacaaaagtatatatgagtatgaagactaccaagtaacttctgatcttgagagtaaccttgttttcagaaagtgattcactagtatgcaaaggaatgctgatgattagtttgagctatgtaaggaaaagaaactcatggggaaaaagtgaactgaagatatattgaaatgtaataaactgtgaagagaaccaagtgctacccagctctttcattgagtacttgcatgacattggcagcattccatttgctgccttgattttccctttataagatggtgatggcaacagttctgaatgcttagagtttctatcagataaatagcattttaaaaaccttgaacaatttaaaattttatcatgcaaattttatatagtccatttactgtttggattatcagtgccatttgcttcttttcttttgactacctggtttatgcatttcacagaccactatgatctcccccaaataaatggggagcagaaagtaaaacgggccaccaaaaaaaggtagcatgtaggaaatatcttgtttattcctgtcagttagtttaattagctgtcaatttttgagtacgatgttcagggataaaacataaactaaaaagcctatttcatttagtaataaatgagtgccacgaaaaagttatcataaattcagtatacaaccataacttaatgaatttcatttataaatttggagagaaaaacatttaaaatgtgtttgagagtgctagttgtgattaagatttcagttcaaatttttttttgtgtcagagaagcactaatttctctttatccatttatatgtttattaaatcttgtcagtcctcaaaattattatagactaacaaggaacttaaattgtccacatcttttttttagaaaaacctacatcatcataaataccaggactgatatgcataactgagagagccctcagaatggtatacaagaagattaattttttaattatgttgtttaattttaattatgttgattagttttttaattatgttgttttgcaaattatcagatcataactttgtcttacctgttatatgaggaacacttcctcttatctaagaggaaaactatagtaatttgtctgtttctcctggttatgacaaacatgtttcccatagcacatttttctttacttttctagtgaacctctgttgtgcagagtgttatgaattatcatccttgattccttgatttattacatactctcaatagttccatacatggcctgcttttatttgtttattgtttactaacttttggatttacttataaatctctaataaacaatcaataatgacagttaaaatgaaaactaagatcttatttgcatttatgaggtgtttcttcatccattccttgcttatgctcatttttcatttgctcttttttatacagttttaattcatcaacatatatcccttaaaatctattatgctaatcattgttaactttataaaagaagtggcattcatttctatgatacattgttaagactaaatcagtcacaaagcacacaaagtagtagaaatataggaggtgggatgtcaaagagtataataatttccctgaatctggtgcatgaacaaaatgcacagaccatttgcttccttgggaaaggtagctagtcagcttatgtctcttgctttgcaaaaactggttttgtaaagagattttacttactatagtttggatatttatgaagttctattcgttctctagcctaagtacatcatcttagtttgaaatctcatatgtcgactcatacatctgacaataccccttatagggtgacctactcgattcaataaaatattcatttaaacttaaaatgcccaatgatctaaccagggtcgaaaacaagtgacttggagcattgagataacccagagagccccagggctgtgtagcattaaatagttcctacaagacagcctgcattcaaaaaaccattcctaacccaccaataattttattttcctactgctgcaatgcttcataggcaagaaaattctggtatgatacataaaaataaatgataatttaaaatctaaatcatttcccaaaaagccacataaatatagacttgttataatggacattttgggggttattgccaagactaagaaaaggaataattcttggaaaatctaaaaagaaaagttaattttcaataaattaagatttattaaacaacaaggaggtattatgcattatctatgtatgctactgcttccaaatttagaaataagcaaccaataaacttaaaagttaacattaagagatgtcaggctcaaataattacctgatattcttttccattcttccattctgtaaagaagtcatttagatgacataataataaagccaaagtgctaggaatattgaatattaataattatgactattcagtgaagttagtgataatgaaagttttcattttctgtgagtcttctctgtgccatagtctttcactttatttcattcaactcatacaactctgttgcttatggtttataatttttattttacaaataaggtgtagaaatatttggtaagctgcccaaggtgtgagttttattaatgtatgactcatattccttattgtggaaagatactaaatcttctttaaatcagatccagatggattctagttttttatctgattgaatgtggtctataaactctccattgggattatccacagtaatgttgatacagctgaacatacatcaggaagatatgaataaagcagtgtttcataaaatacctatgtcccttgttttgaacgggtcctgtgatactgcttgtttactcaaggtttggctaaggaaaagtgattgcaatgaaattaggaatcattcaaaatgagcagttatttttcatagctaagggaagagatttttgtgtttctgatactgtgaattgataataaatgcataaactatctgaaacttatttatacataagaatgataaaggaaaacaacccacagtattaatttgctgtccccttgtgtattagtcttttttcacgctgctgctaaagacatatctgagactggacaatgtacaaaataaagaggtttaattggatttacagttccacatggctgaggaagcctcacaatcatggcagaaggcaagggggagcaagttatgtcttacatggatggcagcaagcaaaggaagaaagcttgtgaagagaaattcccatttttaaaaccattagatctcgtgaggcccattcgctattatgagaacagcatgggaaagacctgccccgatgattcagtctcccaccgggtcccttccacatgtgggatttatgggagctgtatgatgagacttgggtggagacatagagccaaaccatataattctgcccctggccaccccccaaatctcatatctttacatttcaaaaccaatcatgccttccccacagtcccctaaagtctcagctcatttcagcattaactcaaaagtccagagtccaaagtcttatccaagagaagacaagtcccttccacctatgaccctgtaaaatcaaaagcaagttagttacttcctagatacgatggaggtacaggcattgggtaaatacagtgatgccaaatgggagaaatttgccaatacaaaggagctacaggccccatgcaattctgaaatccagcagggcagtctaatctaaagttgcaaaatgatctcctttgcttccatgtctcacatccaggtcatgctgatgcaagaggtggattcccatagtcttggtcagctctgcccctgtggctttgcagggtatagcctccctcctggctgctttcacagaccgccattgagtgtctgcagcttttccaggcgcatgatgcaggctgtccgtggatctaccattctggggtctggaggacagtggcactcttctcacagctgcactaggcagtgcctcactagggactctgtgtgggggctccaactttacatttcccttccacactgccctagcagaggttctccatgagagccctccctgcccctgcagcaaacttctgcctggacatccagggattttcatacatcttctgaaatctaggcagagatttccaaacccaaatttttgacttctgtgtcctggcaggctcaacactaagtgggagctgccaaggcttaaggcttgcatcctttaagccatggcccaagctctgcattgtcccctttcagccgcagctggaacagctgggacacagggcaccaagtccctaggttgcacacagggaccctgagcccagcccaagaaaccacttttcctcttaggcctctgagcctgtgatgggaggggctgctgtgaagacctgtgacatgccctggagacatttcctccattgtcttggggattaacatttggctcctccttacttatgcaaatttctgcagctggttcgaatttctcctcagaaaatgggattttctttcctattgcattgttaggctgcaaaatttccaaacttttgtgctctgcttcccttataaaactgaatgtctttaacagtagtcaagttacctcttaactgcttcagtgcttagaaattccttctaccatatgccctaaatcactctctcaagttcaaagttccacagatttctagggtggggcaaaatgcaaccagtctcttttgctaaaacataacaagagtcacctttgctctagttcccaacaagtttctcatctccatctgagaccacctcatcctggaccttattgttcatatcactatcagcattattctcaaagccattcaacaagtctctgggaagttccaaactttagcacattttcctgtcttctgagccctccaaactgtttcaacctctgcttgttacccagttccaaagtcattttcacatttttggatgtcttttcagcagcgccccactctactggcaccaatttactgtattagtctgttttcatgctgctgataaagacatacctgaggccgagcaatttgcaaaaataaaaaataataagaggcttaattggactgacagttccacatggctggggaggcctcacaatcattatggaaggcaaggaggagcaagtcacatcctacatggatggtggcaggcaaagaaagagaacttatgcagagaaactcctgtttttaaaaccatcagctctcgtgagagccattcactattaggagaacagcatgggaaagacctgcccctacgatttagccatctcccacggggtccctcccacaacatctgggaagtataggagctacaagatgagatttaggtggggacagagatgcaaaccatatcactgtgtgaaatttgaatagctgttttggactgtagaaatctccatgaattttgcaccaagcaggagagcaaaattaaccgatgatattgaatccattagcaattttaagaaaatcttcagttagtgaatcctccctaacattaacaaacatctctgcacttctgatgaatctttcccctgcttttaaagcactaatttagcaattattcatttcaattataccattgtcatcaagggctgctctattggatggacttgactttattttgcaaccttgtaaaatatccctctatatttgtatgaaaactgaagaccaaatgtatttcacatctagttgtgtccgtggaagtaattcctacatatatatgtgtttttttaattcctggcttataatttttatatcataattctgatatggctttatagtataaagctaaaactttgtaaaaaatagctatctcaaaaaatatcaaaaagtgataaatctgtgaaggaaatagaaatatgcatgtagccatatacctactattaattttgaggtttctccaacttatttacccttgaatatgttttactaaattaattagacaaaacttatttttaaaactatgaaaatgaggatgaaacagtttctgattagagaaaatttgtatctcaagagttttgacaccacaggtactttttaccaatactgggtagacaaaagtaaaaattgctgaggagtgggaatactccagcacttcttgggggctagaatatgtcctcagctcttgtctttataatatcatgctgtttagaaaatggagactcaataactactacaagatgaaaatagatgccaaccactcactgcctgctgagatttgccagtgtgagtggaaagtagagaggagtacttgtgggaaaatgaggtaaatatgaatatgttaacagatggaaagccactgttattttgacttctgtgatgtactcatgagctttcagctttgtctgtcaccatctgtacttctctttacatacatggtggaccttgatgctgtgtgagacaggatttagagcagttttctgttgcaactgttggaaatgtaaggtctcagataaataattagagtgagtcttaaaattgaagcctctcaaagttgaaagtcagctttgaacatgagaatgacgggacaggacgaacgaaaagaaataaaaaaggcaagtctagtgatcatgattatgatgattgtttgtgtctctttgaatgaagcaggctcttgctcatcaaagtttctgattgaaagcttgacaaaggcagggaagttagtggaaatggaagaggaagaacaatatggaatatctgaaatatatgatcacttaaagtaaaagtaatgtagaatagcagtaagtacaagttaccaattttaaacaatagatattaaatgttttggaattgtggaaaagaaaagatagggtcaataaagatactccaactgatgtttctgagtgtcatgatctaaaaaaatataaatgaaaaactttttttaaaaaagattacttattttttaaaacttgaaagtatgtcataaaatgtcagttcagtaaaatgttttcactgtggtattttaaacttgaacaggaaaaataagtgcattagaagggcatggtatggggatgtagaaacaaaaaattcaaaacgtctctttccttccttttctctttttttttttttcattactccaccatccgatccttcagaaaatcttcttgcctatatttttagaatatatctagaatctgacctccagaatacatctagaatttttatcacctctgctagtgacatcttggtacaagccaaatctcctaataagtctctctgatcttaccttacttactataacttatcaacataggagttagaatgataattagaaggtggtcaataatattgagtgaataaatgaatgaatgaagaaggaagagagaggtttcatgtctttgacacaggtttccttgtagtataatctagaaatttagattcaattcaattttgtaaaataaacattagattttaaaattagatacatctgcatttttcagagtcagaatgaactctagtccattgctctctgtgctgaatgaggcagctgaagcccggtgaaagacagaggttatgtgttctatgtcatagttttacttagacctggaactaatttccgtttggtgtttcctccagtatgaagataaaaactgttgagaagaaattgaatgatgtccagagtcatgcaaaatgctgctttttgaatggccctgtagcagaaactttgtaattaattctttgcaaccttttttatattagggaaacttccctccattcctcttttcctaaatttctatcatcctgggaccatataattttctcccacacctgggagcctaagaatcaagagctaaagcctccttatttgttttcttttcacctggaaattacaatgtctttaagaacgaactgtggagctacatttcactcactgttgtcaacccatgataaattctaactggaaaatctagcttcaaacttcagactgctgattatttacaatatcttactaaaatgtcaaataagacttctatatcacggtgcctgtgtacctgtaacattactgaattgggggtaacaatatcctcctgtttttaactgtttctttacttctgaccacttaaatagtaactcaaatataggacactttggatagttgggattttttatttttcagaaataatctgtggtgcttctagtgaaaactgcatttttttgtagcattttaattttcaccaatggagaaataaggctgatacggtatttttcctgccaaatttccaagtcaaatataaatcatttctggcccataaatgtttttgtctttgaatgcctcctacctaggatggagaaactaagcaaaacatcatttctcgtatgtgacttaatttagtggatcataaaaagtccttgagccatttggtcactgataagtgattgtatgactatggtataatttgattacttttgtctgtaggcaaagattggatatttttgaagcagagctactttaaatctgtatcaagacacagagaaacattacattagcagttcaggatattagtgtctataagaactcattcctcttcgctattaatatgttgaacaaaataccttgcatctataaaacttattttccatcacgagcagaccatatcatttgcaaatttcatttcccgtaaaccggtgtatcatgtaaatgttgtcaaacaaaactctgatagtctactcagttagatgttggtttaaaagtttctaagttgaaattatttttttcctctctggaaatagtactgattctttgccaagtcagatttcctcctacgcttatcactttatatgtggaaaatggagtaaaagagtaggaggaataaggctagtatcttttcttagcatcacaataacttaggcaagaactggatctggttaactcgtatttgctgtggcaatgtcattatttatgtactgtttagcgatattacttgttcttaagtgttagcctgttcttatataaagacataatttctcagggttttttgccccttctttatccatttctactctcgtacaagatgaagattaccattataatagcaaggtaattattactatcagaacaattctccagggtgcttctccctatcagtgtaaaaatgaatcatataatcattctataatttgagaatttttacaatagcacgttgtcctattacagaagaatttacaatatctcattcttcatagagattcatattatagcacaccacaaaaatattttgctgaatcttcaatgctaggtttcagaagccactagaggtatttaaggaccacttctggtggactaagtttattctttcttcttctgtgaacaataattagaaaatgaagtgcatcttcatcacttttgaaaaaaaaggcaaaaatgcaagaaaatagtatttttaaaaataatattaatgtctagtaaacaatatgttgtattttaataggaaaaaatatggaattattgatatttgttgcttgaaatcttaattcttgtaattatttttgccaagtcataaaagcaattgggaactaaatgttattgctattggtgaaaattgctttattgtagataaatcgttaagtattacttttatagtattattgctgcttaggcttagaagacatgctaggaacaatttccttggcatattaaaatagtcatccaatgcttatgtaaaataccactagaaactattttaacattatgcagttcttggcttaactgtaagctaagaatttgtaaaccttgatatgtttagttcttctctctgaaaatgtttgattttgtgtgattatgaattaattttacacatgccaaagtttgagctatacattagaagtttttaaataaatattaaggaaaaacttaggtgtgaaataatttctaaataatcgaaacattgatttttttgtaaaggaaccacattatttatgatatttgtgcccagtttagcatatgaaatttgaaagggatgaacctggaggaagagagaatagaaaggatattattgcataacctttggaaggtaagatgtgaacctatacagtggcaaggaaagtagaaatggaacagacatgattgacttaagaggtattgtaggaactggaagcggtaaattgttggtgtaaatataactgaggttttgtgtggttagctgggaaggtgatgccatcactaagggaatgaatataggagatgttataaataattagtatctggaaaagcttgttttttttttccttactcatcagatattgaatgattaccaatggttatttagaaaaacatttcaccaaaagtaatcaataaatgtgtaggtcactaagtgcctctatgaaatatccctgtaatgaaggttagatgccaagaagaagcaggagatccttcattagattgcacagtttacacctttgggtttatggactatagcattaaaagtatgtaagtagtcttcactgtaagtccttggttttgaagtgatttaagccttctttgaaaattaagcaattatgttcagactgaatattattatttaaatcatcatcatttcaccctgcatctcaaaagggaagatgttatctatttcaaattatttctgactttatatcaggatttagtaaggttagatgccaagaggaggcaagagatccttcattagattgcacactttgcacctttgggtttatggacaatagcattaaaagtatgtaagtagtcttcactgtaagtccttgcttttgaagtgatttaggccttattcaaaaattaagcagttatgttcagattgaatattattatttaaatcatcatcatttcaccctacatctcaaaagacaagatgttatctatttcaaattatttctgactttatatcatgatttagtaattattatatgcaaatcaccttgcaaattaagtttgagaaaaaatttaacatgtttataagattgttaccacaaagagtctgctactgttactctcggaactaattgttttaaaataagcattgtggatattttcttttgatggaactattgcaaaatctgacttgcccacgaaaagcccaaagtgaggctcctcataaactacttatcatttcaaaggcttcaagatgtcaaaagatttctaattcttcaaagccatgtctttcactcatctatttagcgtgatctgtcatccattggtcaaacattctccacttaatctctaactcacaggagatttttctcaatgtgttttccctcatcagagaagggtcactaggagagatactgctcttgtatattaaaacatatataaaataatgtttgcaaccaggtgcagtggctcatgtccgtagtccaagcactttgggaggctgaggtgggtggatcgcttgagcccaggagtttgagaccagcctgggcaacatggtgaaaccccatctctgcaaaaaaatacaaaaattagccagtcatggtatcgggcacctgtagtcccagctctcaggaggctgaggtgggaggatcacttgagccaggaggtgaaggctgcggtgacctgtgatagcgccatagcactccagcctgggtgacagagagagatcctgtctctaaataataataatattttcaaatacaattgaatttttaataaaaatatcatggaatacaacatttgatattgaataaccttttgttttggccatcaatgtgttcttttagaatacatgcaatatgtctgcatgttaaaaatatgtctccttcaagtaacacaagaaagctctgcactgaagtttggctaataaatcatattgaagactaaatttctactagtcaactgaaactttttaaggttaaacttttattttctttagaaaaagtatgtaaggttgagttttgcctttggcattgtgaactagaatacaagaagtcttgtccattttaagaacaaaaataatatgttccagcagcactgagtctatttttaagtaccttaaaagcagcaagatacggtgggaagggcagtagtctgggaataagaaggtctgaactgagttcttttactaattagctgttttggcatggacaggtgccttaaccttcagggacaaagttttctcctctataaaagaaagaggtttgcttgatgatctgacagggttcttgacacatgtaagtgggaatctctctgggatgtcacagttttttttctcgattaaagctaggcaatatccttctcacatatttattctattagaatttctctcttatgaatgaatgaatatcattcttatatctcagacagagggttagcacaaagaaactgaaattgtcatgctggagggcctttggtcaaatattacatataatttggcattcaggaataacttaagtccaagatagaaatcaaagttgagaaccagtaattacttaaatcaggtaaagacaaaagcttcataaagcaaaaatcagagttagattcataaatgaaaacgtgggtaaggacttggcaaaatcagaagaatcagcgtatggactctggttgagacattaatgaagtgggagcttgctttccatatcgtgcattcagtcttccttccatttcacaatgaattactttctacttgacactactttaggttccaaagatattaaaattgaaatacatgttttctaacatcttgaatcttaaagctcttacaaataaaatgactaaaaactgaaaaaaaatgtatttattgaatactgattgaatatcaatccttgtctcaagcactttacatgaattatttcatttaatataataattttgaaatgtggatgttatttttatttatttattttgagacagatgctcactctgtcacccaggctggagtgcaatggcacgatctcggctcactgcaaccttcacctcctgggttcaagtgattctcctgcctcaacctccccagtagctgggattacaggcgtgcgccaccacgctcggcaaatttttgcagttttagtagagacggggtttcaccatgttggtcaggctgatctcgaactcctgacctccggtgatacacccgcctcggcctcccaaagtgctgggattacaggcatgagccaccacgcccagtgaaatatagatgttattattagatgaaaacattgaatattaaagagatttagaagatcgttgatgtcagaactggctttcagtgctagatttgactgtgtacaaaagtcatgtttttatattttcaattatattttctctattacatacccatacacgtatgtccatatttgttactgaaaatttataaaacatgaattagggaaaataagactaatttaaatatatataatctcatgctaaatgataaactctgtgtccctcagattttttctaggcacaaatttatataaaatgtatccataaaaaaaaagtttcactgtgtttgttttctattttttttcttcactcaggaatatatttataggccagtaaatacttttgagatcaaattcaatgacatcatatgatatttgattaacaaatatattcatttccttaacaaatttcttatcagtaagcacttattttgtctcaatctttattttacaaaaaaaaacctaagttgtttacgtgtgtctctaaaacttatttaacattattttattgtttaggatattctagattaaatttataaacatttatgagagttttgttaagttttgttgaattgtgcactcgaatatttttgacattttatactcctagcaagtgtgactgcccttttcttcatgtccaacactagatttcacatatatgtgcatattgttatacttttgataatttggcaagttgtttatattcatggatctttgcctaatactcagcttgaacatttttatatatgctttttagctattaaaatttgttaaattgattttaaattgattttttttactttaagtttattcttttattttatttttattcttaaacttttaagttccagggtacatgtgcaggatgcacaggtttgttgcataggtgaaaacgtatgtcatggctgtttgctgcacaaacatgtcaaacatgacaaacatgatatatgatcaacccatcacctaggtattaagtccagcatgccttttctgttctttctgatgctccccgatccctgacaggccccagtgtgttttgttccctctactactgtgttcatgtgttctcatagttcagctcccccttataagtgagaacatgcagtgtttgattttctgttcctgcattagtttgctgagggtaatggcttcgagctccatctatgtccctgaaaggatataatctcattcctttttatggctgcatagtattacatggtgtctgtgtaccacattttctttatccagtctatcattgatgggcttttgcgttgattccatgtctttttattgtcagtaatgcttcaatgaacatacacgtgcatgtatccttataatagaatgatttatattctttcgggtatatagccagtaatgagattgctgggtcaaatgatatttctgctgtctgcatctctgaggaattgccacactgtcttctgtaatggttgaactaatttatattcccaccaacagtgttaaaagtgttcctttttctccacaacctcgccagtatctgttgtttcttgactttttaataattgccattctaactggcacaagatggtatctcattgtggtactgatttgcatttctctaatgatgagtgaagttgaccttcaatatgtttcttggccacatgaatatcttcttttaagaagtgtctgtgcatgtcctttgctcactttttaacggggttgttttttctttaaatttgtttatgttccttatagactctggatattaaacctttgtcagatagatagattgcaaaaattttctcccattctgtaggtcatctgtttactctgttgatagtttctttttgatgtgcaggaactctttagtttaattagcccccatttgtcaatttttgcttttgttgcaatagcttttggcattttcgtcatgaaatcttcacccacgcctaagtactgatggtattgcctagattttcttctagagtttctatagttttgcgttttacatttaagtctttaatctatttgagttaatttttgtataaggtataaggaaggggtccagtttcaattttctgcatatggctagccagttcccagcaccatatattaagtagggaatcctttccccattgcttgtttttgtcagggttgtcggagatcagatagttgtaggtatgtggtcttatttctgagtactctattctgttccattggtccatgggtctgtttttggaccagtaccgtgacgttttggttactgtagcattgtagtatagttcaaagtgaggtagcatgatgcctccagctttgttctttttgcttaggattgtcttggctatacaggctcatttttggttccatatatattttaaattagctttttttttctaattctgggaagaatgtcagtggtagtttaatgggaatagcattgaatctataaattgctttgggaaatatggccattttcatgatattgattcttcctatccatgaacatggaatgtttttccatttgcttgtgtcctctctgatttccttgagaagtggtttgagttcttcttgaagatgtccttcagttcccatgttagctgtattcctaggtattttattctctttgtatcagtttagaattggagtttatttatgatttggctctcatcttgccttttattggtgtataggaatgctagtgatttttgcacattgtcttttgtatcctgagagtttgctgaagttgtttatcagcttaagaagcttttaggctgagacagtcgggttttctagatataggatcgtgtcatctgcaaacaaatataatttgacttcctctcttcctatttgaataccctttatttatttctcttggctaactgccctggccagaacttccagtactatgttgaataggagtggtgagagagggcatacttgtcttgtgcaagttttcaaggggaaggcttccaacttttacccattcagtatgatattggttatggtttgtcatatatgtcatacatggctcttaatattttgagttatgttctttcaatatctagtttattgagagtttttaacatgaagggatattgaattttattgaaggccttttctgtgtctattgagataattatgtgttttttgtctttagttctgtttatatgataatcttattctttttttattggagtattcattttgggaattttctttgtaagcctttttacatatcataatattaatcttttcactctttattttgcagtccccgtcttttgcttttcaattttcttcatagtgttttttacatttaaaagaggttaatattaatttattgaagtttattggtgcttctcttttttacttctgcctttgtttttaaaaaatttcattttaaaacacgaaaagccttgctctctcaaaaattgctttagagtacaatatattctcttaggcactgctaaggctatgataaatccaagttgtttattagtattgttatagtttatgtaataagtgagagttgttacatccatggcatatttttggaacctgtcatactctgtgacttggagggagacccctagctctaactactcaaaatgagtggaattagaaccacagagcagggctgccaatggactgagccagtggggtctgtgcccctgtgacctcacacttgctctgattggtgactcttcctattgtagctgcttcttcatatccttctatttatcctcataaactcatggcacaccttgcgcccaggtgtcctctattataaataacctggatcatgcaggtttttcctcccattgggcattcatgtgcttctactcgcatttccccaaatcaacctcctgggttctaaccctcagttatacaactgtagaattgtctttttaattggttggagaatactatcaacaagaagtaacatttttgagttttttaaaaaaaagccagacactcctgtaatcacccttcatgtataaactcattaagtcatacaaccattccatgaagtaggcatcattataattttctccattcaacagctgaggaattggaggctcgggcttttaaagttatccagctggtaaaagaaggagccctctccacagcttcttgcattaaacatcttcaccccttccctctatgcttcatgatagtcaagttcccccaccttattttcttctttctttgttgccaccatgtctaggacatggctggctaatatactaaatccactccaaccatttcattctaacctccactggcattaactaaacctacattaccttgtcgtggaagcagacaaggtctgcttgtggtcccacgagacagtggcctcataagattagaatacagtattttagtataccttttctttgtttagatatgttcagatacactaatgccattgtgttataattgcctgaagtattcagtacagtaacttgctgcacagatttgtagcctagacgtgataggctatgccatataacctaggtgtgcagtaggccagaccatctaggtttgtgtaagtatagtccatgatgtttgcacaatgacagaattgcctagtgatgcatttctcagaatgtgtccctgtcattaatcaacacatgactgtatatactatgaatatgaccatttattttatagctaaaatatgtatataggagtaactcaaaatgcaataactaataatgaattaattgtgctggggtagtggattgcgtatactttttctccctttttctggattatcattagttttgttatgttactcttacaattaaaaggaagaaaaagaatcacatagttcacattattgttttctatttatttcctgttccccactgtattacattgccttgaatgaaaagcattttatccagtattccctgaaaatataataacaccataaacattctatttgtacaagcctggtcttgtaacaagcttaaagttatttggaaagtgatataaacgatttttcagctattaacttccaatttagttaattattattattatataaaattggaactcttaaagaacacaagaattattttgctttccaagctttccatgtttttttgctttcatagagttttttactaaattaattcccaatgagtaaatatgccactaagaggattgaggcaatgttgaaatttagaattatttgcacactaaccaaataacaacatctattatcagttattttatttgaattgagtaaatccatgtaagcaaaactagatgtttttaaattaaaaatagaaagcattttgccagagaagactagttctaaaaatgggggaaaatgctgtcatgatataattgttccttgaataaataaacattttcctaaaattgtatttcttagattggttcatataatgatttttcttccacgttttgatttacttgattttaaaacatgtgtaactagtttaatctagagtagaaataaagtgctgttttttaaatgtcaagacaattttacaactttctcactgctaagtgatttagcatagactgtgcaaaaatggtaaggtgacaacatccagagtctgtcagtgaaaaaaaaaaaactccattaataccattaatcacaagaacagaagaatgctcatgaatatctccccctcatctttaatttttattctaacagccatctaccacgtacctggcaagatacaaaagaaaaaaaacagacacacttattccttgcactatcaactcacaatatttgaggacactaaaacagtggtgagtataatttacaacctcacctccaataccaccccaagtagagaagtccataatcttcccatatttctgcccattgccaccaaccttcagataacacttataagtgaatccactgtttctggtaaatcataatatgtaaattcactccctgataatttcctataaactttaagggaaaaatagtctcattactaagtataaaatcagcatcacttccgtgctttcattaattgatgacaatttggccactggaaatagctactcctgggataatttttcattcttaattttgacagaaatggtgggtaatcctttaatggaagtcccattaaacctatcccacagggattgtaaattagttcaaccattgtggaagacagtgtggctattcctcaaggatctagaactagaaataccattctacccagcaatcccactactgggcatatatccaaaggattataaatcattctacgataaagacacatgcacacatatgtttattgtggcactattcacaatagcaaagacttggaaccaacccaaatgtccatcaatgatagactggattaagaaaatgtggcacatatacaccatggaatactatgcagccataaaaaaggatgagttcatgccctttgcagggacatgtatgaagctagcaaccatcattctcagcaaactgtcacaagatcagaaaaccaaacaccgcatgttcgcacctataagtgagagttgaacaatgagaacacatggacataaggaagggaacatcacacagtggggcctctcatggggtgggggggctgggggaaggatagtattagagaaatacctaatgtagctgacaggttggtgggtgcagcgaaccgccgtggcacgtgtatacctatgtaacaaaactgcacgttctgcacttgtaacccagaattgaaagcatcaaaaaaaaaataaaaataaataaataaataaaaagatgaaaaaaaaaccctatcccacaggaagcctcacaaaatctcctagctgccactgtgatggagctgaccttacagtgagcctgcctgtggggttactgactgtttcaactccttggacattttacctttcttttatacagagaagagatgtggagaaggggatagcagatacccagtttctgtatttttatagattttagctttcaggctgcccttctaatataacatgaaagtgctgacaccagttagaatggcgatcattaaaatgtcaggaaacaacaggtgctggagaggatgtggagaaataggaacacttttacactgttggtgggactgtaaactagttcaaccattgtggaagtcagtgtggcgattcctcagggatcttgaactaaaaataccatttgacccagccatcccattactgggtatatacccaaaggactataaatcatgctgctataaagacacatgcacacgtatgtttattgcggcactattcacaatagcaaagacttggaaccaacccaaatgtccaacaacgatagactggattaagaaaatgtggcacatatacaccatggaatactatgcagccataaaaatgatgagttcttgtcctttgtacggacatggatgaagctggaaaccatcattctcagcaaactattgcaaggacaaaaaaccaaacaccgcatattctcactcataggtgggaactgaacaatgagaacacatggtcacaggaaggggaactcacacaccagggcctgttgtggggtcggggagtggggagggatagcattaggagatatacctaatgttaaatgatgagttaatgggtgcagcacaccaacatggcacatgtatacatatgtaacaaacctgcacattgtgcacatgtaccctaaaacttaaagaataataaaaaaagaaaaaaaaagaaaatgctgatttctttccaaatctaatccaaaataatgttaaataagcctcttgacttagcagtttttgaatatttatattatgctattatgtaggtcatcgtatataattttcatatttctttggagtatatcatgcatatagcaatcagatagaatagaatcatacttatttctagagttttcccattcatgtaaaacctgaaaaaatatttttttcaaattttcagccctcagtatggagcaggtttgacattttaaaggcaatttaaatgattattatttgcctagtaaattctcaagattccttgtatgctcacacagtttgcaatgagatgaaatcatgtgaaaagcaatgcacctggcatttatatccattatatccaaaagaggtgtcgaatttaactaaaatatactttaaaaaatttcctcactggtttaagcttgattttaatactatttaactccttatttaaacaaaaaaaaaacaccataagaaattcaatttatgaggtctgaagaagttttgctgggcacagctaaggattccagcctatctttgtgttcgctgacttattaagtgtcgtttagaattggattaattttggtctcaactcttagtcctcatcacaatcagagttggtattcacataagcctttctttgaataggcttcagaaacaaagactacttattctactcagctctgattaagaattttatagcacacagggacaaataattggggtcagacttttcaactgcagcacaggatgaagagcagcaaaaccaacatgtgtccgtctactttgaagctgccataattatattcagtttttaactcccataaagaagaaatctattcattactcttttctttctttgagacattttttacgattacggatagtcaggaccttagataactggaaaagggctcacgaagttggtttgaggctatcctaagactgtctatgtcactgttactcacctagaaatgcttggattgttagaggattgcaacactgtactgattgccttccactcctcagctgtctctgtcctgtacttaccttgtagaaatgcaaaacccacatcactgtcaatgtgtcacttctgtaagctactactttccataactacccattattataggataaggtcttgtttcttcaacttcttacccagtgtttcccattttctgctccatcttcatacagacatttcattaagtaatgacactgtgttaactgagttttcattttactgttgttttaagtacagagttaaaatgtatgggtcattttgtataagaccagtcaacaaggttaaaatattaaataatacaaaatgatatattggcatcaaaaatgcactaggctctgttttaaacacacacacacatacttattgaatcatcagaacaacttcatttatccctcattttacagagaaggaaacggaggcacagaaaactaaatgattttcccaaggtcaaagagctggtaggtagaagagtgaggattcatacccaagcaaaatggctctcagagactttcaatgtacccactacattctgctgtctctttatctacttctgggtgttgaaaattatgacaagctatcaaaacctttaaagaatgtcctcattcatgcaattgtagggcatattaatgaacggaggagggtgaaaggtgacagtctccttccccagaggccttatcaagaacttttattggatatcatgctacaagatttgtgtctctctactttcagatttccttttgcttgaaacttttatagttattttttcattcctgcagcacatgcagtttgcattctagcatagcaatctcagctacccatagtcagccattggtacataataatgcttagtctttgatgagggtaaaggaaacctttctcacatactaagaggctctatttttcctcctctaacttccagccttattttggcttctcctttttagtgttttggcaagcatttgtcataaatctttgtgacttttgttgagagagtagtaatttatgattctggttccattttaaagaatagagttacttccttagtggcaccttcactatcttccttagttacaattacttcagttcactgcctctgagctggtggtgtgtctcaaacacttggccttgttttttctagaagtaattcaattacccttcttgttctctcttcaactccttcttttacttacattgtgcccggtaaagtgcaagggtcagaaagcaaaactgaaggtacctgcagaatgaatgaatgcatatataattttgtattataatatgttattaacatgagagtaatatattatcaatatattaatatccaatatatcatgtgtatgtgtatgtacagaaagcctcatccaccccgctgctctaaacatctatttcagaggaggattttgtagacttcactttgaaataacagtcctcttgaaaggtatccctgtaattcaaagaatgagaacgcattcattacaatgtgagttgaaaggcggcatcaagttatcccatggacatccctgtattgtaaatgaggcacagctttgtcacagagaggctggaattgaaattggaaaattggaaaagaagtttcttctctgtttcttgaggataaacctggtgatgtgttatctccctgtctctctcatctgcttatctctattttatctctctccatctgtcaattcggttttcacatagacccaaataaggatgtaaatcccagcctcagttatataacaagaatcacttaattgttcctaatccaattttttttttacttttatattccgtgtgggggtcctgcaaatctttgttacgtagatagactcatgtcacatgggtttattgtacagattattttgccacccaggaattaagcccagtaccccatagttatattttctgctcctctccctcctcccaccctccaccctcacatacaccccagtgtctgttgttccctttttgtgcttataagatctcataatttagctcccacttataggtaagaacatgcagtatttggttttctgctcttgtgctagtttgctgagcataatagcctccagctccatccatgttcccacaaaagacatgatcttgttcttttttatgactacatagtatttcatggtgtatatgtaccttgtacaatctgtcattgatgagcattcaagttgattccatgtctgctattgtgaatagtgctgcaatgaacattcacctgcatgtgtctttatggtagaacgatttttattcctctggatatacacccagtaacgggatttctggatcaaatgataatgctgcttttagctctttgagaaatcgccatcctgctttacacaatggttgaactattttcactcctagtaacagtggataagtttccccttttttctgccaccttgccagcgtctgttattttttgactttttaataatagccattctgactggtgtgagatgatatctcattgtggttttgatttgtatttctctaatgatcagtaataatgagctttttttcatatgcttcttggccacatgtatgtcttcttttgaaatgtatgtgttcatgacctttgcttacattttaatggggttgtttgttttttttcttgtaaatttaagttccttgtagactctggatattagacctttgtcagatgaatagattgcagaaattttctttcattctgtaggttgtctgtttactctgttaataatgtcttttgctgtgcagaagctcttgagttcaattagatctcactagtcaatttttccttttgttgcaattgcttttggtatctttgtcatgaaatctttgcctgtttctatctctaggatggtattgcctaggttatctgccagggtttttgtgagtttagggttttacccttaagtctttaatccctctttatttaattttcctgtatggtataaggatggggtccagcttcagccagttatcccagcaccatttattgaatagggagtcatttctccacttttttctgtcagctttgtcgaagatcaggtggttctaagtgtgtggacttatttctgggctctctattctgttccattcatgtaggtgcctgtttttgtaccagtatcatgctgttttggttactgtggccctttagtatagtttgaagtttggtaatgtgatgactctggctctctggctttgtttttatttttttgtttgttttgttttgttttgtttgcttaggattgctttagcttttttcgttcagtatgagttttaaaatcgtttttctagttctgtgaagaatgtctttggtattttgataggaatagcattgagtctgtaaatttctttgggcagtatagccattttaatgatattgattattcctatcaatgagcatgaaatgtttttcaatttgtgtcatctctgatttctttgagcagtgtttggtgattctcattgtggagatctttcacctccctggttagctgtgttcttgagtactttattttttttctggcaattatgaatgggattgcctttatgatttcgctctcatttggctgttgttgatgcataggcaggctgatgatttttatacattgattttttattctgaaactttgatgtttttcagccaaaggagcttttgggccaagattatggggttttctagatacagaataatgtcatttgcaaagagagatagtttgactccctctcttcctatttggatatcctttatttctttctcttgtctgattgctttagttaggatttcccttaattcaaatattaatttaaatatttaattcaaatacttgtgagaaagagaatttgattaatttttcctatcccttgtgttattttatcctggatctcacatccacctttggtccatctcaggtccagtcagctctgatttatgtctgctgataccaacaaagcaacagaggctctgtgtgtgtgtgtgtgtgtgtgtgtgtgtgtgtgtgtgtgtgtgtacatagtaagtgagaaatgaattttaaagctaaactacccagtttttctttcattaattgttctagagaggtttgtgagtattgtaataacattcttagattatacccattggtaatccatcctaatcagtcctctcaatgagtatttggccattaattatactgtgatgaagtaaaatactatatttaaagttgtatccattacaaactaaagtaatgccattacataaggagtaatcagaagaacctttgagcctctacattattataggaaagcaatcaaaacaataacaaaaagcaaaaacaaaaatatgatgattaaatgagatgaaaggtgcctgccacaatgtttgacacataactggtgattttaaaatgttatctattattttaataatactaagtatatgaccctgttcccagaagtttgcttggaaattaagaactcttacatccagataatcccctacccctctctttacatatgtgaattttctcatttttcaaagttctcctcagtcactacttcctatgtgaaggtagagcttatcaatcaaggctcacacatgaaacccaattgactttatttttcatcaggtgcttcatttgcatgatacacaatatttatatgttgtaagatgtacaattatttgtaatcttgcatattatttattttattatttgctattttattttttgtatgtctgtgacccctcattctatacctaaattgtgaatatcctgtaaacaagggctaagacatatagtccacacaatatccatcattgcactatatgtttgggtgcaagcattcatatgatttctagcaggaaattgtagatagctaattttaaaaggaattttttcagtggaatgggacaaggaaataaagtaattttaataaaaatttaatttgagatataaatttgctaaaaactattttctatgacaaaatgtttgttgccctcagttatatagctgggtttttaggaattataggactactgaataactgaatgatcttgttcctttccaagtcttagattttagtttatttctgcaatacacacacatgcacacacacacacacaaagatttcttttctaaaatgatcattaactcctccacaatttttgtggcaagccacaatgatacataaatgtctcaattttgctagtaaagttcaattttgaaactctatgtgctttgatcatctgatgtttatatgttgctaacgtgttcaatcacttccatatgagagatggatgaagaagaagtccaaataattatttagttttgaaacattctaggcaaaaatgtcacttattttagtcatttgtttttttatgctccatttaaaaaaaaaatgcttcattgttcgcatgacgtcagtgtttccaaaacttctacattgatagtaatcattgggaacacggagcttcctgtctttccctgggagattctgagttagcgactcttaggtggaagttgtaattttaacaacagtttgtatttttaaatgtaacttatattctggcagaattttaaaaaatacctaaggcaattgttaacatccaggaagtttggagaaacatccgtatgaagcagttattctttttgtctgtttccatcattcctagttaccaacctttgtgggcttcacctaacataatcactagttgtattgagaacaccttttttttctttctttttttttttttttttgggacggagtctctctctgtcgcccaggctggagtgcagtggcacgatctgggctcactgcaagctccgcttcccaggttcccatcattctcctgcctcagcctcccgagtccctgggactacaggcgcccgccaccacgcccagctaattttttgtatttttagtagcgacgggtttcaccgtgttagccaggatggtctcagtctcctgacctcgtgatccacccgcctcggcctcccaaagtgctggggttacaggcgtgagccaccgcgcttgcaagttggatttaaaggtacgaaagcaattagagtgtattaagcttcttttaatggcaaagaaaatcactcacctgaaagtattgttagctgttgaattgtcttcattgcttttaagatatttctaattagaacaatttactgtcctcaatcaattatgtagggatcctacagattttatttcagggactatcctgaaagcacattactcatctatgggtttattttgttattgttgtttcgatcctttcaaagtgcactttgaaattaaattgggtttctgggaaaagtggaaagctttgaacttcagtagtatcgttcatgtcacgtaaaaataaaatggggatcatatgttgctcagttcttttcaatacatacctacctctggtctttttttgtttttatttttttcgtttttatttttttcatttttgatgcctacttatggttcactctgtaatccacaatctttacaggtattcttggggcttgaatatatttgaactgctgagcacagagcctgtaaaggagaggatgctcacagtgggaaaccattttcctgagaaataaatgtactacagaaaatttaaattgcttccattttttcacagtgctattctgttagtaaaactaagacatgttcttcgttgttatttctaggtttgaatcccctctgttctaagagctttacaattctctttcttatttctattttgagtaacaagtttgaccaaatgttcttcctggtgcagctgcctggaccctactgttttggctttgtgcttccatctcacagtagatacacacacacacacacacacacacacacatacatttttttaacttggactacatggaatgatgagagtatttaattttgactctttcattgaagtaattaggaaactctagggttattctgatttgactccatgtctagcctccctggtcctatcctcttagctgttaatgattgccatttgtgtaagatgagttcttaaaacagagttgttactaataagcagttttacacttgtacaaaatttattccctcggatttcaaaaaacaatatttgaagatattcttttaaaaaaatcaaactgaaaggaattcctttataggatgtaaaactctgtgaaataaatagcaatctatacctttcttatttaaaggtttataattaatgtgtttggacaacaatgcacaacattaatatatgctctcaggcttgagctgtctgcatttctgatgatgggacttattggcctgtgtggttttagagtcattccaaggcgaacaatggatcagggatactcatattatcctttgtcatagtctatttgacaatcaccacctagaaccaggggccccctgggttctgttttcagtacaccatggcatgccattatgtaatatcccatcttctaaagaagacacatccttggatgagcctcatgagttgccaaaatattactgtataaaattatatatattatctcccaacacttactataactttctttttcatctttcgttatgaattttgcaaaaatttatatatctttttcccttttttatagtaattctttcccctctcttctctgtgtctcatctaaataagtaagtctaatgtttttctaaaaatagaaaggcaaaaatacaccaaattgtaaatgttgtaatacagtgcttatgttttacatttcttctctcagttataacctttcttttgtttctacttaatcctcagactattttgaaatcatttcaaaccttctttactctttttttccttcgtgtatccatgtttacaggcagagcaggaaaagtatttacttatgacttatcatcatttaaagaatcaaagtttgtaatgcctaaaacaggaacaagatgtcctcagaatattttctgtattaggcatatctaaaaagagaattaaatcttttaggagtcaattttaataatgatgatgactgagaatgaagaaaatgatatcacctttcatcgttaaatattagaatcagatcaatgaaaatatttattttgaaattttgaagttaaaaataacagatacaaattaaggtagacagccactactatattgagaaatccactcttttttattattatactttaagttttagaaatccactcttgatcattcaaaaataaattgcctggtttgaaaaatttaattctattcttcttttcctatttctggtcactactctgaaaataattctacttcatagcatttttatagaacttgggagaagcagctaccataacacataaatcagtacatttcggtattaattccataacaattttgataagactaatagtgtttgagacagagaataatgaaagaaaatgcagttaatttgaagttttcctttcaatatgtaatttcactttaagagtttaatatatcctgttacaactgtctcctactgataaaaataaaaaaaacccacacctgcacaaaggagaaagcagaaaagaaataaaacaggaaagaaggaaggaaggaaagaaggaaggaaggaagaaagaaagagaagggagggaggaagagagggacggagggagggatgcaaggaaggaaggaaggaagggaaaggaaaagatggaaggaagacgactgattgaaaaatctatctctcaattctgaaaaaaaaaaaagtgaaactaatggttaaacactaaccacaatatgagaggaattcttcatgctttaaaatagtacaacccagcctcctaaattcttggggatgcaggacctgtactatggagaaaaccaggccactgtcttataccccaaacctccaggacctatgccagccttcggaggtaatccttcttgagaaagtaagagtcgttttcctttcacccatcatcagtaagtcaacaattcaaagacatcaagaataatggagggggaattgatggcatcacatttccttctggaggtgtatttccagcataaaatgttctgcagaacagtagaaataggctgagccataggcatttagagatttttctggtcaaagaattatagacggccttaatttcactaggacataaatacttctctccctagttaaagaactattgaagggcagaagaaaatataccttcatcccacagaaccatactagataaatttctggccattgctggaaattgaactggaagcgctgcatctcaaccctgccatgaagtggtatattctttcagtcccagaggacaagagtgcaaagattaattcacacattcctttcttcagttagaaaattttttcttgtttgtttattgtatatattaagggtgcaccttgatgatttgatatgtgttaatgttgtgaaataattaccacaacctagctgattaacagatccataaactctcatagttacctctcagtgtgtgctgacaacacttaggatctatcctcttagcacatttcaagtatacaccagagagttgttacctatggtcacaatgctacacattagatcttcagaacttactcatccagcataactgaaactttgtaccccttcaccaacatctctccatttccccctcaccgcagtcctttgtaaccaccagtttaccctctgctctcaccatacacaaaaatcaactcagaatggattgaagacttaaacataagacctgaaacaataaaacttccagaaggaaaccatgaggggaaaactgcttgatattggtcttggcaatgattttttgcatatgatggcaaaaacacaggcaacaaaagcaaaaatgtaagtggaacaatatcaaactaaaaagcttctgctcagcaagggatacaaccaacaaagtgaaaaaggcaactgaataggagaaaatatttacaaaccatatgtctgataaagaattcatatcctatatataagaaacacgtgtaactcagtagcaacaaaacaacctgatttaaaaatggccaaagtgcctgaatagacattttctcaaagaagacttacaaatggccagcaggtatatgctcaatatgtcattaaccaggatatcatgacaagattaaaaaaaaaaaaaaatatggggaagacatcttatggaaaagataaaaaattaaattaattgcataaaaatgagcactatcctcttaaccacttggaagaagaatgaacttgtgaaaataataacagtaaatgattttacaaaatatgtgctcttgtcattagaaaaataataaaagttaaacaaacaaataaacaaacaaaaaaaaaaaacagaaaaaaatgactctgtggcctgagaaggaaaatcattaataaaaggttaaaattatgtttaaagcacatagacggactcaggctaagatttttttaaaaaaggaaataaactaaattttttaaaagtagctgaaaaggaaaacgaaaatgacataattaactccaaattcgaggcaaagaacagtcgagttaacattgtagaatacaagtcatattgaggaacactgttagaagttaactcagaatgtcttctttggagacagtatattatctcctctctctctaaacatttttgttttctaaattattgtttataccatttcagaatggcttaccacatagcgtcttgaattcaaatttcttcatgccttaattctcaattgtattttaatttacgaagggtaatgagtttgtactagtgtatttctcattgcatttattaaatatttgcagaaagtgtgccttttaaaatgcatgctctcaagcagtatacctgtctaacaaatctgcatgtatattcctgaatctaaaataggaattgaaattatttttttaaatgcatgctgtttgatgatatgtgactaatatttccttttatgggagaatatattccaagaagaaacattaaattttctcattcaaagttggtagtaaaatatgtatgttaaaatatttaccatcagtacaattatctaactccattagctaattcagaccttttgactgtgtgtgttggctcatatgtgctttatcagaatattccttcattattctctctaacaccaagttcagccagatgttgtagtatgtcagctttggttctaaagatcttattatactgattaatctagaatatctgaggtgctgaccagagtctacatagagcatgagggtttgtttttttttttgagtatactccaagtgtttctcttaagtaaatttattcagtaagacctagtgctacttgtaaccagaacatattcacacagagtcactatatttctattgctcctatatcagcaactttgagaaaagaagccctttaatttcaaacatcgtatttctttcttcaaagagtttattccatttaatcgtgtgcatttatttatctctcacaaacgggcattctaacatcccacttgtctaatgatttgtccactatcttatagtttcacacctatataactcttttaaaaggtaaacaattggccgggcatggtggcttatgcctgtaatcccagcactttgggaggccgagatgggtggataacctgaagttgggagttcgataccagcctgaccagcatggagaaaccccgtctctagtctctactaaaaaaaaaaaaaaaattagccaggcgtggtggtgcatgcctgtaatcccagctacttaggaggctgaggcaggagaatcacttgaacccaggaggcagaggttgcggtgagtcgagatggcaccattgcactcctgcatgggcaataagagcgaaactccttctcaaaaaaaaaaaaaaaggtaaacaattttcttgctcacactgactcaattgtctattttaggataagcattataattcttgacaacttttccattatctcttaataatctaaaatattatatcccctaaagtcatataaaaggcaatagaaatagagggcttgtccttccctcctttccttctttcacttacaatgcttgttacaaactcattcaagtaatctcagtatttttttcacagcccattctcactcatgttctttctttctttattttaatttttattttattttattttattttactttattttttgagacagagtctcactttgttgcccaggctggagtgcagtgacatgatcttggctcactgcagcctccacttcccaggttcaagcgattctcctgtctcagcctcccgagtaactgggattacaggcacccaccactatacctggctaatttttgtatctttagtaaagaaagggtttcaccatgttgtccaggctggacttgaactcctaacctcaggtggtccacccacctaggcctcctaaagtgctgggattacaggcgtgagccattgcacgcagcctctcactcatactctaatatttaaccttcaatttacattcactcataagtattgaaaaccaaacaaaactactgttactactgtttctttgtcttatattcaagattacttggtaagtcattttttgttatctaatatttactatgcctttttaggttgatctctttaatgtgccactcttttacatgcttcttcccctatgcttttttgagacagagtcttgctgtgtcatcctggctggagtaaagtggcatgatcttggctcactgcaacctctgcctcctgggttcaagcaattcttgtgcctccgcctctcaagtagctgggattacagtcgtgtgccaccacagccagctagtttttgtatttttagtggagatggggtttcaccatgttggccaggctggtctcgaactcctgacctcaggcgatccgcccacctcgacctcccaaattgctgggattataggcgtgagccaccgcacccgactgcaatgcattcttaaaaactagataatatatatccatacacaccttcaggttcattttggcttattattttgtacaacagaaatgttacaagttgcttcattattctcgtctatataatgtccatgctttatcatctaatgttcatattttttaaaggtattgcatgatattgttttctcatctttctagactatttaacaaagttgaatgaagtgattatacatatataaatgcctttcaatcacactgttatatccacttctccactgtggttattagtgttcatttgtgagtgctatcttcccaacagtccccatttccaggagtgaatgtctccttgttattcatatttaatcttttctcaaagtcatctttgcttggaagaatgtggaattatctcactcaaaagaatggattccaggtctgcagacatcctgaaagaaaatttttatcattcattacttgagggaatcattcaacacactttcaggtttttaattccacccattataataggtgcccataagctaacatctcaaacagaatctttttatcaagacaccaccactgttaaacctgagaaattattataagctcagagaatcaggtacatgtgtaaaagcttattcttacagaatgtgaaaactatatacacagttttaaaaacaaaacaaacagagaatgaataataatcttttattgataccttaaggacattaaatagtactatcgaattagcttgtagatgattttggtcctgtgttttatgtatttaaagtattaaagaaatattgaggttataaatataccatggcccagtcattcctcttcctataaggcagaatgtaaaacatcattatttatgataaacaatactgcttttttttcacccaacttccccttcatcgtaaataaacattgatgcagttcagagggaaagagaaagtctgtcacaagaatgtcatttgctctgtcagacatcaaaaattagagttggctgcctatgacactctcccacctccctggatgagatgaagtgtcaatcaatcacttggatcagcagcctaaagaacaaagaggctacatttattaagctaaacctccctattgggggccgttttcacaattctagtagcagagggagtacataatctataatatgacaaatcaaagatttcaaagtaatgtatgctataattttagcatgacatttaacatctgctacatcatcttttaacatgttcatctacatggcttaatattccatgagattagaagactcacaggagcaaagataccccttcctatttcatcagctaactctagttcatggaactcactgcacctgataggtgtcagtgctcacccaaaatcagatctcatcagacatttccaactgcttccacctctttagctccttttataaactggctatagattagtcaattattcagagcttaacaaagaatttcagataattctataattaaaacaactcatcagaatgactgctctgaaatttagttaactaatatccataagatctttacttttttggcttgaaattatgagatttcaaaccttgtacttttcaatttggctcatagatgaggattagagttggacagtggtctgatcaggaggtaagaaattaccaagaagagtgagaaatgagtaaaacagacttctagacagttcaagatttactcagaatttactatgtgagggagatgattatgatacttatttcggttatctttcactgagtaacaaatcactcccagatttagtgtcttagaatgacataaatttattatttttcacaagtctgcaattagagctttgaatttgtcaaagacaaaagactttaatatgctttgaaactctacagcacccctttgtaaggaaaatttttatatttaaatatgagaaagaaaaggaatttaagaaatatgacaaagctggaataatcaaaagtaaagcccaggcctaatcatcagttgatcatacttgaaaaggtagcctttacttaaagttactcttttgacatttcttccatttctataaatgtatatattaatagagcatgtaataaattataatattattacagagccagaccatatgaaatactttaaactttattagaaaatgagaaattattataatttttataacttaaggtagactgttataattaaccccaaattattagtgacataatataataaaactatatatttcccagcaatataacagttactataatgtgcctgtaaagttggtggccttccacaatgtgactcatggtctcagatgccttcagtcttatgtctctaccttccactagaacaatgtaatttttgccttttaaccagagcacaaaaaatgagagcatggtaaagatataaaaatttcttagctattttgtcttagtattaataaatatcccttctgttaacattctattggagaattagttaaatgaccccatctagaatgcaatgggactgggaaatgtatccttggttagactagtgctaaggagcaacagttctgtttttaaaggagagcacaaatctttggtagaccactggtcatttctgttgcagtatgataaaaatctttgttttggaagaattcctaaaggtcatctgttataactatatgtctgatagttgagtcctttttatgaaatccagtacagtggccacctagcccagaaggtctcaatatgtcagaacataactggtatatatccaccatttaagagagaagttgaaattttaaaagtaactaaaaaataatgtcttaaagttttcataggatttacttttgtcatgatatagttgatttcattcattgttacctttattcacattcaagtttcttctgtattcaagtaatatggcaaaatactacataatctacaggccatccaatctatttattggatcccttcagcaaaatgtggggaatcttatgaacatgttttgaatgtctacatcatgcatcagtatgtgtaagtttgtgtggtgggggagggcactgagaaacttttgacctgcctatacatgtgtgatagcctgcttgttaccactcaatgctgcttttcccatctttaaagaatcctgttcaaaatatttctttttagctattaaaaacatgtcttctttaagattttgcccttgaaaatgtgcaccatattgagcaaatctagtgcctttccataatggcatccctcaaaatgtacccaaagaagttatctatctccaattccttcaaaccagtacaagatatactttctgactattcatatcattctcctctaaacattactgagtctttcaaaggaattctcttctttgcctgtatatatttccatttgcttaatttgtgtcagtgtggggaaatggcaaacgttttattgtaacatatattactacattttcatttacatagaggaggataaaaaaatccactgggcaggacagaaatctcattatattgaacagctagctgcctaatgtattcactgttatccctatgtagttaacaaagatgcacagagaaatcttgtgactaaaactgtctttattactacgtaggtttttggcccattaaatgcatctattttctcatcttggtagactgtcacatatacattagcctcaaagattcctttagtttatgttaagattagaaggaagctttagcagtcagttccacattctcttttcccagaatcatatcctgttatctgtgtggcttccaaagacagggaaatctaggtttctcagagtccattttagtataccaggtatatatgttggaaatgagcaaagtgatcaggaaaaaaaatcaaaacattcttttccattcaaatctatttatgatcacttcattccttccacagattcactaaagtttttcccttatcccagtttccttctttgggtattcttaaagaacccttgatagacttggttcaaattagagatcttcttccctgagtaggagagaatgacctccagctacttcctaaggttatagtgtatggtgcttagcaagtctttaaaacctacaggtagtaagccttatttcagtgattatgaaggaggagtcagagggttgtagtagtggagacagacagggaagaatccactgaggtaccttttctagggagtagctgccattttagtatcccttttgtggtgagccatggttactggcatgtgtcatctctctcagaagagttagagaatagaagaagttgagagcacctgccccatacaactgttaatttaatagtgcctcagctaagtaagaatttttaatttgaatccttcaggttatttgaaaagcaagtccttcagttctctattcattaacctttattataaattccaatcacaatcacttgaaaaaattaaactactcaccattttttgcaacaattgcacttcccttcagcttgaaaataaggagtccttattcatattaactaatacaacttttttccccgttattataaaggctatatgtaactgtcctgaagatcctaatgcatcacattgtagtcagttctcaaaaatgtcttcataaattctcatagatgcaataagaatagttcaaaatgacagttgatgaaaaacagatgttatcatttgacattgagatttttaaattttatccttacatttcatttggagaatctcttcaatatctttaataatgttaatgatgtcattgtcaatatagcactgcttggaaattatttcccaatttctgactagcaactcctctgcaactcatttgaggctggaaatagatgatgctcatttaagtctgatctgtgagatatacctttcttctgattgctttgccttgggggatactattttatgtgtttcaaaggattttgctgagagaaaataaagagagaaaagtgacaactctacaaagtttaatatttaaatgcactgagggtctaatatttgttaccacatgctaagtcccattttaagaaaggagtaaacctcaaatccatttaccatataaaaagctatctgtactaaaaaaaaccttcaaatgaagatagatattaagaaaaaagaatatatgtggtaatgcatgtgttagttaattataatgaaacattgcactatatatatatagaaaacatcgtgcacaataaatgtatcacttctatgacagtttttaaaaagtagtgactaaattgtagcaaaagaacatataggttgtctatctgtcaatgatgactgcaaaaaaaatgaaacaatttgaatttatggagtctgtttaggctatgtaaaatttttttcacatttttaggtagcaactctttttaaatgacgagtttttgtttttgtttttgtttttgcataagaaagcacattctgaccaagattctggaatattttcacaaagcataaaaaagttggtcgatgtctgcctaggtagctttgcttttgctctgcatgattatgtatatttagaaaacctgaaaccatttttttctatctttcatgttattttttggctatctagttagttacaaaatgagatactagtattatatggctctctctagctatagttttaatgttattaacctcttaagtgtgtttaactgtctgtcaaatctatgtaatttaagaaggtaaattaaatgatttctaagttgacttttatttacaaacaaaaagttatgctcctttgaaataaaacagtcactgtggccaattctcatcagtccctacttatgaaaagactataataggcacaaaaaatagttaagaatatgttctaaatttatttatagtagaggtgagtctaatagtctactttgctccttctgtagcaaagtcctcatttatttctgcttgagacccataagcaactcgaatttaaaatatgaaatatgcttttgttggtataatagtgtttaaatgaaagtatactcttcagacacaaatagcattgaggagtttccaaaagtaaagaacaaaaaaatgccatatgccttcacatttttaggaatggtgctggactactgttgcaggacaggcaaagacaaaatgctagtttaatgagtcctggctgttcatctaattttaaagttgaagaatctaatggagttaagattcgtctggaaagaactggagaaatgctttcttttcacctattatcatctgtttctaccaacacaatacttgtggcaccaaatgtgtaggatttttcctcatatcagcaaccagttctccaactctctggacaccaactgggtaacctacaatttaatgaaattctgacactaactatctggagttagtatcagatcctgcaagctaaggactccgttccacatgactgccttcacttcagatgccagctgcaagtcctggaccactgaaacttttgaccaactagcaataaatgcaggggtttcctgcaatctctttcttacgcttgataatttgcagcataaggaactcaggaagacactttatttactattactgttttataaagcatacaaatgaagagcgctttgaagaggttcataaagagaagtccaaaagtgagcctctgtcctgctaacttagggtacaccaccctttcaacatatggaagcatcacctgtctggaagttctccaaacctcattactaaatctcagctcctcttctcttccaagaagttgtggggagtggtattaaaaggttgttgattggagtggggggattgaaagtagacttcgggctgggcacagtatctcacgcctgtaatcccagcactttgggaggccaagacaggcaggtcacttgaggccaggagttcgagaccagcctggccaacatgatgaaaaccctgtctctactaaaaatacaaaaattagttgagcatggcagcacatgcttgtaatcccagttgaggcatgagaattgcttgaaccgaggaggtggaggttgcagtgagcagagatcttgccactaccctccagcctgggtgacagagcaacacccagtctgaaaaaaaataaaataaaataaaataaaataaaataaataaataaagtaggcctcaaataaagcttcatctttctggaaaccaaaagctatccttctcaccaagacccatctcactagaataagagggattgctattacccagaaaattccaaggaattcaggagctctttgtcactctgaaagacactcttatcaccccactcaggaaaatacaagcgttttaggagccttctgtcaggaacaagggaccaagatcaaatacatatttcttattttaccacatatcctccagtcaaatgagagaattttagaggagcctaacgccctgatattttatttctgcctgagaaatttagagacaatacgctttgactggagctgtgtcctcatctatgagagagctcactgcattaggagtgaaatcatttctactgatggtaagaacaaaagtctacatttcccatggatgataatggatcacaggactgggaaccatctacagtgaacttaacgagaattttgctaggactgctgtccggaggcaccaaatctctgtagagttgactactgtatgcccccatagaatgttaagaattgccatcataaatgaccagctagagaagtttattgctgtgtctcctgtcactgtggagattttacatataacccacataagcatccaacaacagaaaacacagcattagtatggaaatactaccatacaaggcagcccaataacccactggcacctgaggcaacgaaggaagccttctcctttttctttctttgtcccatttcttccctgcactaactccctaaatggattcagaaactgtggccaggaagcagagagaggcattgggataggcgtgagataagagcctgacctttctcttgtcttcagcaagaaacttcccaggctagcagtaccaagccaagccacagtagggtatgcgggaaagtattaccttctgtgaagtcagtagctccctggactaaacagttttattgctaaaatggtgatatttagcatgtgagagcaacatgaagctattttagtatcaagaagtaataggaaaatatttcatccacaggttaaggaagaatgagtccatgggtcaggtttaagagaatagtgtgggaaaaaaataagttgttttctgattctataccattgtgttcagcacattcaatataatgattagagtcactacaagaatgcatgagattcattcatagtatgtgaatagaattctgttgtgccacacttaagtctgcaatagaggggggctgaaataaatatcatggatattaatatcaccaatttaaatttgactttagaaagtgggtgctctctgatctcccccaccctgtcttttactttttttaaaattttctacatccacataccctggcttaggctttttttaattttacttacttctgggatctagctaaggagatgcagaataggagagtggatgatctcactgacaagtgggagaactatctttttgaacgttatgtaaacttcagtcttgcaagtcttcatcatgcaagaatttttttttctctttttacccttatacaccgacaacactccccactttcgtttttacaaagaattttctattaaaacaaaccacccaccaaaatatttctagtattttcatttatttcacagtgaaccataccctaaaggaaggggaaacctataatatgactgtttaagctgtagctctctgtttaggcttttatgagctgtaatgaaaccaggataaattctgggtcacaaacacataatcattcttgctaataatgactgattctgtaatcttccactcagatttcttgtataatcttctcacatataattcccaatgtatgaatataacattttcccctgcttctttgtgagtaggtaagaagacaaaattcccaagatgtttttgctttgttacctccaaccaagtactcatacacatcttcatgtaaaatttcgtctttaataattacacacagggatgactctctgatagaagttcttaatttttttaaggaagtgagtaaaaagttgtacataggcgtgggtttgtgagaatttcttgaaaaaataatagttaaacaattttgcaggctaagactacaaagctatgtgcttgtcacataaggtattgacccagactgctttgtgtgtccctacaagagttatggaaataaattatattttgttccattgtttctatttttcagccatcgtacctctactattgtggtatcaagaaattgaattccatttctgactcattggtttgctttttctgtttgtgcttgtcttgttccagacaatttacaaagggactacatgacatccaaggaagttggtgtgcagcaatttttctctttgttccctccccttctgcttatccctcaaagtattcttcattttcttattgtcactatttcttattgctgtccctctctggattttattttgtcttatgagtaagagtgggtaagaatacaaattaagaaattagttacacttgggttttttcaataatttttttcatgaagcttttccttgtcacctaataacaaaggaagttggcgaacatgaactcacaaattaaaaagaaaaaataaaactctcttgttacaatttaaatagagtatgcaaggtgtgatttgcaacttaaaagttgtacttgttgttttgaattctggggatatatgagggaaaacatttactttcagaagctatagatgcttattctctgaacaatgtgtgtaaacagaaaaggtcgctacagccaggtgatgaaggtggccaaaagcagacatttttccacgatcttgctgctgtttcaagtgtgttttatctcttccttccttctttctttcttcttcctcctcatagtcaacattgatcttcagtgtgggaatcaaatgccctaccactgaacttcacttatcttcaaaaatggagaaagcataccaggagacttgaggcgacaaccaggatcagtgttttctgttcttacttttgtccacccatacaccaggtttagcacttacctttacactaaccatcttttccactttctctctccatgcatatcctacagagtctcacctcagagcagatactgtgataaagtcttaatctctgacttattaattttctcaaatgcatcattgtacatttcataatactttgaatatatagtccttagaagtaggtattatgtcactattcaattaggttatggtatatgaagatttcaatgtacaactcctccctttaaacttgagaaaagtaaggtttagctggtaaatccagtcttagtgacctctcatggagtgcatgattcactactattacaagctaagactatgaggcttagtgaccattacatctaattacttaccgtcatcaagttcacccttccatttttttaaaggtctggtgaataatcaaggttttaatacaagatgacccttttgaaaacccagaagtcttacatgcatgctttatgaatataaggtaaaaagttttactccttagcaggcggcctacaggcaatcaaatcaccgttcatttagaagcaagatgatctctcatttaaacatgtacttctgtcctttttccaccatctttccatgccaccataatggtgctcatgattgtcctggctgatgctctcaagagcaataacaatgctaaaaagagaggcaaacatcaggttcttatggggccgtgctccagagccatcatctggtttctcactgtgatgatgaagcgtggttacactggcaaatttgaaatcattgatgattacacagctgggaaaagagctgcgaatccctcaggcaggttaaacatgtgtggcatgattagcctcaacttcgatgtacaactcaaagacctagaaaaatggcaaaacagtctgctcttctccagtcagtttagttgtattgacaacctcagctggcatcatggaccacaaaggagcaagatgaaagtgcacagtagggaaaatcctggggattatttttctagggatgtaatgcttacaaataaaatgctcaatagacaataaacaaaaataaaagtaaaataaacgtgtacttctttagtgtttcttatgtgcaagagcctatgctgtggaaaagatagatgtataccttcaataaagttataatctagtaactgtgttttggcaaaaagggtgtccccagaacctatgtaggaaggaaaagtacaactttcagggacaagcctaggattgaagaacatccttgggagtttccaggcagaaggccttggaccctctctcttatggatgccgaaattccaacattcacctgagacctccctctttagggacatccctagtcatatacaggtgaaaggtgtctttctttgcaaggggcagcttactgatatctcaatttttattctggatttattattatttgaaatattacaggaatttgaggatgaacttggacaattagtaccatatttgatattcttttattataaaaacaaaatacaacataaatgcataatttatgaactgaattatgcaatggtgaaatgcagaacaatgaatatttatatagtaaatatacggaaacaaatacatatatagaaaagtctaattcttttaattttgtgagccagtcaacacaattaccatttctcatctgttttgaagctagagctctcctagtgtcatatagtagttctccatatccaagggggatacattccatcatccccagtgaatacctgaaaccttggatagtaccgaacacaattgccaccaattggaacacatgtctgttcgtgtcttctacccacaaatttaatgccttttatatcttaattgagcatttatcatgcactctggacataactttggcagtctgaggtggaacagcaaaactggcatgaatttctttttgcctctttacaatttcatgatctcaagatttgttctcaccgtagatcttagcaagttcagcatacaattttttgctttccttaagttgagaacgtgcactgtttcatttaaagaaagtactttatggcatatcttaattgctagcgtcactatttttgcacattgcggccatgattaagtaaaatcagggtacttgaacacaagaacggcaattcagtgacagtccatctgataactgagatggttaagtgactaaagggtgggtagcatagacaacatgggtacgccgaacaaagggatgattcatattccagtgcaagattttatcatgctactcaaaacagcatgtgatttagaagttaggagttatttctggaagtttccttttaatattttcagaccacagttgaccaagagtaaatgaaattgcagaaagcaaaactttggataagcgggggctcgaatacacagatgtggtatccgcaggaaggtgatggatgtggggattagagtatatgctgggcttcatggtgcctacattccgtttgctgtgcctcactatttaatgcctttaaacttttgtttgcccaagtaggaaatgaggggtataataatacctataaggtagaatcattgtgaggataaatttgttaatactctgctcctgccttcactactgacctcatctccagtgagatttcctgcttacatcacctcagtgcaccagcctcctctgactaagtccctgaccaggtcatgtgcatccctgactcctgtgctggaaactcctgtcctgtctccctctgctggaaacactgagcctacagacaactgtttgccttactctctcatgtaggtctctcttcagatgatcagagaagcctttcttgctgtttattcaccattaggtctgtaccatctggaacactacctgacactaaacagacactcaataaatgtaagttcagtgaagaaataaataaatatgtatacataccttaaccgaccacttatcacaaaacaagaactcaaagtatcctctccattgcctctattatcaattatattgttaaaaattgatcccaacctatgataaatcacatgacaagtagtgtttgtttgagcccccacattttctacaccacaagcctgtttatcttttcttcactagactgcagtgaagggtttttttcttttcctaaatagaaccttaaatcaatatacttgactgggttatctattttctgaaatcaaataggaaaatatttgttctgttgcacagaatgtgtgcatttgacactgattctatcccaagatacattgtggcagctgtttctaatcattctcagctttgtcctcatgatattgggtctaattaataagtttcactaaaacttcaagtactggtttatatttctattaacagtattctaccaattggcataatagcatatttaacttctgtagtttatctaccaagtatatattgtgatactctgctagttgtcgtatgttgtttgtacccatgacaaatctgattttcaaaaaactgtcaattccatgaggaaagggagtctatatggctccataatataaccttgtacttattgatgcttaatgtaagtttgttgagaacatatttatttatatacttattttggtaattagagttagattatctcttaattttcctactatgtccttcagaatgtttaaaaaattgctttacttccgtcacttatttgactttttaaaaatttgcgcttttgcacaaatgtgcattttgagcaacctcagttggtcagtggaatttcagtcaatgaaatccagccagcgggtattcattgtgttcctgaaacctcaccagtctgcctgctccctgtccggctcagtgctacctgcattgtgagcccattctatttctgctctccacacttggtttccgtgaccagctgcccttgttatgttgttctcagtttggaagtccttgactctgcttgatcaaatcttgcctattaaaggatctcatcaagagctttcttggctctgctactttgcctgatcactcagctcagagttcatcggtctcaccttttggctcccatagacttgtgtttatcattctatttgtggcatgtatttccttccttgcttcatagttgctttgcacagatctgtcactcttactgtattgtaatacagctgaaggtatggaatgtttgtttgactgtgtatttgcagtccccaaatgaaatcagtacttaccatatattcagttattagctgtacccttgaatttaattctacctctgaaaagggtaaagggcagaggtaagagaagtaaattttttttacgtaatgataccttggattccagaggaaataatcacatatttcccccatgaaagcataactatggggacaaagggcacccctagagtgagaggaagatctcactgttttttatattttgacaattccctttccagggaatttctagaagcctacagaagcctacagaaagtgtagaatcatgctgagttagactctggggtttattttagcttttctttattactttatggtatctaccagagataccaactagaagaatttcttttcactcttctctggaaaagcgtttatataaaattgcccagtgattctcagttttgccaatcctaggtttaacaattacgtatgacttaagttgccatcactgtcccaataagcagacgctaagacaaggtttcatgagacagtgatgtactagaaagcattcccatgagtgaggaaatggcacagggaaggacagcaagtaaggatgtgagataaacaaagtcccatggacatagtccctcaggggaactctggtaatagtggagatcacacttcagagatgtcagatcaggggccagatatttatacgtcctcattaaggtctgccccaaatgtgtactttttcctgtgtgcaggcaaagcaggctgcagcagctgaagggctgctttcctccagggatcctcaggggtatgctgttgggagtgagacactggagccgacacatgtgatggggaaacaatcctagaggtatggatggagcagtgacattgtctgcactgtgctgcctatactcctgcaggtttctgctgagaatcttggcactagcaagagaggtggtaggaacagtgcacaccaggtgcaggcaataagaaggtacattttctgtaaagaatttacaaaccaaaaaaaagaaaaaaaggctaaaagtaagtctgctttttattatcttcatgcaccaacaattgtggaaactgactaataaaatacttctagccctcatatgcatacacacccatacacacacacacacacacactcccttagtgaataactgtcctggcccactcttaggtactcgagtacatacaaccataatccctgccatgattggacaataatatttagactatacatacagacatagacacacacatacgcacatatatgaaaaaaaaatttagtcggtcattatccctgtaggtacaaataatttggcattctttttaaaccacatgaaatcaaccacaaaaaaagaatttttctacagctatgaaatatagatgtgtctttctgcaactgaatcaccacaagcatagagggagtagggacagcagaaggggaggaccactgacaatggagaatgttaacctaacattgcaattcattcattttacaaatgtttcttgaatgactactagctgttggatactgattgctatgcacattttgtgataaatgattatgtaagtataaattattccattaactcatttaggagataaacatacacacacatacacacacaaacagaggcacaaaacatatcttacatatacacacatcagctatgcatatatctatttatatcatggttcatttccttatttgacttaagtcattgccatatctctcaatataacctgctatatatatctctatcataactaactattctaaagaaagactcttcatgtgtttggaataacttctcttccttgcctttctttttttttattattaaccagagcactactgcagtttattacagcatgctgagcaagacaaaaggacctaattcactacagaagcctaatgcataaattctgcagattatttgctagtgagtcagcctatttaccaagataattcaacttgcaaattagtcatgtagaaagatttagttggcgaagatagagtaggcacatttgccctaaaaatagacacactatgcttgttcctaaggcagtacagtagcaccacacataagagacacagtgaagcagagagagacttttttttgtttcttatccaaatgatcaattcctttccctgatagagcttggagcacattgccaagcatttgtgccagttttttctacactggaaaataaaccctggcccatgctaatgaatcaggtcctaacagcaccaattggtctggttcttcttttgctttttgcattgctgacatttcctccttccagcttgggagttgcagctgcagggatagagctgcagcatatttctggctcctgtctcttgaaaatgtcataatggagctagagagggaagtagctatactggtttacacatatgagaaacgggagctgtttagagcctgatcaggaatatttgaaattatttgaaaaatgactagggctctaaacagctcccatttctcacgtatgtaaaccagtgctaggctgcaaggtcagaacacagagtttgcctatcaagttatatccatatttctttgaaggtggtgggatggttagatatatgtgccactcctttctggagaggacagtaactttcggtatgctgttgagtagcctcccattgcaaaattgcaaaatcttaccttactcttgtattgaagatgagctaaaatctttacctttagattattctatttttagacctcaagtttgcaaatgtaataggaagctaaatcaatgcacagatggttaataagaatacagttcagtaatggataggttgtacccaatccatccactgatgtttctgaatcataccctaatgtagaatggattataacaattaagtctaaaggtacttcagaatgaggtcttgagaaatacatggctccatgtatatttgacaagctacctataatgggagaaattcttgactagaaagactggtactgtgcttcatgaggaaagataccacacataagacttgaccttatgtagtgctcagaaaaatgttgcctttattagagtgtagcatgactactcagaataaactagtgctagagctcattaatgaggcttattcagcaaattactcctacagtggatatgcttgcatattgctggactgaaataccaaaatttgcatgtgtttttccagctgtgcttgtttgtttaatttaaatgatcagctgcagatgaaattctgatcatattcttaaattaggagatggccccagttccctgatcacatttgaaggctgatttgtttcacacagtaacttcctatcatttgttgcctccactctactctgtacttcatttgaaatttggcaaccctttccatttacaaactgtgggtggatttgagtacaagacatgaggaaatactatagccactaaagaaatggagggacatacattgtcttctagtaatttgcaatctttccagagttgcaacatataagcagcatggaacaactggaaatatatcaaagatatgaaatggaatacaaataatagctgttatttactgagatttaccatatgcccttgactaggccatggttaggtgcattatcacatttaattaaacctctcaaacctgtagtagggagccttatcatctttattctctagttgagatatctgaggcacaagacagttgaatattttgctttaaaatctgaatgctagttgtccatgtagttagccattatttcatacagttatatgcttacttaactgctttgggatggagaggagtaaatctgaccttatttctcacagaggtgagtttagaggaattgtccccctccccaccacaaaaaaaaaagaaagtacaattctaggctaaaaagaatgaagtaatgtgcctgctctttaagtagctttttgtatggtgttagagagagacaaatcaaccaaaaactacattgcagaatgggaagtactgtggtaggtatacgtgcatacaactttgatgaacacacagaggagaactcaagggtgcctagatatcattcttttttctgcaaggtacagatgcagtgagcatgtatcaagaacttggatcctgagctaatgctttcctcaagaaatgaactggctagattgcaagcttgtccaacccgtggccactgggctgcctgtggcccaggacagctttgaatgaggcccaacatgaattcataaactttcctaaaaaaatgtttttgtgatttttttacctcatcagctatctttagtattagtgtattttatgtgtgaatcaagacaattcttattttaatgtggcccaggaaagccaaaagattggacacccctcggctagagggtactttctatggtttccctaaaagcctgggtattataaagaaatatgttgtgttcacccagagagtatggcatactccatcaggggaagttcttttccctgccattctcctagtttatgaactccagttggggtcccctttttgtacaccttgaaaagaaaatgccatttgttctgcttatctgtactactaaagactagctacatgtaacattatgaaactcagtttatacataaagatgattctgtataacataacttgaaacctatttctaacccttgctacactagaatacacttgctacacctgaactattatataaactttagccatttaaaaaatcttgaatttcttatcagctttcatttatccctgttagaaagacaacttctcaaattgagaaatgaaaacactgggaatatcagagatgtatttatggatgagttttccctgagatgtcccagtttgtagacaactataacctatggactttactattgaagttttgggtgcacagaatgcaggagtcaagcttgagaaggcatttagtcataaggatggcctctctgactaaaagcgaccagcttgagagagagacaaaaaaaggaaaagagccccagaaaaaagcccatgattttaggtcagttggaaacaatgtagattttctagaaagaaattgaatgatgcaaactgtttgacagccacgttctgccagattcatagggaatggatttgagagagctgagcccagaagcataaagtccagggggcactttttcagtaacctggtcatgagggagtggaatcatccatcacagtattgttggcaggaacaaaaagccatgtgcctctcagtacaagagaggtttggcaggactagcatttttcaataagcctttaatacttgtgagttgttaccatgaatgcaaatggccatttatgatgactctagaaagttttagaaaacaaattaaacattattatgaaggccacagtagtcacatggcataggtcctagacagtgctaagccaggtggttaaaatgtgggttgagggttttgttagtgaaaactgctgatgctcaagaatgccaatttctaggttatgctcagacatgctgctgtggtccatgcctcagactcactgatgtgtgggtccaggtgaaaatgtgcacaatccctatttaggaaatgatgggtaattgtggaaaaagtatacagcagccaaaaatatttgcattgcagaaatgcattttaatgtctggcagaacacaaaatcttggtttagttaaaaattaagagaattgggtatatttaagagggtgcagcagctctttctcatgagtgatactttcactagaactaagcatggtaactaactgtatttgcctacataaagtgaagttgtatattgcaatgttggtttgttttgctttgttttgtttttgagatggagtcttgctctgtctcccaggatgtagtgcagtggcgtgatctcggctcactgcaacctccacctcctgggttcaagcaattctcctgcctcagcctcctgagtagctggaattacaggcatgcactaccacacctggctaacttttgtatttttagtacagacaggttttccccatgttggtcaggctgatttcaaactcctgacgtcaagtgatccacccaccttgacctcccaaagtgttgggattacaggcataagccaccgctcccagcctcaatgttggttttaattaaagcattataaaccaccatcttgaaatagtggggttcagattaaccaaatcaaaatttatgcacaccacacttaaatgttgattgtaactataactaaataaaactagaaagtaactacgaggtgaaaattatattagcccatttaacacaagctatatttaccacttcccatatatctttgtgatgtacttaacatctcagacatccttagggtatcttatcattatctgtaaaatactttattttaggcaataaatacaaaagtccacactggttttacatacacactgagaatgatattctaccttctttgacctcagagaaatagtctagaattagtaagaatcacttgatcaaagtgttagctttccaactgaaaagtcactcaataagctatgaactcaaaagacaaagtttcacaatgctacaaattatcctagttctatgagatatgacatttgttgtctgtttttcaaataaattaaaggtaacattactattctcagtagcacaaaacacctataagtaacaaattactggatagtttttaagtaactttttcaagggggtctgtatctgagtattattgaaatagttgaatttttgtcaaaattggaagtatcacagaaaaacactcatatggcaagaataaaaaagggcacctattcaataattgataagctattcttaaatgatgatttcctaaaatagagaatcttaatgtgtatttttgtcaccaaaagtcttatttttttgctatcagagtgacttttttcagatatgaaaagcttttatcttttaagagatatattctcttattatttagcaatggtttaaaattaatttgagaatgataattatggatacatatgctaatatcagatatgtccaccacatgattaaattttcaaacacatgcaaaactttacaatgactgataattgtttcactgaccatatctcaaattattctctgtgaagcttcaacacattcctgaattagcacatgtattagtttcctgcatagctagatgagatatttaaatagcagataatgctttgtctgctttgaattacaaagagatgatttcatttttctcagtgtgcttatcccaaattgaagtctacagctttattccattttcatggaataacaatgtaaatggcggcatcagccccacaacacttcatttccctgatgtcgtgaatccagaatttctaatttcccttagtgaatagtttttcaaatgtctccttagtcctgaattagattttataaagctttagggaatatcttcattaagatatcaagctacttgcttcaaaactggcaatagtcatctcgattattttatagggtaaaaatatttttcacagtgattttaaattatttcagttctcttgtcttctctatttttctatgtgtttagttttggtaatcaaagtgtagtttctccaaaaattcaggtgggtggaggaacatcacgttttttcttaatcaatacttagtgtttccagaagacgatcctagccaagaaaccaagtagaaggaagagaggcctctgtttcccagaaggacaactctgctgttttaaggtttctatgtctaatagtattaaaatgcttttaataaaaaaaactattgactgtggttgtgaccatcttataactacccaaattaatatttcccctcaaacacttttttctaaaacttcctatgctttgtttataccctgccctttctcttttaaaaaggcagttatatctatcattactggctcagtgcatgccttcctcatgtgaccacagggacagctcctggagagtcattcctcttcatctttgtgtcccagtatttgacacagttcctggcacatggtaggtattcaataaataggaaaggaatcaatgaaattatattaatgcctgggttctgatatgctaccaacttctaaactaattattcttcttcaaaactctaatcttcatctacctagatcatccaacaaaataaaataaagatgattgtttcaaactagagtttccaaaatgtcatccttcagaaattcattgcttagaatatatttagactatattgtacaaattagtaatatcaagatcggaagatcaatttttctaacattcatatttaaaattttctttttttcaaattttatattcaaggcaaccattctttttgtcagaagggcacagaaagtataaggtagttcataaggcctttgttcatataagtgaaaatataaatatactggtggactgagatcctatcctgttttcaactaaatataccatggagaaatttcagctaaatattccatggagaaatttcttctacatgtgatggagataaaataggagccagaaagtgcatataagttattaactttaatatacagattgttatcccaaggacttataaatctaatttagcggatatatatgagataacacaatatgacacatttcaactgctagacaagagctgtggccccacatataagtgtgagattcccttaatcatcagaagtggacattaattcagtaatatcttttaactctggacattaaatagacttttatcttgtgccatagatttttaatattttttaaccacaaaactaagagcgaaaaatccccatgtgaatcttagttattctacagtctttaaaaaaacaatcagagcttgatatgtgcacagcacccataggttagcacagtcatttagagtattttgatctaatagacatagtctttcaagagttggtcatttatgttaatctccattggataaccaagtcgatgtaaataatatgctatctatatttgtgtctctcagactttgttccttcaagtaataatgcttcaggttgttcataagggtctttgaaataaagagtgcttgtagtcaaatatgtcgtggaaagctatgttaggcaaatttaaaggttcccttactgtggcactttttagactctttactgaagtatagcatgaactgccatttaaaaaaatgtaatgtagacaaatctcaatgtttttagttactaagtctctattttagactgtcttcatctatttttcaccatgaagttacaaaaatgtgtgccgttaagtataacttatttttgtaataatatgatactgttactccccaaaccctcatttgtgcaaaggaaaaacagcactctgggtaggattttaaacatgatcaaatttcttcaaagcacagttagtagtaaagccaagacctggatttacctcttgtaagtgttctgctttttccatcataacaataccaaaggcgtaatatttaacaaattctttttgtgtgcctgggcattgggattaatattttatgtatctttccacatatgagtcccatagcattccaatgacatgaatatcataattttatttttactcaggacctttgaataaaaagattaatataaatgacttttaagcaatttttttcactaaatttagaaaattttatatttttcccctccctaaactgatgattaaaacttacaccgtgagtccattttcaaagctgagtgagttgccattgcctatggtgatacttgtaacatctgattaattgtttaataattattcattctctctaaggattcatacaggaatatgaatatatacttatatattctcatatattcatatgtacatgaaaataaaaagaggaatgaacctattcaatcacacattatgacatggtcagggctaaccaatattgcctatgtctgcagacaatccccaatcaaaacagataatgacataaaaactataagggctgcaaatgcctgatgagttcttcctgcatgcacaattttaagccctgcacatggatgagtgtgcactcagtcaatcttcaaaataaccatataagatagataccattttacagctgatgaaagtgaaactgaattaattaacttgcccctagtcaaacagctagactggtggcaccagtatttgaatttagataattcttatacttggtcattttgtgtactgtcaatatttaaatgaatgagatgccatcatttgaatgaataagactttcaattgccatgaaaaatattattccaagtgcttacttgatataggatcttatatgtttaaacagaaacaacttaagctgctctattattggtattactggtagattggagcagtatttgtaattgtgattcaataaagtaatataatggtacccctttttttgttttccacagagaataaattttatttaggtatttaaaatttcttacacccccaataaagtgtcttcccactcaaattaattaagcatgcactttcttcaatgaagtatgagaaacgcagatcgtggcaaagggatcatatgtaagataatcctagaaaactacctggctaaaaacacagacataatcttgatattctctgtcttggcaccactatctactcaattgcttaggaaaacaaacaaacaaaaagaattgtcctcttcttttagtttataatttctgatcaactcatcagcctgttttagtggctttacttccattatctcctgcaacagttccctaagtgcttctcactgggaaagggtctttcacaaatatgtctcagatcacaacactgccttgcttaagactattaccattgttgttataatcaaatccaaagggtgcagaggagtcaacaaggcactgtaggaactgtacctgtagatctgtacctctctgatttcaactccattctcccatgtattcattaccttctagagacactgtcctcctctctttcccacctcagggactttgcacatgcttttccatctagaatgctgttctcgttatcatcatccagacctccttttcagtcaattttcagattatgtaatgttatggtccccccactccttgtttccctcttagctactgattctatcacattattttactgtcttctgaagattcctcattacatgaaattacttggtattactccatctttcccactaaaatacaaatcttgtttctctttttcaccgatttgtcctcagtactgaaaatggtgcctcggactttgaggaactcaataaaatgtcttacaatgaataaatatacatcacatcatgattaataagtgaagcaggcactaagcatttgcatgaaaaagcaagtctaccaaaactgatttatgaagattgtacctaatgtgaattttcagcatttgataagtcacaatgcagagatgcagatgatgatggatgctttataaaaagaataagactttcccagaacagaatgctatgagagaagaatgccatggaaaagacagaaagtctgcagaccatgaataaagtgaaagagaaatccagaagatacaaaaccattacctgtgttatatttgctaagaattgttataattttctaggtgagaaagaactggaactaaatatcaaaactgtctttctcctttgacatatatgcacatataaaaatatatatgtgtgtatatatatatatatcttcatatttgttaattatataaatttcttaggggtttgtttgtcttttgtctttgagacagtctcaccctgttgctcaggttggagtgcagtggcgcaatctcagctcattgcaacctctgccccctaggttcaagtgattctcatgtctcagcttcccacgtagctgggattacaggcacccgccactacgcctggctactttttgtatttttagtagagacggggttttaccatgtgggccaggcttgtctcgaacttctgacctcaagcgatccacctgccttggcctccccttagtttttttatataataacttgtggatgatcccattatcagtttgtgatttgattctgttcaacaaagcttttagtattttgtataaataactattccatgtagcattttacaaaaattttgttcttaaggtgaagaattttgtatgtgtgtgtgtgtttatatatatatgtatgtattttacatatatacatgtatatttatgtatgtgtgggtatgtatacacaaatatatgtgtaacacgtatatgtgtgtatatatacataaatatgtatatatgtatggagagagagaatgagagacagaaatgatagggaaaagctcttcttagaaaagcctgtcccactagggtttcttatttgggtttgatatgataatgagatagtagaatacaaaacatatatgtagagagagttctgaactcagatgattgaaagttaatattttaaggtgacatttttattgtgaaacagtagcacattccaaatgttaaagatcaaatatatacctgattttgaaaattaatctttatgtagactaatcaacatttccctagtttatggtgagattgaatgataactcactataaaaacatctgtactactatagtgtaaagataaaatgcctaattaaaatcttgaaagcaagccacagcaacaattgcagtaaaacacaattgtactttaaaactgcacattaatcttttcaaatatgagaatgactgaatgatactaatatgatattcttcagagtaattatccttattcattaataatacatagaaaaaagtgagtaaagagtttctttaattttttcctgttttctagttctgtatcagatttgaagtgggataaagaatataatgatatatttttaatgcagtgcatccctaggaaagtttccttgtgaacagatcatgaaattaaaatagctatgcaaaaaaagaaacgaaaaatctggcaagatcaataaatgtgctttagtgaaatcaaggaataatttatctttcttaggaatttagcaccagtttatttttttctcaggttgcagctaatccatagatctagactaactgcatgataaattttagtcctagcatgttcaaacgatagatctcttaataatgagaaacacatctgtcacacaatctgcactgaatcaaatgtttagcagagccatgtgaggcttcccctaactcactgttcattggcactttctaagagagaaagatttgctagataattgaaacaaattcaccacttgaggaagtatctggcattacgtgacatcccaggaaagagaaaagtggttcttcttttttgaccctgtctctgtctcccaccacacaacctggtgacaattactcagttgcaattaattcttgcttctactgagaatgttgcaaaaagatagtagggctacagagaatgaggagattgtgtctgtatttatatttgaatgaataattacaaaatgacatggagaacctggtccaaaaacttttttcttgtcactactgatcaaattggtgagtactctgaatatttagaatagtgttgaaaacacagtatctgcaaaccgtggcatttgaagatcatagccatccttccctctgttttacctgacacctctcagttctctcttgctattccatagctaaaaaggatttatcattttccttaaatccatctctgtgttttcagctttggaggtggatgtgggaggaagggagcaggagggtggtgttttctttttgcctcagacgacacattaaagccatttttaaaacactaaagaaaagtaatggccttgtatgccattttattttattgacaataatggcatgatggcagtttacgggaagtttatacctgtttagactgagatttatttaaacactgtcaatttagaaacaatctagtaactagtaacataagttatttaagttatcacatagttgtaaaaatcacctgaaattaattagtccttgctaactattattactttgatgtgttactttccagacatttttcctatgatttaagaaagtaactcacaactcacaatatgtagagaattccaaagcttgctcttcttcaccaagcagtatattataaatgtcctgcctcctctgaaaatatgaatttatatcaaatatatttgatttataaaaaatatatttatattaaagtctttatatcaaatacaattcagtgaatcctctattgttggataactatgttgttcactgcgtgagatacatatatgtatatatatatataaatgatatatataaatgatatatataatgtgtgatatatttacatatcacacacagagatgctttttcaaaaaatatgttttttacaaaatattaatctgcatattttctagaaaataatttttggtgctattttttaattatattatctaactagtaatactagtaacttccatattttgcatatttcatagttaaaatggttgctatctttttgttaaacgaacagttatacccagatcatcttgtggtgtcaaaaaagtaagaacgtgctttaaagaaaagaaagggctcaaaaaaagtaggggcatactgaaaacatataggggtccttctgaaagagatcccaatgaccaaatttggaataacttgatcaacaagataaataataatagaagtaaaaaaaatcaccattagatcaccactgtaataactgccataggctagatcctccgatgggagtcaaattagcaaaaatttaggaggcagaattagtgggcagaaatgtgatatcctctagcaaatactttgtgaagtatacagaagaatgtatccccgccaaaatgtccatgttctcatctgccaaaactctatgttattttatatactctacaaaataaacaatcagtactctttgaaaacatccgggctgtgtaagtcagagaaccctcccagactggaggacacaaagaagacacaaagaaactaagtttgatatgggatcctgggatggattctggaacagaaaaagggcattcattaaaaatccaatgaaatcttaaaaaaaaaaagactatacatttgtgaatttagtattgtacaatagttaatttcgtagctttgataaatattctgtggctatgtaagacttttacataaaggaaagctgggtagagggcatacgggcactctctcttttgcaagtcttttaaaagtctaacatgtcaaaatatacacacatatatatttatacacacagataataaaatgtctcaggaatagtatatcaaaattgaactcaaatgaacattactttctgaaactctctggagaaagtagcctttaaattacacttcagtgaaaaatatcctaacactccttgacattcctgaacagaaaacaatttacttcctgttcctagaagattatagcctcagtggcttttctctgtgtgcgcgtgtgtgcgtgcttaatatttcctttactcctagacatttaactgacatcataatcactggttcccaaaggtcttctgttagaaagcattcttgggatttgatggtaatggatgctattattttgtgcatttaggtaactgtttgtacatgtatctcctactgaaattaaatgagggtgtatgtatctgatttcattttattgtctggatcgatgtgtgcactaatatttaaaacctgttttaccagatagtgctaaaaatgaatatctccaaatctgaagtttgtaatgtgaatatcaaacttggtgcagcctctcccaataagacattaacattgaaccacatttttcaaggacaaggatttcacaaatttacagaaatacaccagggattatggagacttatcagataagctaaatttaaattgcctgataactttaaatgagaaattctttttgaaggtctaccttgggagctgctccaattcccatcccacttgggctacttctttactggatttcccctatctaccttccttttcatcatcccccacctttctctccacacttcagattgccttctcctgcaacgtaccaacacaagatgccttttccatatctctatcctttagagttagaaaaataaaaactatgagattatggatggttgtttgctttggattatccatagctaggcaatgggagggtaggtggagaatgagaacttctatcttagtctatgaaatcagtatttttcttatggaaaagagaaacatgaagagatcagttacctatgtcacatagatatgtattgctcctgtgtaagactctctagctccactctgaattaactaaataatatacaatccatgtcacatctagaatttcactgtttgcttaaataataatcagaatcacaagtaataatcagaataaccatcctcataattgtatgtgccaaggaatgatgcacttctaatatacaaatgagtataagggatatagttctgacacacatgagaagatgttggtggagtattacaaagagtgctgaattcagtcactctgaacctcaattaaatatgctcttaaaactttttttttttttttgagacagaatctcacccaggtttagggcagtggcgtgatcatggttcactgtagcctgcatctcccaggctcaaatcctcttcccacatcagcctcccaaatggctggaaccacaggcacaaaccatcacaccagctaatttttaaaatttttttgtagagacgacggtttctccatgttacccagactggtctcaaactcctatactcaagcaatccacatgtctgggcatcccaaagtgctgggattataggtgtgagctaccgtgcccagctgctcttaaaaattaaatgaggattaaggccaggcatggtggctcatgcctataatcctagcactttgggaggccgaggcaggtggatcacctgaggtcagaagttcgagaccagcctggccaacatggtgaaaccctgtttccactaaaaatacaaaaattagccaggtatggtggctcacgcctgtaattccaagctacttgggaggctgaggcaggggaatcgcctgaacccgggaggcagaggttgcagtgagccgagattatgccactgcacttcagcctgggtgacagaacgagacttagtctcaaaaataaagtaaaataaaataaaataaaataaatagttaaataaaataaacagtgtgttagttctcagaacactgacatatcttttgactttaacaatcttagtcactagaaaaattcagtaggaaataatatattaagttctatcacatgattcttaaaaagctacataagtaagaaaataaagcatcctaatacatgaagaatacatactaaatttcagtttccatctaattaccatattgaaattaaagagtacacacacacacacacaggcgtggggataggggaaactaagtacaaataaagactgacaattagtagctgtgtcatctgggcaagttaacacttctgaacttcactttcctcttttgtcaaatgagttgctctgatgattaaattaggtgaacagtgcgcgtaaagcacctagtatctggtagatggatatcagcattaataaaggttagtttcccagcttttactaataagtattgggtatagttacttagtatggaagaggaaaaaagttaactcacagaagtgaattacttaggaatttaaaacattttgcaaatgcttttgactttttaattatttttatgaccaataagaagagtaatgaatttcaaatttagctcatgatactatcaatggggataaaatttaatatatcattatacagatgtgtgacatgtttagagtccctagaatgaaaacaagaagagaaagcaaggattgtacatctaaacactgcaaaataatttgcctaagcataaaaatatcttccacatacatagaagagaaaacaactggttatttaattatgggtaggaaaaaggaaattaataatcgtttaagattaacaggtaaaatctgtcgtctgaatatctatctacctatctatctatcatctatcatctatctatttaaaatccatctatttatcgatcatatgtttctagggtttcgagtgtatagaatcagaatgttaactctatacttagtccttaaaagtgagctgacacagaagagacatgtattgtggctttcatgttgatggcatttgaaaaaaggaacaaacatattcttcatgaaaaatttcagctgattatttttaactttatttttgcactgtcaccagctcagtcgatacctacgaataggaaaggagttagagaaagaaggatggcaaaaatagatatcatgaaaattataatgtaaaaagttaaaaaacttcagacctaatatttgaatgatggaaacaaaactttattcaatgtaaatatacctttaatttaagctttttcacttgatccttgcttttaaatggttcttagcttgaatttcgggaatatcctggcagttctctcattctttggaagacatgtttggttaactcattttccttttgttaacctggaagctggaggaggcaggagggggtcaagagaggtctgccactcctctttggagacaagagaggtctgccactcttattcacatttgccttgctaattaaaacctaaagaaaagcccaggacttactaggaaaaaaagtaattgggaagtcaacattagcactcatagttcctttttagtctatggagagtttgctcatgaataaactcaaatatttaatgtattgctattacaaactactgagaatgcttaaccaaggaagagagtagaaaatttatgaatttggaaataaaaatcagaaaatgctggcctggaaatttatgaaacaaaacagagcataaatgtctatgccatagcacacttctatattttataaaagtgtctttttagtggcatttaaacttcaaagaatattgttaactttgtacaatactttattacagtcaccaaaagttcaaaattgtcaagcacatgattttttttaacttgaaaaaaaatgaatttaaaagtcaacacaattagcagatgatctaacaccaaagcaaactaaacaaactcaaaaagaatgcattcttgtattttttaaaaattaagaacatttaggaagtataatctagtttttgcaatgcgagagttctctaattccattactattatcctgttagtaataaacagctttagtcttcatgagaggtttcttttaaatttgattttgtttcctcacatgcatcggttgtatattggtgttcactagtagttcagtgatctactagggataattacaactctatttatgcaacattatacaaaataaatattttccctgaatatcaacacagtatggttgtacttttttgtccttaaataacagactcaaagcatttgcagcacgattttgcttttgtttttgtttgttttgcttttcagctggtccacatattaaaggatggaagttacagaaatgtgtcccactgtccatctttttctgaaaacatgaaccatagtgttcaaactttgttttgtttgaccatctgtgatgccagccaaagaaggcaggattcttccccacaatttgcaatttagtttgttctgttttgttttttcttggctgattgacttacctaaattaaatgcctcatgaaacgagcttttaatctttgactccctttgaataacatcatttgaaaatgtaaaaaacatttcaggtagacgtaagtagagaccccagagtgaaattctccagatacgttacatcaaactgacccagagagtaggttcctagattatattaggggttattgattgaccaggtaaaatgtaacattttgacataatatgtgtgttttactctctggaaagaacagcggcactcttcctatcgtattctcagctctgaagtctatttgctgtactatatttctcaggttttatgcttgaaataggcatgttttctttgtatataaatgaatgtaaaataacaagaatcaaaatggtcctctgaaagggtgcaccatttgtgtttgctcttcctgatagaggaaatacagtttgtgctacgatgctttattattattattattaacttactctttttctctctctttattgctttcttttagatattgcttttgaatctaaggaaaatgggagtccttataaaaacttagtgtctgattttaacaacagtaagggcctttttcaccagtcaaggtctgtaatacctatggcttcatgagaaaaggattacagtgagaaaaggagtcctacagtgctcagagctttgcaagcaattgagcccatctggccacatgtgtccattttcatcagctccaaattttagaatttgtgttttatagcaccaagaagaaaatggcaacacatacttggataacttctttcttctcctctacttccttcttctcttttctttttgcttttgctatcttcaagttaattaaaagaccttttatattaaattggtatgtaagattttcccaaataaagaatttattggaattacaacagatactgctgtttccaaaatagaagaccaggaaagatattagatatagtctatctcattccttccacatttgaattctttatccttcatctttatcttgtgacgtgagtgtgttactatgccagaattatttctgaagagattgatgtcagttggtgtcttgtcagttattacagttaaattgagtaactttcaatttacaatcactattctgaaagtaatttttttaattagctaaaaatattaagctaccatatgcattgtatgtgtgtatatatgtatgcatgcatgcatgtattgtgcatattccttccatccaaaccccacactggcataatttacccactaatccttattataaagttgacaatcgttttaattacttggatcatttttagtactagcttttattcacactacaaggcttatatcttgttaccttttaatttttggattattcttgtttgtatttggttataccacatatttccttgaagaaatttcaacctttgataagtatgactacctcaataaaaagacctctccaattagctcacaagaaaaatggtccacttagaaaaatattttatcccccattgaattatcaaaccagttccacaattatcaacttaaatatgaatatgcagtatatttataacaataataatatattgtatatattcagagatatagtatattttctttacatgattttaacacaaattaattaaacaaatttagctaatgctagaattatagctggcatatgtaaataagcagcaaacctgtataagaaatgtataaggaaaggccattagtagtgtagttaaaaatacaagagtactaaacataataaatcaagtttattattatgtgctaagatgtgttctgtaaaggaaggctactgtaagaaatattttatacatttttctcatgattacttgacacatatttaaagatttcgagcatcttactttctttgggtcatggcctatgacttctcatgggtcaatcagcctacaataaatatcattaggtatttcaataactaaatctctgatagaacaaaaaaaaaagcttccttttgtgaattcttctttcaagtgtgcagtattgataaaatgaggacagtctgattatgtccctgtgcctctgcatttagtatcacttcagtctataatcctcctttcttcttggtagtcctttgccattccctttataaatattcatttataccatggaagtatcaacttaaaatctagttcaaccactggcagatggataactgatataacagtgtgaagtgaatgacttgctcagagttgtgcttcttaaaaataactcaaaattatttagtttcgtctgaatactctttaaatttaacctccatttaatctgtctttaatccttttctaatctacaatctctctatatggcaagaactgaaaagtattccactttttgtcaccagaattcatagagtacttatagtagtatcaacagtgtttactgaacaaataaaccctttccaatgagctgaccttcttaacagaatttctgacctaatgttcttcttgttcccttagacctgggttctatttctctcataccagttagatataatgcttggaaaatgaagtaaggaagtaaattgcaataagatgctagcaagtgatgtctgaatatgtcattctcattaaaaccatgtgctatggtctggatgtttgagtccccccaaaatttatatgttgaaattctaactctcagtttgacaaggggtggggcttctgtaaggtgatttggtcatgaggttggatccccgataaatggaattaggaccttcataaaataggctcaaggtagcttgtttgctacttccactaagtgaggacatagtaagaagccatcatctaggaatcagaaagtgggtactaccacagcctgaactttcagcaccttgatcttggacttcacagcctccagaactttaagaaataaatttgggctgggcgtggtggctcgcacctgtaatcccagcattttgggaggccaaggcgggcagatcatttgaggtcaggagttcgagatcagcctggccaccatggtgaaaccccatgtgcaccaaaaatacaaaaattagctgggtgtggtggcacgcacctgtaatcccagtgtaatcctcaactcgggaggttgaggcaggagaatcatttgaacctgggaggtagaggttgcagagagccgagatcatgccactgttctccagcctgggcgacacagcaagactccatctcaaagaaataaaaaattaaaaaattaaaaagtaccctaatttttatagcagcccaaacaaactaagatagaaaatttgtactcgtccaggtgcagtggctcacacctataatcccagcagtttgggaggtccagcaggaggactacatgagcccaggagtttgaggccagcctgggcaatatagcaagaacccacttctataaaaaatttagaaatatgcctggcatggtaatgtgcacctgtagtcccagctactcaggaggcagaggtgagaggattgcttgagctccaaggaggccaaggctgcagtgagtgatggtgccactgcagtccatcctgggtgacagagaaagatcctctctcaaaaataaaaagaaggaaaattggtaccagaaggagtgaggtgatattgtaacaagtaactaaaaatgtggaagcagcttcagaattgggtaaagggtagaggctgaaaaagttttgaggtgcatgctagaaaaagcctacattgctgtgagaggaccattcagggtgattctggttagagctcagaaagaaaagaggagagctgtagtagataaagccaccatcaactcaaagaacatatgagtaatcctggagagaatgttggtcgaagtatagatggtaaaagctattgttatgaggtctcaggtggagatgaagaatatgttactggaaacttgaggaaaggtgatccttgtcataaagtggcaaataatttggctgaattgtgtttgtgtcctagtgttttatggaaggtagaatttgtgagtgacaaagtagaatgtttgaagaaatttccagcaaaatgttgagtgtgtggtttggcttcgcttgaatgcttctagcaaaatgtgaaaaagggaaattatttaaagacagaatttttaatcaaaagggaaacaagtttaaaattaggaaaattctcaacttatttatatagaaaagaatgagaaagcacagataagattaatacgaatgtgccatctcaacagaagccaagagttactcatcaagacaatgagacctcatcacaatagcttttatcatccatgcttctaccagcattctcttcaagattacctatatgttttctgagatgatggtggcttactctacagctctcctctcttccttctgacctccaaaggacatttcagagattatgccctttccattacaaacccagagtgcaagtgcatggggagggtgggagcagaatgatttcatggttttgttcactgtactctggcatagtgctctttagccacctcagattttgctccagtaggccaaggtgggggcacaggatgcagaagctctctccagagggcacaggtggtgaaccttgcatagtgccatctctcctggtgcagctcatgcgtgtgctctgagagtgtacctacctccacctagatttcaaagaatagagtcacttggagcctcactcagagggccatcccaagggcagggccacttcaagagtccccactagggcagtgcctagtggagtcatggggatgtgggcacttttgtgactctggaccagcagggtagccttcatgtgattctagcctggaagagcaacatgtccctaactacaacccattagagcttcagaaatggctgtgggggcaggactacaagcaatgttggaggttctccttgctttagtctgtctgggagactggatatcaagtcaaagaagattattcttgaaaattaaggttttggactcactcaggacctgtaatcccttacatctttcctatttctttttcttttttggaagaggaatatctatgctattcctgtttcactgttgtatcatggaaatgcataacatgtttgatttcacacattcacagctacagatcaatttccctcaggatgaagtatacctttcgtctcatccatatctgatttaaatgatatttagatgagactctaaacttaggtttgtgagttgacgctagataaaatgaagactttgggggctactgagatggaattactgtattttgcatgtgaaaaagtcacaaatttgggcaggtgggagatggaatagtatgatctgaatatttgtgtaacccccaaaattcatacctcgaaatcctaaacatgaaggtgatagtatttacagattgccctttaacagatgacgaagtcatgcaggtggagtcctcatgattcgcattagcacccttataaaagaggccccagagaggtccctcaatcctcccaccatgtgaggatgcagcaggaagacggcagtctgcagcctggaggaggccctcactagaaaccatgctagccccttcatctcaaacttccagcctccagaagtgcgagaaataaattgttgttctttataaataacccaatctttggatatttagtcatataccttgtgtgtattctgttaaggtttatacaaaaattctcttggggttagcaggactgcagatagtaatatactatgttttttttcctatatacacatactataataaagtttaatttataaatcaggcacagtaagagattaacaataatagtaataaaatagaacaattataactatatactgaaataaaacttacatgaatgtgatctctccctctctaaatattttatcctactctgccatgggtttctgaagccatagaaagtgaaacaacctataaggggggtacttgtgaatatgtgtagatatccaaagtatatgtaaaacatattttaaacaagataggatgattaaagttggttaaattatagaatattgctagtgtttattgtctgagactatgaggcaaagataggttgctgagtttgtcattcatgaaatatctctattgattaatccatgtttcttctttatatgttagcaaccaaaattatatctggtacaaaagggttactgatatagaaattactctgcatctggatccagttttgttcctccaattaagatttttccaaagagtcttcatcacatcagaatagtaacattagtttattggtgttaaaggaaatgggtgaactaaacaacctgatgatggaagatactcaaatttatattaaatatatataatgatttacattttcactattaagattgtttgaacagaaatgaatctttgttttttatttgcaatagaattatatctaaatctttacagtgttagtaaaaatgatgattacattaattttaagaattttttgcttgcttttgtctttctttaaatatctgttttattacatctaaatttttgttgggttcttggtgacatggtataaatttaaatcaggagaaaacatcacaaatctcaacaatgatcaaatgttcaacatagtagtgatatatacagtaaaatatgaatcaaggaaagtaacttcaaagacctcaaccttggcaggtttcagatccacaagtacaatgtatgttagcatttttgtagagctctggaaactcaacattaatttttagtttttacttaaactaattaatcagcaagtgcttaatctcatactatttcccttttcttatctatctatatcgcaagaaattcatttttagatactcatttgtaatttagcaaaggctattattctttccattaatagtcaacatttactgagcactttggcatatactagctatattttatgaattatatagtttatttttcataactagttgatgaagtggtcatttgttatctcatactgtaataaaatactcaatcgtagaaagattaagttattaggccaaagccatacaaccggtaagcatggctcttgggttataacaaggtgctgcttatttctagtcagtgctcttatctgcaatgttcatggacattatggaaataaaagttgcatttgggataagtagctggataatagtctagggctataactcaatttcacagcagagtttttccactgtatctcactaggacttcatatgtcccttaattcctgagtgacattatatctctttcattctcttggcccttaagaaaagctagttatcattttataaatgtgatcttcttctgaatagactctcacatcctagaaagcctgcatctggtactcttctttccttggaacttaaaagagcctgagacataggcactgtgtagttttaatgatattcataacagaattgaaggttgatttctgttcctctaattctaataaatttctaaccatgctgttgccatggctgattagctaactcactctattcccttgttttcataacgtccttttgtaatttatgtttcattgtatatagaacatgtcacttggtgtttaatcccaatgagggattaaacaaatgtccagtcccaaaaagctgaaaagtgtctttgttttctcaaagtaaaaaaaaaaaaaccaaaaactattacttataataaatatagcatcaagagggagagggatggccagtctttttgttatatagatatttaccttgaaaatgtccatttcagacattttaaccagaatagtaatctgcgtttgactctttccaattatttagcaaaacaagatttgaaattattcccttagaggattcttgaagacccaggcaatgcctttagttacttttttcttcccctttttcatgttacttctttctttcccactgcccttccccttaaaaacagagacccatttttagaaactcaaacacctaatgcaatgcatgagacatagaatagagacttagtaattttcttggcttcattttattaaaggacatgctcttaacttcagcaattaaccaagtacaggttccagcctatatacgagtaattaaagcatgtgctttccttgatgtctaatgtttacttccagtcaaatattttgcagcctggttaaaacttttgtcactttatagatatttaataatgataggccaggtttaatgtcagtttgaaatactgaaatatggctcaaatattaattagcctgatggaatgattttattcacatggaattaaaagggttagcaatatacacttttctagactagagcaaaaatggtcctgaaaaaacaaaatgaaattttgatgagattttgatagttttcaaaagcacattaataaatctctgagatacatccatttcctttatttgtaatatattcagccttcagttagagtgtggattaaatttgacttctgattaaggatgaatgcaaaactgtttagctcaaaggcccttttctgagactctcaccttgaaattgcatgggcaacatgtggtttgtgtgtgtacctcaatagcatctgaaaaccatgaggctctttcccaaggaaatgaagctgatgttggtgatagcctggagcatttctttcattccagcctctccctccctctgtaaatctactgtcaaaataatttattttgtcacagaatttatacattatctgtaatctacaacatttcaaaagtatttttgcaacttgaaatattttcagcaggacacagtagctcatgcctgtaatcccaacactttgggaggccaaggctagaggattgcttgaagccaggatttcgagacccacctgggcaaaatagtgagacttcatctctacaaaaattaaaaacattagttgggtgttgtggcatgcgcctgtattcccatctactagggaggctgaggagggaggattgcttgagcccaggagaagttggaggctgcagtgagctgtgagcacagctgcactctagcttgggtggctgaacgagaccctatctcttgaaaaaaataaaaggaaataatttttttatttctgttttgtttttcttctaaatagttgtctgcagagtttcctgtctcaaggttttttgtttgtttgtttgtttgttttttgcctcacattattcattcttctcctttcccatgaagatcgacagacattttatatcaggaaaactgaagacagttgtgagtgttttgatgcctacactttccttcttctttccaaaaaatattaccaaactaaatgggtgctagacttcactgggttactgactgtgagactttagacaggcttcttaactgtgattttgtttcccaatttgcaagacagcagtactcctagtaagagtgactacttttcaatgtctttgtgaattgttaatatttgcaagagtatctggcacatagcactccataggaagtcttacgggtctttgggattatatcaaatgatctaatatggctagggcccctgttccaatataggaacggatgcctgatgatccattttagaatatgcattgataagcagaatttgtgaatttgacagaccagtagagcagatggctgtgagctgcctgctttacacataggttaatgctaacattttccttatgtgctccttcatgcgcctactgccagttaacatttttcatttccatatgctttattttcctatcttctggtcctatataacattttcagcttatagttgtagttttttgtttcccaaggccaaccgttatgatcctagtgacgtaataaaatttaaataattgagagaaaaatatgggtaagcttatacttaattatttaagggaatacaaagtttggctacagtctccctatctggacagtgacataaatggccttagttctaggcatgataatttgtccagagtttgaggacattctagaatgttcaaaccccaccacattagccacttatatacatgccttagttttctttccctcttttaatattatactctgtagtgtactctgaaagcttgggagtttttttgttgttgttgtctaaccactaaccccttcacactggatagaaaaaaaaaggacgtttatggtattcctattataattataaggggatcaattcatattatcttgcctttctttttgcaacctacaaatcatccttttctgattacttccatttgcagaagagatatacttttcctccctcataaactgtgatgtacctgtctataggaaacagattaattctcctacactaagccagtggcctgccaaacacattatggtgaactttcaagccctagaagacacagattcaatccagggttgaaagcctattcaacagactaaagttgaattagaaaagtatttgagagtctcaaatgtatgtgtcttagacatcttttattttcaataactagcagtgattgatgaatagtagatactttataaatacttgttaattcgattagtaaaaaagtaaatttgatattagaccaattttgttgagcataaaatacttatcaagtttaatttagagagaacttacggtaaaagcaataggctgatttacatagaaaaattaggaatgtggacattttgcagttatttttagaataataagctttgaaaagttgttgttctctgaaatggcgtattttctctctctctcttcagccatgcatttgattcatttacatgttcaaaactagaagaatatctcaaatatctcttttatgtaagtgattatagttgctatgtcatttgttgtctgaaatcacttgttataagtttgttacaaagacaaactttaagaagagtgaggaagtaaaccacaagtatgtaaaaacaaaaaaacaaaaagaaaactggcaaataccaggatcaaattagtacaataaaaattaaaggaaaggatataaatgatttcttggtttccttagatgacttttaacatgcttgttaaaattttccaagactagaaaaacaaagttatcactacttcatttttctctcactctcccatattttatcatcctcttaagtaaactacaagacacaaggctcattccaggttaattatgcttttcttggtgctaaatggttaaagcctttagttccaaagattaacttataggcatgtcttctaaccagtggttagaatgcaaaacggtctttgctctgatcctgacaagcttcctgtctgaagacaacaaatggtagttggctcttgttagtatgtggaccaattagaaaaagtttttaaaacaaaaatgaatctcatagcctgtaatgattgtggtgcttattatggagcagaaatcagttatcgtacatacttcacagactttaaagttttttgcactttactcctcagtgatatgtgaacatggtgtcactgctcacgtttttttcttattgaattggtccacgctgtttctttagaatgctccaacccacaaagcgggggacgtaaattaaaatccaagaagcaatattacaaattgactgtctttctgctgatgattataccgtattcatgaggttttctttcttaaaaaaaatcaaaataatatgaacgtgactttaacctctaagtgtcatctgggtggtttgaagtgatacagcttctgagggaagtggcctgaaggacctctgctgtgtcataaaagataactcttcttagaaaactgaactgtacctacagtactgattagaaatagggatggcagcatgtagctttttattaggctcacctgaaaatacacagttgcttttcttagagttcaatttgcagtctagaagaaaagaaagagtaaacagatgatttcagacaagtgtgatgaatgtttgataatagtgtgatatatttgtgataattaagtgaagccatctaggaatgctatggtggctacctaggaaaagaatctccgaaattttatatgtacatttttaaattatttagagagcagagtcccttcccatcacctccatctttaaaaccttagttaagttcccattatcttttatgtggtttggcgaagtaacctcagaacaaatctcttggcttcttcccataacgggctatgttcaatacagcagccacattggctcttgaagcttttaaatcatatattatttgctttctctacatcttccagtgtcttcccatttcactcatagtaaaagttaaagtttccaagggccatgatccagtcccccccgcctttctggttttatcgccacatgccgtcttccaccaatccactccagacacacaaggcttcttgctgttcttcagagatgcctgtctgccttggagtctttcctctctcaggtccttttgcagccaaattgaaaagacttctttcatgtgtccacctggctaacattcttacctccatcatgtcttttctcaaatattaccttcttgataagagtctcaatctggccatactatttaatcctctatctgcccagtctcctcaagcaggcattcctgacccctctaaccttacactaatcttacttttttaaaaagagcacttaataatatctcctaatactatctaatttaattattttgcatttagaattaggtttctactgatctgaggacaaattacacaaatatagaggcagcttggagaagaatagacttcctagcttattcagagtgttgataaaactttgtggaggtttcattgtccttgctgatttccggctgatggccgcccttagcgcttagagtcctttctccatttattgcatgtggatccctacatctcagagccagcaattgctcattaaatctttcttaggcataaactatctctgatttccccctctgcctcacctcctttacacttccagcgagagacagttgtctacttttaaaagatcatatgattagattgagcctaccatgcttataagaataatctcggctgggcacggtggctaacgcctataatcccagcactttgggaggctgaggcaggtggatcacaaggtcagtagatagagaccatcctggccaacatggtgaaaccctgtctctactaaaagtacaaaaattagctgggcatggtggcgcacatctgtagtcccagctactcaggaggctgaggcaggagaattgcttgaacccgggatgtggaggttgcactgagccaagattgtgccactgcactccagcctggcaacagagcaagatgccaccaaaaaaaaaaaaaaaaaaaagaataatctccctattttaaggctcacaacattaattatatctacaaattcccttgtgccatggaatacaatagtcacaggttttagggattagggtagggacatctctgggaaatcattattcttcctactacatgtgttatttgttatctgtctccccctgttagaatgtaagaaagattcctgcagtcaagaatctgcacctgttttgtttaactaatgtattcggtgtctgaagggaggcctttttagccagtggctgctcaatatacagtattaaatacaggaatgaataaacaaataactctcattttcactataatattaaggtattgccctattgattaacgatgaatcagaaaaaaataattaacacatggaaattctaaccttactttgaatgtatattttaggttaaatctgattacataaatgcattcccatatccttctctaagaatacacaatatgagaaaatctactaaaagccaaaggacaaattaagaaccatattttcatggatataaattgctacctttggtgacatttgaagatatcatggaattctataaagaattcacaaagattccagttgaataaaggcaaaatatatgaataagcaaacagaataaaaagtaagatatctaataaaaataatgattactgcattattagtaaaatgactgaaaataaaaccaaagagtccattttaagcttgaaaagtagtaaataatttgtaaatgattatactgaatgtagattagggtgcaatgaaatggacatacatataccaccagtggaagtataaactgctgcattttggaaagtgaaacaaaacaaaaaacaaaacaaaatacaccagaatcttaaattagctcttaggttttagcctataatgcacaatggagaaatcatgcctaatgaaacagaaacttgggccagaattaatatgcacacctattcattgcaaccttagaagaaactggaaacaacctacataatgttttgataagggaatggattgtattttacaaataatacaataccttttaggaaatgagaaaatattcacaatatattaaatgaaaaaaatgaataaaagttcatactgtacatagcatagtatatatttctatatttgtacatcatataattaagaaaaaacatcaaattgtcaaacagtgagtggcagtccctagagagtgaggttgtatatgatttttgtgttctttctaactttacaaaactttataattctcttcagtaaggatgcagtgctttaatattgaggaggaaattatttaaatcattatgggagaataaatattatgttcaacataggatgaaaggctgagtcattgaaccacacctatttctatcagtagccattaagtccaaagaatagagaaatgaagaggaaataagccaattactactttaaatatttcatgtctctttctgtctattctttctgatttatccctagaagaagagaaaattaataggatgtaaatactaggatatgtcatgttttctctctttatcccaacccttccctggtaaatgctgctcctcagacttttatttcgtttccaaatctactgctattttagtgtctgcttaataaagcatgctaaatttgtaccataattaagtacatagttaccatattgtcagtcacttgtactacatttaataaacacttgtcataattcagaaatttgtattgtttttataattttgtcattttaaaggatgctggaatgaactacttaattacatagattagtttgtgattatctctctgggatagatttctgacttaactggaaaattttattagttttattaaaatttatttccaaatttttttccaaaatgaaatctaatttgcacgtctaccagcagtgtgagagtataaccttttacatatgttaattcttacaactaggaacaactcctttcttgaattaaaccacttgcatagtatttccacataaagagatcaattaattttcgtttctctggaccattacctaggtttagacatttatactttataggaatattttagttatactgaaaatgattgaaaagcttaaactcaaataatccttaaggttttcaattgtttctcttttattcaaatattaactgtacaggtgctacttacaatgttgagtcacgcatgaacataaataatgttttggaaatgttctttgtagaggtaaatcttttgattaaatttatatgattgcttcatgtgtcatttatactgtagcaattcaagcactttaaatctccctcttactgccttcatgccccaagtgcttggaagattatgcaaaattatgtgacaaaggcacagattctgaaaatagaaactgtaactgtcaaagtgattttgcatttcataattcaagaaaggtatttggaaagactctgaaattggacaaagtattgcaccttcaaagtcaagtgtgtagctttgtttggggactgatagtttcatttttttccaccagcgaggaatagtaacattgcttaacattactactccccttatcttcgagaaacaggcaaaacataaaagatatgttgagaaagagaaatgaatgattaattctcagatattttaaaaagcaccatgtaaccatctttttcatggctgaagactttgtggaatttatatatatgacagaatggtacactctagcagtaatacatcagagtttatattcatcaggagagagccaagagaaaaacataaaatgagggtatggcttaaattttatttagaaattcaattaagaactgtaagatgaagggcacattatagtttcttgatttaaaaaggattttaattaattactttgtacttttgataaagccgcatagagccattcttgttattaatcatttttacataagcataatgcatatatttattagacaagaaatacatagaagaaaataccttttgagatattgcttagaaagcaccgattaattattgctataaacatcattcattatttcagactccaaaacttataaattacttttaatatttatcgaaactgagctgcagtttttcatcattgttttcatgggtaaagtctttatgatgcaaacaatctaagatacatttaggggtaagatgagaaattgtctttaaatacttaaaagatatctgtcataatcactccctcaaaataaggcaaataaaccaacaatcctattatagcttaaaaatgataggtaggctgggcatggtagctcacacctgtaatcccagcagtttgggaggccaaggcgggaggattgcttgagcccaggagtttgagaccaacctgagcaacatagtgagaccctatctccacaaaaaataaaaacttagcaatatgtggtgatgcacacctatagtctcagcttcttagaagactgaggtaagagaatcactggagcccaggagtttgaggttcccatgagccatgatcccatcactgcactccagcatgggcaacagagtgagaccctgtctcaatttttttttttttaaacttggtattggcccattgctgtggctcacgcctataaccccagcactttgggagcccaaggcaggcggatcacttgaggtcagaagttcgagaccagcctggccaacatggtgaaaccccatctctactaaaaatacaaaaatcagctgggcatggcggtgcaagcctgtaatcccagctactcaggaggctgaggcacgagagtcacttgaccccaggaggtggaggttgcagtgagctgagattgcatcactgtactccagcctgggtgaaagagcgagaccctgtcttaaaaaaaaaaaaaggttggtattatagaataaatttcttttctcacccattgctatgttcatggctgatgactctctataacaaaataaagatttaacaggagaaaaacatacaaatttatttaatataaattttacgtgacacaggagccttcagaaatgaagacccaaagaaacagggaaacatgaatttttatgctgagtttgatgaagagtggacaattgtgcagctgtatggtgagacaagggtatgttctatcagggaggccttagcaaagcccactttttagatacatctctgagtccctgtatcttcagagataaggacatcccttttctctgggtatagagtgggcttcagaggaaaatcagataatttttatggcctgtttcatgggagaacagaagaaagttcaggagaccttcctttttttgctattttctcaaatgccaaggtgctgtattttggcatagcttgtcctgaacaccatcattatggaaagctaaagcacgcaaattcaaactccatttgaactggtgatggtgatggtcatggaaatgatgacaaacagcaggaagaactgttagcaaactaagagtcattcaagtagtagagggtgaggatatgagttgagacaatggcagtggagatggagagagtaacttggcatttgcctgtgatttgtcagtttaacggacagcacctagtgatcagttcattgcaggcagaaaatagagagggaaaaatacaagaagaccgcaatattgaccatgaatgtgatcatccaacattcatctagacagcataaaaggggagtttacaaagaagactgataaggaatggacaagaggaaaaaaatcttatttccagattccagaatggcaaataagagaagatttttaaggaagatgacagtgtcaaatgcagcaaagatgttaatttggttaagaaaagaaaatgcccaactgaatgagcaggtaggacatctgggacttaacaagagtgcttttataggattgggggaaattagactaagttgataagttgctagtgaatgctgttggaaatggaaagtggtgactaggaataagaggaaaagaaggccactcagcatggacgctagagagagaaagtgtggagagaaagtctgctgtttttaacatgggaaagatcttaagaatgcttttgtgttgagggaaacaagaaaagtcaagagggagagattatatactgaagagagttaagtgatggtgccaaatgcctgaagagatgaaaaggtggagaattcacagataggtgaggagggaatagtccttcacaggactacaaactctttgtgaatggaacagaagagaaggattttgaaaaattaactataatacttaatgggtacatttttaatgttaatgtgtgtgtgtgtgtttgtgtgttccagtatcctcagttgtaatttccctattccatgcaaattttaggacaaagatgaaacatacatgcatatgatattttgtaaactacataatgctatacaaatgcaaaaatttaaaaaaacacatttttaaagaacagtctatgctctgccttctcttttcttcttttacattctcctcttccactaccttttctacatcgttccagcaacattacaaaatacacatgctttgtaggctagaaatggaacttctgtatcatttatagcatttcattggaaggataatgtattccttagtgagctggaaatgtggcacctgaggacaagtttagccttctgattgtagcaaataagactctgttagagaatcatggctttatggcttttcttttctccttttgtctctctctctcttttttttgcggggtgggggggcgggggtttctggggtttctaccctagcatacaccagtcattagtttttgagtctcctaaataaggtttgtgaaacatagtagtaacaataccacttggtttgccagtgtaacattctcctgttttccaaaagctcctcgaggtctgaaattccacttttaatgccttttaaagatgtgctaatactacctacacagagctacgaatataggcattgaggaaaatttaatttggtgaatgagaaacaaaccgtgaaagtcttaagtatttctcctagcccacataagatagacaccaataaactacacgcttgtgctaacttttgaccacaaaatggaattgtattttcatacttttagatcccatgtcctaaagccaaagctttacttgttacgaggcatttgaatattgataatttactgtctctcatctgtcaaccccttgagaatgaccgtattaattctacttcacaatgaagcaatcttaccactcaatggacatcataatttatcacttaatttactcagcaaaactgtgcaatgacactggctggcatggggtttccataagagagctttcaggtgattgtgctggcgacatggcctcagaagatgtagcatagacttctgagtgaattgatctgattgagtagatagacaggatcacacaacagctgtaggctatgggttggccagtaatttgctgccaggtagcttagtaccaaacagatcatcacccaaactcacagttttatttgatttaatcattcagtgttgatgtgcaaacataaccaaactataacagaatttgttggtaaaaatttaagccttttggtgagtacctcatttctaaagttgatcatgctggttgtacataattaggctacattatcgcccttttctggcaagcagaacaaaacatggttttctctccccctccccttatttcccatgtaatagctcggaatcttaatcttaaggcattctaagctttcaaagtcttttttaattatacattttcctgtcatcttccctaaagacacttttactgttttcaaggctggaattccgttctattttttatccctataatgcctgttgaaataaatggaggtaagaattaatgataaactaaatagataaaaataatgagcaattgtgtgattattgtttttggttgttaatttatctacttgatgtgtttttattgagattctactgttaattagacaaatgaagcacccagaacagtactggggacataaagaaaaaaaaaatgccggccgggcacggtggctcacgcctgtaatcccagcactttaggaggccgaggtgagcggatcatgaggtcaggagatcaagaccatcctggctaacacggtgaaaccccgtctctactaaaaatacaaaaaattagccgggcgtggtggtgggtgcctgtagtcccagctacttgggaggctgaggcaggagaatggcgtgaaccccgggaggcggagcttgcagtgagccgagatcttgccattgcactctagcctgggtgacagagcaagactccgtctcaaaaaaaaaaaaaaaagaaaagaaaagaaaagaaaaagaaaaaaaaaaaagccttaccactaagggttttttttttgtttgtttgtttcgagacggagtcttgcttcgtcgcccaggttggagtgcagtggcacgatctcagctcactgcaacctacgcctcccaggttcaagcgattctcctgcctcagcctcctaccactaagggttttaagtcttatgtgttgtttttcttccagcgttttgttcattgttggtgtcactgatataaatcctacaaagtatattttaatattcactaaacaaatgtaactggtagattttaaatcggagccagatataaatgcctaagtataaggggatagagagaacagtcaaaatgtttattctgtataaatagtaagtagaggaagataagttgcagaaaacaataaagaaaaaataatagtcataaaaagaagggaattaaacattgaatgtacagttttgtgagtttgagagagaattcaaatgaaatgttacctttgatagcttgggaccatgagtatacacattgaagaataaagattttgacattaaattgtgaaggaaacaagaaaaatcatagtaaaggaatatgcgtgctgcagtataatttctcataataaatatatacttttaaatgttctgcaccttgaattttttttctgtttatgattgctctgtcaacaaggttatttttaccagaacattatgcattcaaactggaagaacattgtcaggggaaaaagggaagtaaattggaggtaagtgctattcttataccatatgtaagccttttaggtgtcactgcttaattatatattctcagtgccacactccaagtgtacacttggatcctctttacagataccttctctgaccacatcagctgacccatggtgacttttctttcctctaaaatcctagagcttgttatttttatatcctaaatttgataattaccatgcattgttatacagcatttttttaacaaaaaaacagacatgatttgtttcgtgatttttttgtaaactctttaggaaatctttaaaaaatcaattattgagcattcagtgtttgctgggcatttcactttattcttatacgcatttattcagtctgctctagcagctataaatgtgttatgtgtgctccttagaatttagccacgatgccatgccatgctatgcagggtgttttagaatctaattcagtcatattaaaggtcttctgaggttcccgaagagattgaaataaatcttcttctaagataatgaagcagcagtagctagttattttgagaatacagaagcagatgttggacaattattcctcattctctcttccaactatgcaaatagatatttcctatttccagtttctgtacctgcttttcccattttgcaatttctgtgggtcctttatcttctcatcgtcaagtaactgggggacaatgaatttcaatgtcagaccccttcctcgtcctgttcctcctcctttttcttttgttgtggtgttgtggtatacttctttaagatggatgcttccttctttcttatgtcttatctttgacatttctcttctgtacattcccttatttgttgcctatgatatttgcaagtatctttcaataccaaaatttttaccaaaaacctggttttctttcttggctggagaggaaataacttctagagaggcagagggctcatcaaatgaatacaaatagaacctaagtatttgttgaaagagtaagatttgttctataatgaaatcaagtaaagttacttattgagtacacagggtacaggtagatacagttgtgtatatatcaattattctgtcctcaggcaatttgaaatgtttttgaagaagcaacaaatacaatgctagaaatagttaaatactaaattgtatcttacaaactttgtactacatagagactcaaaatcaagaaaagatgatatgaatataaagaactaagggaaataactgaaaagatgaagtttgtgctacatattagggaatttttaaagcaggatggtgccctgaaatacattaaattgcatgaaatacagcaccacagaacctgagttcaagtcacacctctactacttaaacgttgtgtgtccatagaaaaatcctttacattctctcatccttgattttctcatatgtagctggaaataatcatgatagtttaacaataactatcatttataaagccctcatcaaataccagaaaatgtataaatatatagtttctataatccccataacaacctctccaaaaaatagttttttcttcatagcgtaaagtataaaatgagatggaagatgattaaaacacttacctaaactctcacaggcaaaagttagtagagttggactaggacccaggtctgcctggctcaatactgcttcctacaagactcttgagagaattaatgcagatgaaactgtaactctcaaaataatattgatttctatacttcagtattttttgagttataagtaacctgggcatacagtatttaagctatagttctatatcatggaaaatgtgggctcaggcagttaattgaagagccgtatagtatcatggtagactctgaagccaaaccactgtgggtttgatacctggaccagacaccaatcatgtgacctcagtagcgtcatttcattttatggtgcctcaatttatcttctgtaaaattaggttaataatggttccattctcaaagcgatgttgtgaggataaaatgaaaatatatgaaagttcttaagacagtgcctggtacatagtaagtgctatgtaattgttagtcaccagatgtttctaattcttgaggtatctaaaaaggtgaggcaaatgcacttgataattagaactttacattctctgtattttacctctcttaatctgggtctcttcaactagcccctaaggttacctccttgtatccagaatacaattatatagcatttctttctgaagtatctctgtatgtgtgtttacatgtatttatatataaatatctctatgtttgcatgtattcatatatgtgctcatgtaatttacatttatagagataatctatttataaagatacttatctattgatctataaagaaaagaaaatgtccagatttgcctacgctttcttttattttggcttttgaaaatttcctaggtaattcttccctcataattcaatgttaggtcttagttttttggggtttgtttgtttgggtttttttttggtcatctttttttatgttataatttaagctctgggatacacgtgcagaacgttcaggtttgttacataggtatacatatgccatggtggtttgctgcacccatcaacccatcatccacattaggtatttctcctaatgctatccctcccctagtccccaccctccgacaggccccagtgtgtcttgttaccctccctgtgtttatgtgttctcattgttcaactcccacttatgagtgagaacatgtggtgtttggttttctgtccttgcaatagtttgctcagaatgatggtttccagcttcatccatgtcctgcaaaggacataaactcatccttttttttggctgcatagtattccatggtgaatatgtgccacattttctttatccagtctgtcattgatgggcatttgtgttggttccaagtctttgctattgtgaacagtgctgcaataaacatacgtgtgcatgtgtctttatagtagaatgatttataatcctttgggatatacccagtaatgggattgctgggttaaatggtatttctggttctagatccttgaggaatcgccacactgtcttccacaatggttgaactaattaacactcccaacagtgtaaaagcattcttatttctccacatcccctccagcatctgttgtttcctaactttttaaggatcgccattctaaccggcatgagatggtatctcattgtggttttgatttgcatttttctaatgaccagtgatgatgagctgtttttcatatacttgttggccacataaatgtcttcttttgagaagtgtctgttcatatccttcacccacatttggatggggttgtttttttcttgtaaatttatttaagttctttgtagattctggatattaaccctttgtcagatggatagattgcaaaaattttctcccattctgtaggttgcctgttcactctgatgatagtttcttttgttgtgcagaagctcttcagtttaattagatcccatttgtcaattttgacttttgttgcccttgcttttggtgtttcagtcatgaagtctttgcccatggctatgtcctgaatggtattgcctaggttttttctagagtcctaatttaaaaaagaaaaaagggttttcatggttttaggtcttctagggtttttatggttttaggtcttacatttaaatctttaatccatcctgagttaattgttttatcagataatacatataggagtctagaagtacaaatgtgactataataatgaaagccttctgcattacataaggtagaacagaaaaaaaataaaattcctcagctttgaaaatatgtttattaggaaaagtctgtttgttcacttaaagttacaggctaagtttgttattgaaaattgatttgtgcacttgcctcatgactattagtgcacagtctactatttctcctcaattttacccattccaacacttatgaaacacatagattctcttgctagtcagaaaatatgaagacctgggtttactttttgtttttcatgcttgctacacacgaaagtaaatatgagaacctgtggcataaattgctagttaaaagaaaaatggtcctttacttcctttctaacctaacacatatttaaacattgtgagtattgtaacaaacttaaacaaaatggtgactatactgtttttatatatgaacatgatttaaaagttataattatgtatgaattcattctcagctcctatactttattaagaaaaacctactaaatgtatatgttttgtctgataatatatcataattattaatatgttcattgtctataattcagtcatgtttattttctaggaatcatcatgtacatttttgattgccttatagttttcattgtaactctcaaaaatcaagttcatattgaataacatcattttccaatcactaggtatttactttagtaaattatttaaaaaacattttaaaaattattgctttccaatacgtttaatgttatgtttggcacttgccataaagtcagaaatttaagtatattaaagacgaaatattgtatgtagatatatattataatatgcctcatcatattttttattctgagaagaacactgtggggaagtagataaacatcaacactctgggatatgactacatattgtgaacttattttcaaaactggtataaactttgaaagtgttcttttcattctgcatcaagcttttttcttttttaaattaggactctaatttgtttaggtgtgatattatgttgcaatatttgaaaatctaagcgtatcagaaatagtttttttgtttctgttttttgagctggcttttcactctttgtcacctgggatggaatgaagtggcacaattatagctcactgcatcctcgaactcctgggctcaaactgtcctcctgcctcagcctcctgagtaactgggaccataggcatgaggccccactcccagataatttttaaaatttttttgcagagacgggggtctcactatgttgaccaagttgtcttgaactcctgccctcaagtaatcttcccacctcagcctcccagattgctgggattacagggatgagtcaccacacctggctagacatagttttaaatctttaatacataactttatatttgttgtcaaaaattattcattttaaaactttctaataattgtggttttgagtgtaattcatgatcataatatatttttgttttaatttgacactttatgtttaatcatgtgaataaatccacacattttaatagttatatagttatgaaattctcaaattaaaatgttacaattttaaagagaccagtaacaaatatagagaggcatgtatactagcatatataaagagaaacattaagtcttctttgtattctgttttagatacattcattcagaaagcaatacagtagtctctctggcttgtttaaacttaagactattttttgcagataaaatcaaatagccacgcctatatgatactctttctgatatggttaaattgctatcacagttgaggttaagtttaagatggtttcttaatggtaaatattgggagtctaggaccttttacactaggttacagatgccttcttgctgatttactgtgttctaagtcaagaagctttgtttctggtccaggcttaaaaaactatgtctccttcagttgtttatgcaaaacctcagtggcttagttcttttatttttttaagtgaaaatattattcttttgtggatagtttaaaatttcaaatgaatgaacagataaaaaagcaattaaaggaatgccacatgctaacaaatgtgtagcatttttattataaaaattttttattgtgatgttatttatattcatgatggtggaagtgatgaactggcattttcatttcataaggggaaaaaagggagccagaatatgcaggttcacaagcaattttgtatttggagaacatgattaaacaaacttaattgtccttcttcttctgactaagccactgtccaacccaaacttccagtgatcagttgtcctggttttggtaccaaatgttcgtttatatttatagtcaaaatacaaggttttccaagaaaaccttaggttcctggtaagccagtatgattagtcaagtcacaaatacatttcctcatttcctgtacaggcacaggtcacaagattttcttactattgaaagatggaaaaatagctggtgatcatatcaatgtagaatgttaactgattatcaatatcacattcagatttcattggcctttgaagcttataaaattttgaaggaaggaggaagggcttctaaatgaatagaatatgaaatagcaaatcaaaaaccagaggctggtccttggaaacagactgtgcaaataaggggccttaagcttaaaggtgatgggaaattagcttctgctgattataaatccacttttctctttctctatacccacaatttaaaagaaaaagctgttatctgtggtattttaattttaacatggcaaatatattcatgcattaaatgtgtaattatatttttattttttttaataattgcaatttaaaaactttaaaattttcccaaaattgaagaaaagtttgaaaaatgaaaacctaaaataaatagggattctggttttaatataaagcagtatgtttggaagtaagttattttgccatagtaagtacacagattctcatcgatgtgaaagaaatgaacgctttagattccccacttaaagcaactataaagttttttaatttctcaagcctgtcaatctccagataacaaagatgtttgacacggcaagctatttgtatcccttcttgcaattattattattattattattattattattttaattatctggtttctttggttagcagtaattcaaggttcatctaacaaacactttagtttttaagactttggaagattactttcttttttagctgcaaaagcttctgaaaaaatactggtctgatctgatatttcctgccagaatgtgcttggctcatgaagaaataaaagtaacgagatgctcaaatttatattattcccatgcttctgagctttttctttgccctaaatgtgatccttatttccatttaggcaataacagacttatgtgttttatgtttaaattaagaaatctcattcaacagatattttttctttattttttattttttggtttaaaaatatgtatgtctacctctggacagcaagtgtaagtgggaatgtaggctgagccacattgccatgtaaagcagctcctcatctgttcctagcagatgttagcaaagtcttgcttcctgacaaggttccagaaacatcacaggatatgtgcagctcagtagggtctctctggactgtttaccctgaaagttctcctgcttgttgaaggcagagtctatatttatcttccactcaaagatatttgttgaataaacatagatttttcttgaaatctggctaggactcaaaggcctacttgcatgagtctgtattataataaacatttttatgtgggtcaaaatttttatgtgggtcaaacatttttatgtgagtcatgagacatcagcaaaactagatattttatttcaatgtactatggcgacagttttccaccactttaaatgctggaacatttgcttcatgaaatgataaaagttaatgatttctaagcttcatttttgtctttgcccctttgacttcagtaattaactatgtctttttcctttcctcaacctcaccttaaacgatgttatttatctatttatttattttcttgtacattcattattcactcagttctttacatacgccttccatttgatgcgctcttcaggagatctgagtgttaaaagtttgaaattctgaaaatttgataagataaaagggaacttaatttaaggtcaccctgttacagacagaattaccgggatgtgcacagctttgcctcacagcatgccaaaagtcgtctcctttagccctctatttgtttgagtgatgcatatgagaataattaacataaagaggtgtcagtttaaaataacttttaattagtgcttctaaattgcttaaatcaaatctttgagatacttatattaaagggggtttatagacaccaaagctcaccaaagagaaaacggaatgtctgacactaatcaaatgtagctgtgtgtttctagtatttgctggtgttgacattgaaaattagaaaaacattttcaaattcatgtattttactgtgagaatgacttttagagatgatcaagatcaaacctgacatttaataattgataaaaccaagatcagagaaatgagttgccttgattagtgtgttatatttatatgcatacctgtgacaagaaaaaatacaatttaaacagatgtccaaagtgagatggggttgacatataaccagggaaggccgactaaccggcatccacagagtgctaatggctgccattatattgtgtctgactttcactccctcaaacctcggaaataactctgaatggatcatcccgtttcttagaggcagtttcacacttgtctattcacagaaactgattcctaaaaactatggcaaaacaatgccaccctatttataatgagaaatcgctgtcacatgagcagaaattctggagcagatttgtgcattttctcccttcggcaaatctacagtacaggcagtcacaatcaaaaagttgctagggcagcatgaaatcacagcagagtttgcactgaaaggaagtaagaagtgttaccagagtttggtccagaagagcttcacagaggatatcataccggaggagggttattatgtgtctgccaagagaatggagaatatgattccagccagagagaacagcaccttaaaagcatagcatcaaaagtaacatgctatgtctctagtctagtgtgttacattgtaaatatgcaagggctggctagacaggagatggtaggagtggaaacagccaggataagggttggaaaaatagaaaagagaccagaccttgaaaaatttggtccattctatggtaggaaaagaattcagccaaggatatcaagaagaaacatttagagaaataggaaaaattccaggagaaactggtgtcccggaaaccaggagcagatgttagggaaataaaattagaaacaaaatctcccaaactggaaagcctctcccacaaaagtaaaggagaaagaaaccggtttaattattgaataagcattaaactggaatgtaacctgcatcacagaaatccactaaagagattgcgaagatagaaagaaatcacccttttatgtgtctgagcaggtacaactcatttcctacgtgttcccaagataaacaataactagttctcaagtaagagaacttgacagcatcatttgtcacacataattcatcctaacttaatttggtaattggggtgaccatgcatattgtcatattagctagttggctttatccaaaggaaaaacgatagtatctttacgatggaaggttgttttggcgagaggcaccagccaaagttaggctcctactcttccttaggaattgggtgacagagacactatcttccctgatgattccatttcaaaaagttacttccctagtctttgagaaagacattctggggttgtaaagctggcttattatcttttaaaaagagttacatatattgcaaagagaagaggaagaagtgaaaagttttctaaataaatgctttaagaaaaggacagagaaagtttatttccttattttcaacagggagaattaagcctcatatttaatctgtatttgcctttagggaccgttttaaattgagagtgatcaacacctcaaatgctgaagttctacggattacaggaggggcacaactaagagtctaagggaagtcatattgcagctcaaagaggcctgtcctctacttccatgggtagcctctatttgtaagagcatattcaaggagccagcctgcattgtttctgtctgagagtcaagatattcaccactaaatagttaaatggcttctctcttactatccttttaaagtcctttggctctatgcttaaaatgttgtttgtatgtatttaagggaattatgttagaatcctctacccttgggcattttaaagtacttgactctggcaacaggttttattcacagctctctgggaaatccctccccccttttttcaccctgaggcccaaggactgcaaagtagggcggtattttgccttctcacttctgcagctgcagggggtgagtgaggctgctttgctttctgaagtgtgtgtgtgtgtgtgtgtgtgtgtgtgtgtgggtgtgtgtgtgtgtgttttcctgcaaaagggtaattgacaagttctctgtaattgttcaaatagctttttatttttcatttatttattgtctaaagacattcctagaaagcagttttcaaaaaaagaccctatagattaaaaataagtattctacatgtatgccatttaaaattacaaaaattagtaaggtcagtctaagaaacacgcacaatatattattacacacatttttagtcattatatgtcagtttggggactttttgttatttaatttcatgatacatcatctattttagaagtcaacatgtttatgtgttcacacctatattttgaccatacagcatttgtataacatttattttttcatttcatggatccaaagtatacactgtgttaatcaaagctattatgaagcaccagctatttgctagtactgtgctggatgtatttgaaaattttttgaaaagtaaagacttggtgctgatcataggattttggtggtgaaatgtgactaacaaatatagataatgcataactttatataattagtacagaattttgtggcacaaagcctctgttgcaatggaatttttaacatttagacatcaataagaaataaccagggaagatgtaatacagaaggtaaaatacgacctttagtttgaatgacagtcagtgtatccatcgggacatatgcttgtaactgagaggtagaaagcactttatactgcaaggaggctgagtgtgtcatcgtatgctgaggagttagactcaggccaaagtggcgttgctttgtctttctctttttctctgggtcacttatcctcctccctaggcttctctgtgtgcacctgcatcactttcccctttttctctgagaccagctttctgtacatttctaagcatgatagaagaatataactcacactccaaacccctaattttctacatctgttcaagatgctacttggcatctcagagtcctgatttcaatatcctgagaaaaagagaatctgacttggtcaagtaaggtcagaaatcttcagtcaaaagggcaaccagttaagatagatgaactgataatcacttcctagaaaaagagtaaggtaggcagaagacacagcattcaggtggaggtagaacagattgtgggaatgcacaaaagcagaaggaagccttggtttgtgaaagggaaaatagcactgtatttgggataatagagtctgaaacagttgatttagtgccagtaaggaactatccgaggattcagtttacttcagtatactattctcaacctggataatggtggacagtatttaatttcagactagattttagaaaaggaactcaaactaagaaatcacttataccgttatttcttactgtttatgcctccatacctaggataatttcaacaagcattctggcaatacctaacagaagaaaggaaacaaaatacaaataatcaaaacaataaagacaaaaacaaactcctcagagcatccaggaatgagttttcaggattagatagaaaggaaaatatggaaatagtgtttgtcatcattttcgtctgtgatttctgagtaaccatacattaggatcagaggaaccaatgaaaataaatgtagtgaatattcaaaagtgagatttactagccaaaagggatttcctattcacatattgtcattttcctttatatcgaaggctgtgcttgtctgacccatcccttaaatacggataggtttggacatagagagggtctttcttacacgtaaacgtatcctcagtccagagagatggtgagatctatgactttcaaagttgtcatatccattctatgcagggtctagagtatgtcagttaagtatatttatcctgacacatggatatttaaagtataaatatgttaaaaataattatgcccacatgctgaatttggcaaagaagtgttttctgcctcaaatgtttcaaaacaattgagtatcttggttgatttactaagcagcataatttagaacaacttcggcaacttctaatttttatcttttttactttatttagctgaaattgcttacatcaaaagagtacaaaggagagtaatagaggaggggttgtgtgggcataagaggtacctggtagacagtgaggacagagagaaaaacacccagctgttttggtgtattccccacaaagatccgagtgcgtgatagggtcataacaactttagtctccacctccagcttccatcctttccctctaaaagatagaggggtgggtttgggggtgggtggagaataacccaaccgtggtaccaaagtaacccactttactgtttgtcttggtctcaaacaacctgttcgcgaactgaagaaaggatgctgattgtagaaccgatttggcctatgaaattttgaaataatgttagagagatccttaacgtttcctgagattgtacagcaaccagttcctagtaaggtattctaaaaaaagtatcagaaacacgagtcataccctctgaagataaccttgaagaagaacagtcatggggctgtacagtctgatcatatttgctttggtgcttttttaaattcattatgtatcaagagctgccatttgttgaatatgtaccatgtgccatatatactattttaaatccttcatattatcctcataaaaacccagtgaagtagatattaatactctcattttgcagatgaggaaaataagacactttctaagatgacacaacttgtaaatgcagagcagaatctgaagccaggcagtgtgcctcatgagtttatgctcacagatagtctgttacactgagtcatgctgcagcccatatatagtccctgaatgatataaataccatacttgtggaagtggattcttcttcttattattatttattattagtttgacaaattgccagaggctagcttcaacaggtattgatagtcttggtacttgtctctccatttttccttttgctcttcatatgttttcactcttcttcttaactaatcagtacttttcagcagggctcacattttatattaccatttcctgagaacacttttaccttgtaattgtcacttttgttaacatttcttctgaaatgattaccatgttcacgtctttgaggagtggtggccatttcattgtgaaactgatgatgattatgtctttgttaactacgtgttatcagtcagtggtttaattttttctctgataaaattaaccataatgagtttttatgaaatcaaaatcattgaaaagattataaatgaaatctatactttattcttttctttctttcttttttgggtggagttttgctcttgttgcgcacactggagtgcatggtgcgatctcggctcactgcaacttccgcctccgtgttcaaacaattctcctgcctcagcctcctgagtagctgggattacaggtgccccccaccatgcccggctaatttttgtatttctagtagagacggtgtttcaccatgttggccaggctggtctcgaactcctgacctcaggtgatccaacctgcctcagccccccaaagtgctgggattacagatgtgagccaccgcgcctggctgaaatctatgctttcataaattagaaaaatactctaatggatatgatataggtttccttaattcattataccattctgaattacaacttgtatttattactttttccctctgtcatgttagtgattacagttttgggatttatcaacattataaaataggtaagcaactgcctcagttgctatcatcaccgactttccttagaatatcttagagataatttgttcatttggctcacacaaaagctaccccatttccttctttcctccaaagagagcaaatgtgtgacttctttgctcctgacatttagaaagaaacagtgacagcattgctaatggctggggaggaaggaagatggaaagagggatcattgatgctcactcacctttcttctgaactacttaaaactttgaaagaaaaaaatagctttttaattatcagtgtcctaatatcagtgttcttctcttgaataataatattattattccatatttaaaacaatgtcctatttgccattcttgaaaatatttatgattgtgtttcaatttttattttgatagataatttcatatacaaaatgtatgctagctaatatggctcttaataaattatatttatcacatatttcaattatttttcaatttttactaaaataattttactgtacctaagggaatgaatgtcagtttctaatcttggtaaatgtgagccttcataatgaattttgtttggatccagaaacgatcagtgtcatagtagatatttatatttatatagttataattattagacttaatatgcaatttacttaaaacataaatgaaaacattttagacatagtataattttataaatctaattggttttattattagatatacatcatatatgtaaaattggtcagtattatgttcaactagggctcatagactgtttggctgcttcacccaggattatataagcaggtaataacacagttagaacttgaaatcatgtctgctcacatcaagaaaaatgtttgctcccttttatgaaaccctggcaagacaaatttgaaatagctgaaggcatcagaagtattcgttgtatggttcctccattgttataggctcagctatctttgtattctctggttgcatggtttcctgattagctctgcagtgttctgttcatctgggccaccctactgggcttaacaccctcatttgttcagtgactttcaatttgtttttgcaatattttgttctccactggagagtctcttaagtgggtatatcaggtgggatggagccactgggagctgtatggaagtactgtggcacccacccaagcaatcaggagcagtgatttggatggcagtatgtggtaaagttgccctctcaagccatactgcaaaacataaaagtatgaaatatactgggttggaaaagagggaatgcaaataatggtaaatctctgtagttccaagtgcagcccatataataccaagaagaaaatagaagaaatcaagaaggaaaggaagaataatacaagataacaattctatgaggaatgatcctggaaaactgctgcttgaggaaaaataaaatagaatctgcacattcacttttgttctagactttaagattattatgaggtttagtatcaaaatgaggttgtatagtatgcagaacattggagtcccctggatactagatcccctcatgtggctcagcagcaactcgcctaagggtccattctctgactcagtccctttgcctccatcaatgctgccaagtattgactctctaccttccttattgcctcctggaatttttaatgttatgtctatatgattatcaggttctattttacaatactttgtaagcctctggatatatttttcatatgaaattataggagagagtatttgatggtattcattagttactaaccaatatggaatatcattatgttctatttatctctttatctaatctatctattatctatctatctatctatctatctatctatcatctatctatttaactctatacatagagactttatgctaggctgccttaagcaccatgcagtccatagatgacaatttttttgtctcaggcatgatcaaaatcgtcataacatatattcacaattagagtgctttgtgcattagcaattctaatgaaccgtccgggtgtggtggttcacgccagtaataccagcaatttgggaggctgaggcgtgtggatcacaggaggtcaggagttgaagaccagcctggccaacattgtgaaaccctgtctctactaaaaatacaaaggtggcaggtgcctgtactctcaaatactcaggagactaaggcaggagaatcgcttgaacccaggaagtggaggttgcactgagctgagatcatgccactgcactccagcctgggcgagaaagtgagaccctgtctcgaaaaaaagaaattcaagaaattctaatgagtctccattcagaagaatggtgtgatatgtgtcatttactttccacacagaattttattaatatttcttcaatgaatcacatattacatacagtagtgatttaatacatggaccttattaggcaagcatttgataggcactaccaagtaatccagtatatttttcttttcttttttttttaattgtactttaagttctagggtacatgtgcacaacatgcatgttttttacatatgtatacatgtgccatgttggtgtgctgcacccattaactcatcatttacattagatatatctcctaatgctatccctcccccatcccctgacaggctccggtgtgtgataatccccatcctgtgtccaagtgttctcattgttcaattcccacctatgagtgagaacatgcagtgtttggttttctgtccttgtgacagtttgctcagaataatggtttccagcatcatccatgtccctacaaaggacatgaactcatcattttttatggctgcatagtatttcctggtgtatatgtgccacattttattaatccagtctatcattgatggacatttgggttggttgcaagtctttgttgttgtgaatagtgccacaataaacatacatgtgcatgtgtctttatagcagcatgatttataatcctttgggtatgtacccagtaataggatagctgggtcaaatggtttttctggttctagatccttgaggaatcgccacactgtcttctacaatggttgaactagtttatagtcccaccaacagtgtaaaagtgttcttatttctccacatcctctccagcacctgttgtttcctgactttttaatgactgccattctaactggtgtgagatggtatctcattgtggttttgatttgcatttctctgatggccagtgatgatgaacattttttatgtgtctgttgactgcataaatgtcttctttcgagaagtgtctgttcatatccttcacccactttttgatgggtttgtttgattttttcttatgaatttgtttaagtcatttgtagattctggatattagccctttgtcagatgggtagattgtaaaaattctctcccattctgtaggttgcctgttcagtctgatggtagttccttgtgctgttctgaagctctttagtttaattagatcccatttgtcaattttggcttttgttgccattgcttttggtgttttagtcatgaagcacttgcccatgcctatgtcctgaatggtgttgcctaggttttcttctagggattttatggttttaggtctaacatgtaagtctttaatccatcttgaattaatttttgtataaggtgtaaggaagggatccagtttcagctttctacgtatggctagccagttttcccagcatcatttattaaatagggaatcctttccccattccttctttttgtcaggtttgtcaaaagatcagattgttgtagatgtgtggtattatttttgagggctctgttctgttccattggtctttatctctgttttggtaacagtaccatgctactgtagccttgtagtatagtttgaagtcaggtagtgtgatgcctccagctttgttctttttgcttaggattgtcttggcaatgtgggctcttttttggttccatatgaattttaaagtagttttttccaattatgtgaagaaagtcattggtagcttgacggggatggcattgaatctataaattaccttgggcagtatggccattttcacaatgttgattcttcgtacccatgagcatggaatgttcttccatttgtttgtgtcctcttttatttcgttgagcagtggtttgtagttccccttgaagaggtcctttacatcccttgtaagttggattcctaggtattttgttcactttgtagcaattgtgaatgggagttcactcatgatttggctctctgtttgtctgttattggtgtataggaatgactgtgatttttgcacattgattttgtatcctgagactttgctgaagttgcttatcagcctaaggagattttgggctgagacgatggggttttctaaatatacaatcatgtcatctgcaaacagggacaatttgacttcctcttttcctaattgaataccctttatttctttctcctgtctgattgccctggccagaacttccaacgctatgttgaataggagtggtgagagagggcatccctgtcttgtgccagttttcaaagggaatgcttccagtttttgcccattcagtatgatattggctataggtttgtcatagatagctcttattattttgagatatgtcccatcaatacctagtttattgagagtttttagcttgaagggctgttgaattttgtcgaaggccttttctgcatctattgagataatcatgtggtttttgtctttggttctgtttatatgctggattacatttactgatttgtgtatgttgaaccagccttgcatcctaggagtgaagccaacttgatcgtagtggataagctttttgatgtgctgctggatttggtttgccagtattttattgaggatttttgcatcggtgttcatcagggatattggtctaaaattctctttttttgtgtgtctctgccaggctttggtatcaggatgatgctggcctcataaaatgagttagggaggattccctctttttctattcattggaatagtttcagaaggaatggtgccagctcctgcttgtacctctggtagaaattggctgtgaatccatctggtcctggacattttttggttggtaggctattaattattgcctcaatttcagagcctgtaattggcctattcagggattcagattcttcctggtttagtcttgggagagtctatgtgtcgaggaatttatccatttcttctagattttctagttgcgtagaggtgtttgtagtattctctgatggtagtttgtatttctgtgggatcggtggtgatatcccctttatccttttttattgcgtctatttgattcttctctcttctttattagttttgctagtgatctgtcaattttgttgatcgtttcaaaaaatgagctcccggattcactgattttttgaagggttttttgtgtctctatctctgtcagttctgctttaatcttagttatttcttgccttctgctagcttttgaatgtgtttgctcttgcttttgtagttcttttaattgtgatgttagggtgtcaattttagatctttcctgctttctcttgtgggcatttagtgctataaatttccctctacacactgctttaaatgtgtccgagaggttctcgtatgttgtgtctttgttctcattggtttcaaagaacatctttatttctgccttcatttcattacatacccagtacatttgggagtaggttgttcagtttccatgtagttgagcagttttgagtgagtttctcaatcctgggttctagtttgattgcactgtggtctgagagacagttcgttataatttctgttcttttacatttgctgaggagtcctttacttccaacaatgtggtcaattttgatataagtgcgacgtggtagtgagaagaatgtatattctcttgacctggggtgcagagttctgtaggtgtctattaggtctggttggtgcagagctgagttcagttcctggatatccttgtgaagtttctgtcttgttgatctgtctaatgttgacagtggagtgttaaagtctcccattattattgtgtgggagtctaagtctctttgtaggtctctaaggacctgctttatgaatctgggtgctcctgtattgggtgcatatatgtttaggatagttagctcttctcgttgaattgatccctttgccattatgtaatggccttctttgtctcttttgatctctgttggtttaaagtctgttttatccgagactaggattgtaacccctgtttttattttctgttttccatttgcttggtagatcttcctccatccctttattttgagcctatgtgtgtctctgcacgtgagatgggtctcctaaataccgcacactgatgggtcttcactctttatccaatttgccagtctgtgtcttttaattggagcatttagcccatttacatttaaggctaatattgttatgtatgaatttgatcctgtcattatgacgttaactggttgttttgctcattcgttagttgatgcagtttcttcctagcatcgatggtctttacaatttggcatgtttttgcagtggctgctaccagttgttcctttccatgtttagcgcttccttcaggagctcttgtaaggcaggcctggtggtgacaaaatctcagcatttgcttgtctgtaaaggattttatttctccttcacttatgaagcttagtttggctggatatgaaattctaggttgaaaattcttttctttaagaatgttgaatattggcccccactctcttctggcttgtagagtttctgccaagagatccgctgttagtctgatgggcttccctttgtgggtaaccgacctttctctctggctgcccttatcattttttccttcatttcaactttggtgaatctgacaattatgtgtcttggagttgctcttcttgaggagtatctttgtggcgttctctgtatttcctgaatttgaatgttggcctcccttgctaggttggggaagttctcctggataatatcctgaagagtgttttccaacttggttccattctctttgccactttaatgtacaccaatcagacgtagatttggtcttttcacatagtcccatatttcttggaggctttgttcaattttttttagtcttttttctctaaacttctcttctcacttcatttcattcatttgatcttcaatcactgataccctttcttccacttgatcgaatcggctactgaagcttgtgcatgcatcacttagttctcctgccatggttttcagctctatcaggtcatttaagctcttctctatactgtttattctagttagccattcatctaatcttttttcaaggtttttagcttctttgcgatgggttcaaacatctgcctttagctcggagaagtttcttattaccgatcgtctgaagccttattcactcaactcatcaaattcattctctgtccagctttgttccattgctggcaaggagctgcgttcctttggagaagaagaggtgctctgatttttagaattttcagcttttctgctctgttttttccccatctttgtggttttatctacctttggtctttgttgatggtgatgtacagatggggttttggtgtggatgttgtttctgtttgttagttttccttctaacagtcaggaccctcagctgcaggtctgttggagtttgctgtaggtccactccagaccctgtttgactggtatcaccagcagaggctgcagaacagcaaacatggcagaacggcaaatgttgctgcctggtccttcctctggaagcttcgtctcagaggggcacccagctgtatgagatgtcagttggcccctactgggagttgtctcacagttaggctactcaggggtcagggacccacttgaggaggcagtctgtctgttctcagatctcaaactccatgctgggagaaccactactctcttcacagctgtaagacagggatgtttaagtctgaagtttctgctgccttttgttcagctatgccctgcccccagatctagagtctacagaggcgggcatacctccttgagctgctgtgggctccacccagttggagcttcctggttgctttgtttacctactcaagcctcagcaatgacagatgcccctctcccagcctcactgccaccttggagttccatctcagactgctgtgctagcagtgagcaaggctccgtgggcatgggaccctcaaagccatgcatgggatataatctcctggtgtgccgtttgctaagactgttggaaaagcacagtattagggtgggagtgtcccgattttccaggtaccattttgtcactgcttcccttggttgggaaagggaattccccaaccccttacacttcccggatgaggcgatgccccaccctgcttcggctcacactctgtgggctgcacccactgtctgacaagacccagcgagatgaacccggtacctcagttagcaatgcagaaatcacccgtcttctgcatcactcatgctgggagctgtagactggagctgtttctatttggccatcttggaatgactgtaatccagtatatttttcttcagctttatcacatttaatcttatgaatcctctgtttcatcaatggattataccctaaatttcaatttttgataatctacctctttgccactttatatatcatctcattctaagtacccatttctcctctccacagaaaaccacagctttttaatgttaatttcatttttattacatccaaggcttactactctaaaacttgcctacttcaaatccaaagaatttaaccttttctttaacaagttctttattttttctatagtccaccagcactcttattgttactttacatgtggagtagatagcatgtcaatcttttcaattgtttgtaattaatcttttggaaagtttgtgccccccctttcctacctccagcagattttgaaacccctcaaggctatgcattttttcctgcattttttctacagtgtcttagttccctgtacaaaatgactgctcagtaaacttttgcaatgtaactaattacattgttttgctgaaatggcatgatacctatgaggcatgaggttgtatgtcagtttttagatacacaaagaagacaggaaaatggagagtaagaacgataactcaaaatcaaaggggttgaagaaaatcagcaagtatttatcagattttaatcccctactgaggtgagaactaaaggcacagaagataaggtttaaagttagcattaaatgaaaattgttctaaaaataaagttatgcttgtagaaatttatgttgtttttgtttttttacaacttgaataagacaacaaacctagatctgagattgaccaataatagttggattatacaatttaatttttctttttgttagatatattggcctgtatgtatactgggcatgtaaatatggatactaatgatattttccagaaaaacaagtatagaataagtatgtgtaaaatatttggctcatttgcagaagatgagctccagcatcaggcacactgttttgcagtaactcttagaactattcacacaggttttcaaaattaaatgatcaaaaatcccaagctgattaaaatgtagtaggtataaaataaagactgatgaacatgctttgggacagagacattgaaataaattgtgttttctgtttaaaggaatatgctacaaaatattgtttatagttttgaagtaaatacagtgggagttaattttcctgatgtttcagaaacatgcattacatggaataatcttgtaaatataggtaaatagagtatcattggctgattgggtggaaactaaataagagcaaatcaagttttccacatggtaataggtaatagattacccactgtgggccaggttcttttgggaggggcagctgtgggtaaaatataactttacttatgttgtacacataaattacacataaatgataaatcacagcaaataattcctgaacatttcatagaaacacaaaatagttacattgtaaactctaaatccattgttctagaggttagaaaatggtagatgtgaattgtaattagaataatcaggaaaagttttatgaggtaactaaaaattgagatctggatagttgcgaggattggacgagtaagatgtcattagatggtttaatggaaaaggaaactgtaaaatgtagttatagaatcagaaaaatgagttaaaagttaatattcttttttttaaggtctgacattagaaaatggcagatttagggaaagcaagttatttaaaatatcatgagtacatcagtttggaatagaagaaagatgaggccagattaaggaggattttaaaggtcaagctaaagcattttgagtttatttggcaagttattcccatcacctgccattgaagatttttaaggagtgaagacgttaagtgggttttaggaagataaagctggcagcagtattctgtatagagatcaaacaaagtgataagggctttgattaagatggaagttgtaggctaagcagttacgaaaaagaaaattaactgttactaaatgtttttttttttcctaagaggcactgtatatgaaagtctttttattaatgatgactagttgaaccctctgaagaactaggaagtagatactatttttatagttttctaaaaaattttaaaaaaattaaaaaaaacaggttttgaaaggttaagtaaccaagtaaatgcttagaaataaattaagccagaatttaagataagccctatatttgacttcaaaattaaagctcttaccactataacacactgaaaaaaatctttgaaatataagtaaatgattagttgtagggataaggtcaggtttaaagaaaatcgagtcaaagctcacacttggataagtaatgagttttatatttaaactctcttaacatctaataagttagtttggttataaattttagaaggcataccattacaaatactagattggaacagaaaggatcacatatttctaattctaaataataacattcatccgtttgagaaagaaatgtacagaaaaccacagaagcaaatccagtctgtgtttttcttgctcttgtataatactcctaaattgatctgtcacagaatttgaaaccattttgatgtttcatttcaaaatgttagtggctgccttcattgatgacaacagcgtttggcaaactctgtactgaaaaaaagatattcatgctgtgatttaaatcaccaacaggataaaaatagatatgaaaatcttaataatttgagcatccaagagtatcaggagccctgcctagatttaaaattgagatattaatatcacatgtgtcttacggtctggcaatcttgcttatatagaacagagtgaataaccagaaatcgagggaaaagatctgaatggccaaaatttatctcacaatatgtaagcatttaaggtcaggtacattattcatgagaactcaggacttctcttaaatgagatttattctttcactcttatttagatgtatatttaatgatctttaccatcaaaggtaattagtgggaaatcctgggggaaatgttggtgtattatatttaaactacatagtcataacattaaagatgatgttcctattattgacacctattttcaagaaaaatatggcatattattattagacactgcttaaaaagccaagtaggtttataacaaagatattttctcatcccaaatatgtaaaattaagagaaagtgttgacattttaagtgggaattcttcactaacaggaaattttatttatatggaataccttattatcctttgatggcttattataaggtttttagttaatgagtataatatttaaaaatgaatttgttaagaaacagttatcatgttgaaaaaattggtcataggttttctttcagctacatcgagtattattcttatgccatacaattcacccatttcaggccaacattgaatgttatttagtagattcacaaagttgtgcagctatgaccgaaatctaattttagaacattttcacctcctgtcccctccaaaaagaaaccccctatccattagcagtcactcaccatcttcctcttgacagccccacagcccagccctagccaacccctgacttactgtctctataggcctcctttttctggaggtctatatgaacgtaaccatatactatgtggtcttttgtgacttgcttctttcatttagcttaatactttcaaggttcactgatgctgtatcatgtattagtagttcattcctttttattaccaaaaatatttcattatatggatatgccacattttaagttaatagattttttttcaccttttaggtggtataaatagtgatgatatgaatgtttgttaatgagtttatgtatgcatatatgctttcatttctcttggatatatacctaggatcacagatatttttaaagtgatatattgggatttatatactttatcctttactgatcttaattgtcacaatttttcccaaagctaattgaatgaattagtgttgctatatttaaataaaacaattaaaaatctctcccaccccttcttcttttcaaaactctccaaatgatcaaagataatagcctagtttatgtcattccatattctatactgttcttgaatgcttataaacatataaaacacatatacaaacttatacaagtgcaaaatgtatcatatacacatatgaggtttgttatatgatttttaaaaatgggataatactggtatttgcattgttctacaatacaaattttttttatcatttaaaaacataccatgagttttcctctaggccaaaagagatagctctgactcattcttcctagtgacacagcattccataaaattataataaaaagtataataaaatgtatatgaacatttgcctatcattggatagtcaaatttaattattttccctccagtttttttgcagctacaaagctacgataatcattttttacatatgtttttataagtaatacaataatttctataggctagattccccaaattaggatgactgaatcaatagtaattcttaaatttactatatattgctaaattcattttcacaatggtgggtagcaattcatactctaaccaataattcaggagagtaactgtttcagtctctccaccagcactggatgtagtaaatctttttaagtttgccaattttatgtgtatttcgttgttgatttaatttgcatttctctgactacaaatgagagggaatatcttttcatatgttgattagcaatttaaatttcctcttctgtgaattgctaattcttttcctttgccctttttctatcaaatttgtttgttttcttcctacaatttattggagctctttacatattaggaatattaacatttgcttatcatttgtgctgcaaatattttatcacttgatttttgacttttttttgttttttgccattattgtttataatgtatgcaaatatatctattcttttttcccccagtcattgtggtttgctcagaaacactttttctgcctgctggtggtagaatattttcatatgatttttaaagcatttcttaagtgcatttcaactaatactatgtttatacaaaggacataatgtttctaaggtattcagtaatattcctgatgttaatgcaatatccaacattttttgcttagttccttttctaaatatcagatgctttatataatttgagagtattttataaaatgaaattatatacattttatttttgtaaacatatttcaaaataataattgaaagattacagtatatgttgtaaatgttttcttcaaaaaaggttagttataatgttatcagatatgaaatgaaaaataatgctaatagatatttttatcaaaaaggtaggaatactgatttgtatgatgttataacataaatcatctcaatttataaacctagaaacttagaatttataaatcaatacagaaactatcttggtgtttcttattttctggttccctttcagtaataatgagaatctcttattcttacagttggaaaatcactatgactatggaaaatttaaaattcatataatacttcttaattactacattttgggggtgagagaatttcagagatattccatacagggaactactttttgccttaccatcctcaaactatttaactggttctgtgcttcccttactcttattcagaatataaaaatgtgcctggggtaaggagattaattattataatgttaatattttatgagaaaatatattaaatcatgtcttgaatatagttcatgactggagagtcagtacattaatttagatgactaaaagagattgatacttccaaataacttgagtctgtatttgagactttaagtagtactttaggttttaaaattttacactaaaacttaaaaattctttcggtgcattagaaagatcagcatttgaaaatggcttatgtttatttttaaaaatatcataattgttgcttaataataaactgtcttcaacaaaacttcctataacaaaatcgcatgtcctagcagggaatcctggcttgcagttttaaagtttgagagaaaaataaaagtatcatttatttttcaagtgtatttcaatttgtaaaattattattatcttatagaactcctttttcacctcgttttattagtatgtttttaaagaagtttttcaagtcaaaggatattttaaaattccttttgtgctatcaactaggtgtagaatatattccctgcttttgatgaatttgtaataaggttcgagacataaaatgtacattcaggacagtattaatcagaaaaatataagacaaaatttaagaagtggttaggtagtgcagtatcaactaaacaaaatgggaatacagaagaggatgtattatttgaagtttgaaagtcattggacacctaaagcaagtgtatgatttgtattatttatttgtttacataaggggtggtttacagagaggatactgacagagcaaaaagagaaaagaaataaatataagctgtgctagaaggaagtttaatgaatttgaattatatacaatataaacaaaactatttcaataaacaacacattcttacatgtggatactgtttaaaatagaaaagtctaactttctaaatttctctttgaatgcccaaacataaaaatcttaaacacacacacacacacacacacacacacaaaaaaaaaaaaaaaaaaaaaaaaaaaaaacagtaagtagacctagaaaatagtaattcagatattcagatacaggtctctgatgaactttcttttcataagagagggttttgtaacctatgttaaatctctccctccattcacaaacatttagtcctctctttctcttaatctgcttttttttttattcaaagcattgtttttctgcagtacacagtaagttatgtaattatttgttattttctcttcccctggaatgcaaattttctaagagtaaagtctttgtttcaccactggattatatcactcataataatattaagctcatggcaagaatgagtaactgttgaatgcattattgaatgattgaattcattatttattgaatgatgttgaaaaagtaaggttaccatttgagaaaaaaacgaaaaaagaatatgtcttttgccttcatatttcaacataaatgtcagaattattgaagatttattttttaaaaagatggctgaataaggaataacattttaggcattaaataatagaaaatgtcacaaagaaagttctattgaaatgattacctaaatgtctaaaagcttgtatatacaaaaatattataaacctattaaaaactaagtgcctagttatatgctacaaatatataaatgggataatattcttaatataaaattagctcacaaatcatgatgaaaaatattcaactttttaatgattaatcatttaaaaatgattaatctaaaaaagttattaaacttcctaaaagaaaagcagatgaccactatattgatgggaaaaaatcatattttatttataattaaatgaaatgcaaaataaaatgctagtgagcatcatttttcatctgtcactatgacactatgagaacatctttttgttggctggtggtgtcgggaccggggagatggctggaggactgcagggtggagggtggtggtaagaggatgaaaaccctgagttctcatacattgctgtgagaaggagttataatgattactacatttttgaaaagccattaggaaatagtgtcaatcttaaaaactattctttctctttaagtacttccatttccagaactttttttaaggaagttttcagagaagtggacaaaattatatgtacaaagatcttcatctctgtattattttttgttcctaaagttctaaaaattgtttaaaatttggagtggaattaaataaatgatatcatcataatatggatatgtcattgttttaaattgaagttatcagaggatttttactgtcattggaaatatttaatgatatatcactaagggggaaaagctgtattgcaaaactatatatccagcatgttttctatctacgtatgtaaatagatatctatctaggcataaaactccaaattgtatagtagtgtttatctctaataatgttattattcattaattttaacatttattttgtaatttttgtagtatcaaaattgttctgcattttatattattatgcttataatctagaaaagaagtaataagtatttaaaattcatgcaatgtgtttaggagtgcatgtatggcataaaaaatggtggaagtcacttgctgattttttaaggtataaatttaggttaaattttttaaagtcagaaagcaagttaacatgacttttctccaagcatatgttattattatatgaactctctaattatgcgctttctagtaaaactctttcattctgaactcaaagttttacactaatgacaacgtaaaacctgaataaatataaaatgtgatagtattctttagaacagatggtgtcatttagatactatttatgaaaattagatacaataaatggagttatatatcttacatcctaataacaagtgacataaaattgccatcgactagcagtatttcatgttcttgcccccgcaaagcataaccttgcaagcacaagactaatgcagaattttaattctctcttgctttcaactataggcaaagtgatccaattttattacactgtatgattattcaattctattctctaatctagatggtagtagaaatatttaatttgtaaatatattttgttaaagttagtgtttactgggtctatacaatcatttatttctttcagttccagattcatgtagcataactttcttttttttaatttttattatttgttttgttttgtttagacagagtttggttctgttgcccaggctagagtgtaatggtgtggtctcagctcactgcaacctctggcttctgggttcaagcgattctcctgcctcagcctcctgagtagctgggattacaggcatgagccaccactcccggctaatttttttgtatttttagtacagacggggtttcaccatgttggccaggctgatctcgaactcctgacctcaggagatccaccctcctcagcctcccaaagtgctgggattacagacgtgagccaccacgcccggccatatctttctttttagaaagtgtgtggctaacatagggtactttactttgatatttttagggaaaaataataaaatctatacttcaagaacactttgcctttggaaaaatacatttttacttacccagatagatacaaagaacatcgctttagtaatagataatcttatttagagtcacctgaagtaaggtttggagaaaggcaaaagagatattagccaagtaaggaaattaacgaaagcagagaaaactgaatttcagaagggaggtaggaggtcaagaaacgtatgttggtaattgttgctcttgtgtagatgagatttgttttgattttggcaaattgtggaagaaaaagaatagtacagtttttagaatggcttgcccatggaaacctctggtagtttatggcctatcattctatagttttattttgtgatagtgttactcaaaattagaaaattggcatttggttacctgcgaaacagtatttttggtcgttgtgacatcaaatttattattactttataggaaaatagaaacaaattatgactttaaagatatttcctggatgctattgaagggtttgttgtacgttagtcttttttgagcattttggttacatgaactcttaattggtttcatactcttttttggtacagccagagacaaatatttttagggatagcaatctataggaaagatttaaattgtttagaaaattccaaaaacttatcataccctgaaacaagatggatgattgctcttgcaaagacaaagaatacaacttcctgtgaaattactcataagagttaatggattacttaatcccagtatattttaactgtttatcataaaataaagaataattaagatagctcagttatatttgcattactctgccaatgttaacagtggttggctaatgaactcagattttattcactactgtcagtcttttacttgatgacagatgattagtctatggaacacattattagttctaacaatgtagattaaggtttctgctcattactttttattttcacatacaaattctatttttttgttgtatgcaaaactagtaggccaaagtcaaactaaaagtaatttcattatatctaacttttagtaaaacatagtatcaaacataatctttaaggtatttaaatctgcttggagataagtactgttacgtgacttgaagttcatgtaatattttaagtgcttctaaagaaataataaattcacttgaaaaaggcaaataataataacaataataaaaactgtactcaatctgtactgatttataataaagagccagaagacaaaatttagtattatatactttaaaaatatagtacatattttttgtaacagacgaatatgttatactgtcccttttattgagtgattagtagagcacttactgaactataacctcctggtaaaagtagccaggtgaagggcgaagaaaataatcaggtaggcatcctcatttggcttttattttggctcttgctaatagagatcatggaaaagaggcctagttcaccctggctcatcccgaaaggactagaaagaataatcaactctctaaggaaattctagaacagcccccttttccttgtatttttttttttcagactaatacatcagagccagatgtccttaggggatttacattttaaaattcttcctactctttctgcagaaaagacactattatgtaaaaggggattggtatttgggactttctaattcagcactcttccaatagccttcctgacctccctccaacaacaaaagtccaaagccctccatctggggaagtttgagctatgtgaaagaacgcttgaatttttcttgccctgtgggaagaatagaccttgtagtcagaactgcagttactggaagtatgacctataaaagtgctttggagctaggattttccgccttttctttttccttcatacatggttattgagattgtctttgtgattgagttcttggcaccttagctctaaaaaagatttagataaattaaaagagcttccgagaaaagccacaaaaatgacgaaagagttagaagtattgatgtatgaggaaatattaaaagaatgaatatgccttggcatggcattaaatgaggacatgttgccatactatagctataaatatttgtaaacagaaggaggaggaaaaattatttaaatggtccaatgaagcagtatgttatgcaaggaagagaaggctaagactgcgtattaatgtccttccttctggatttcctctctaaatatgttggccacacctttacttggaaacagaattagttaccatttactatctagaacacctgaatgcctcatactgcttaatgtggggaaaaaaaggagaataaaatgagaatattatttccttatcagtttgagaaatgtcgtgcaatgtttctgagctgtctaggcctttcctaggtttctgtctaccagtactgctcgtggccactgagtagcttacgaatggcaatgggttgcgctgccagcagcatagctgcagtaattctgcccatcccagtacaatgaactctttgtgttccatgcagtgaagagctcccttcatttattgtgggaagagttatctccgccttagcagctgtgcatactgcaagcttcagcttccacgggagaaccttaacagaagggaaaggcaggggtgggcccccaagatgcacattttccagctgtgctcagaaaggcatgtcttccttctaatccagaaggggaagaaaaacgaaccccatcttaagtctttcagaaataatatactattgagaggcggatggagatgaaagtattatttgatttatatgataatacgcttgggcaactgtttagttccccaatcccattgaagggtgtagaaaacaaactacaaatttccccaaaggaactttattttgtacagttgggttttcttcaaattgacttaaattgtttcttggaattcatacatactatatcatgaaggcaatgttatattgggtaattcaaatttagatgagaccatgaaattctattttacctataaactactaataattccattttggctctactaggcaactctcctcatgttgtttatgggggaaaatgaactctaagcttcaacttaaaatatcaagaggacatactcctggaggacaaattccctcagtggaaatctgtacaatgcagattagcatcactcacttttaactatctgtatttgcttttgttttttagtttgttgtttaaacatataccatttttatttaaaataacaccaacaaaacaaagtgagtatatctgcatttgctttaaagaaaagactttatttggtgcttatttggttatcattcaacaggagagctgtgctctatcatttaatttaattctggggccggcgcggtggctcacgcctgtaatcccagcacgttgggaggccgaggcgggtggatcacaatgtcaggagatcgagaccattctggctaacacggtgaaaccccgtctctactaaaaatacaaaaaattagctgggcgtggtgttgggcacctgtagtcccagctacttgggaggctgaggcaggagaatgacgtgaacccgggaggcagagcttgcagtgagcagagatggcgtccctgcactctagcctgtgctccagagggagactccatctcaaaataaataaataaatataatataattctggattaacaaattagcatattcagtattgtgtcattacatgtatacttactctttagatatgactcatagatattattaaaagtagaaacaataaactcagaggaaatcactgaaatgattacctgaaataaagatggtgaagccacacttgagactgtccagattctatctgtggttcatctataatcatgtaatttggtgtaggtcctcttttatttttgtcctttaacacataacttttaataagctcatttttatttagacagttactatctatacatttatgaacactttaaggtatatagttcaaattttttaaaatgcaaagtaaaagcatacatgttagacatgcaatatgtatttaaatacatacattctacagtaaattagatgctatctagaaatactctttgcactcatctattttggctttctctttctctctttctctctcctcatttctctctccttcccttccttcttcctgccttctcttcccttccttatttgctttctcttcctccggttccttcctttccctctttgtctctttcttcttctagcccttgtttataaaagaaagtaaatgattaccaatccatttaccatgctgtgtgactttttattataattcaatgagcagaagctgtttgaaatttgtgtcagtatttggtgtgtatataaatttgatacaggccaggtatggtgactcactcctgtaatctcagtactttgggaggctgaggtgtgcgaatcacttgaggtccggagttcatgaccagcctggccaacatggtgaaaccccacctctactaaaaatacaaaaagtagccgggtatgttggtgtgtgcctgtaatcccagctactcaggaggctcaggcaggagaattgcttgaacccgggaggcagaggttgcagtgagctgagatcgtgccactgcacttcagcctggacgacagagcaagactccgtctcaaaaaataaaaataaaaataaataaattaaacacataaataaataaataatttgatacaacccagatagtcaagcatttcttaataagttaggaagtctaatagtatgtataaaatatattaaaataaggattataaaagtgaaggaagacatcctcactagatatttatatcattaccaagatgataaacagagacattaatatcttcagctattcataagggaaagaaaagaggctgcttttgcaaggatagaaaattgtgttagtatgaccaaattattgactattttcaaaagctttactaattgcttttgcatcaaggatgcatatattcaattcaaaacaaaaactatcaagcatttctagttctaagtgctcctacggaatgagattttactgacagtgttcaatacactaatatggtagtttttgatgcatttgttttgaagtaattcaggataagtacaataaaataatacctattgtcaaaactggtgagaaagcttccatcttgagtgtagtaatagcaagcaaaatatcagactgataaaaacatagccaaatttgaaatgttgtgttaaatatgatgaaatatttcttcaaaatgattgggaaaacatagaaactgatgacttttagtttttacctaataactttataatcttatatattcagagtaatctttttagaaaaaaatgcaatgtggtgaaaatatatataaggcacaaaagaaagaaaagtaaatgcaaccaacgcagcaaatagctggataatattaagcacattaaaaatatcaatacctcaaatttccatttatttggcagaatacttatagcaaatccatgcattttaaagccaataaacattatataaatgataacccaattaattgaaaattgagtaaattgatgtgttactgtagatatacacactcaataccttcaaaattatttgatttttattatttttagagtctgagtatttataacttcattttaatatgtatgtggagaggagtcttctttgaaacaaagggaaaatgaaggtacttcaaaatccatgaagatgtctatattccctttatgagattcaatcagtaatgcaaattcatttgagtgagaaagaatgaaatccaaggccacttgggatagaaggccaagccaggcttctagttcaagattcaggactcctaaatcaaatggaagagtgatatatatgcaaatagatgtatgctgtctcattggaggttacaaactttctattttgcaaagtataatgttaaaacaaaacccactatcatttccatttaaaggaaggacatattttaccaccagaaaatcaaaataaaagtgaaggatagtaacacagaatgaagaagagtgcttcgaattaggtaattccagctttttgaaaatcatactctgatatccttatatgattctaattttcctatattctggtgaaaactttctcataaactgcccaggtatgcagatcaatgatcaaccaaacaactgagtcctcagttcaaacccaaaggattcaagaatggaatcctatgtaagcagtccaagaactcatctggtccaatctcttatttttaagggtaaggaaacccacattctgaagcccattagaaggcactggataataatcatgctttaaatctgaaggcataggggagaagcagagttagttatttgggggtgaaagcaacatactttaaaaaaaacaaccagaaatcagagacagcactaagagttttaaataaccctaaagttttctctgcatttaggcatggtatagtagtttgctggagctgccacgacaaaataccacagactggatggcttcaacatcagaaatttattttctcaccattctggagctggaagtccaagatcaaggtgctggcagggttgctttcttctgaggcctctctccttcgcttgcagatggtcaccctcctgatgactcttcacatggttgtacctctgcgcacacaagcactctgatgtttatttgtgtgttgtaattactactgccatatatatatatatatatatagagagagagagagagagagagtacaacatgacattttgaaatacatatacatagtgaaatgattactactggcaagcaaattaacatattcattcacatagttattatacaattttttggtgtggcaagagcacctataatctactctcctagcaaatttttattatgcaatgattgactatagattttatgttgtacattagatctctagacttattagtcccacataactacaactttgcaccctttgacctacatcttcccatttcccccatcatccctggtaactacttgttactctgtttttatgcattcaaccttttcctttctgtatctgatttattttacttagtctcatgtctttcaggttcatccacctgacacttaagttgttttcatttctgtgctgttgtgagtaatgctgcaatgaacatggcagcacagatatctctacaaggtgctgatttcatttcctttgggtatatatctacagagggattgctgggtcaaatgaaaaccctgtttttaaagttttgaaaaacctccatactgttttccataatgaatatactaattttcattcccaccaacagtatacaaaggtttccttttctcgatacccttgtcaatacttgttatctcttgtcttttgataatattcctgacagatgtaaagtgaaatttcattgttgttttaatttgcatttctctcattgggaaagcaccttttcatatacccgttgcccatttttatgtcttccttggagaaatgtctattcagatcctttgcacatcttttaattttttattttattttatttatttatttatttatttatttatttatttattttttgagatggactctcactcctgttgcccaggctggagtgcaatggcacgatcttggctcaccgcaacctccgcctcccaggttgaagcaattctcctgcctcagcctcccgagtagctgggactacaggcatgcaccaccacatccggctaattttgtatttttagtagagatggggtttctccatgttggtcagactggtctcgaactccatacctcaggtgatccgcccacctcagcctcccaaagtgctgggattacaggcatgagccactgcacccggccctttgcacatcttttaatcaagttatttgtgttttatttttttctactgagttgtgtgaatttcttacatattttggttattaaccctttatcagctatatggttcacaaatactttttcttaatctataagttgagttttcattttgttgtctcttttgatgtgcagaagccttttagtttgatatatccctacatgtttatttttgcttttgttgcatgaacttttggtgtgatacccaaaaaaccattgctaaggatggtataaagagacttttctttcatcatgtttttttttcttttcttttttttttttttttttgagacagtcttgctctgcagtccaggctggagtgcagtggcgcaatcttggctcactgcaacctccacctctcaggttcaagtgattctcctgcctcagcctccagagtagctttttttatgtatggtgaaagataaagttcttaaattcattcttttgcctgtggatatccagttttcccaacagcactggagaaactatccattcctcattgtgcattattggtgcccttgttgaaaattagttaaccatatatgcttgagtttgtttctgggccctttattcggttgtgttagtctgtgtgttggtttttatggcagcacaatagtgctttgtttactatatctttgtaacataatgttttttgtttgtttgtttgcttgtttgtttgtttttgagacagagtctcgctatgtcaccaggttggagtgcagtggtgtgatctcagttcactgcagccttcacctcccgggttcaagcgattctcctgcctcagtctcctgagtagctgggactacaggtgcgtgccaccacgcccagctaatttttgcatttttagtagagacagggtttcaccgtgttggctaggatagtcttgatctcctgacctcgtgatccacctgccttggcctcccaaagtgctgggattacaggcgtgagccaccgtgcctggccagtaatataatttaaaattaggacatatgatgtcttcaactttgtttttctttatcaatattgctttggctacttgaagtcttttgtggttccctgcaaattttagagtttttttgtttgtttgtttaagtgaaaaatgccattggaatttttatagagattgcactgaatctgtataccactttagatagtatggacattttaacaatattagttttccgaatccatgggcatggagtatcttcccacatatttgtgtcttctccaatttctttcatcaatgttttacagttttcagtgtaaagattcttcaactccttgatgaaatgtattcctaagtagtttattatttctaatgctgtcataaatgggattgttttcttgacttattttttgcataagtctttattgacgtaaagacatgcaactgatttttgtatgttgatttttcatcctgcaacttgactgaactcattaattcattcttaaggttttggtgctgtctttagggttttctacgtataggatcatgtcttctgcaaatagggataattttacttattttccgatttgaataccctttgtttctttttaccgtctgatcgctcttgctagtactttcagtactatatttgatacccgcacaacgggtgggtttgattgcttggcaggtgacagtctaatgaccacaaccaagaaaggtttaacaaggggattttattacttttaacaagtacagagaccactagggaagttcccaaagcagtgactctccaaagaaagatgaaaacagggcttttattaggctgattagctgagtcattgcatacagaggtggagtaaaggcagcacaggagcagttgctgatcatgcttccacatctatgcgtagaaaatggtgaatagacacctctctgggtgaggtttttagtatactaatgaggagaggtcaccaaagttcatccccaattcaggcatgtatggatccaactggttttctggggcagagcttcttcctggaattttttgaaacaagacctcaaggtgcaacagttgcaagtaggcactttttccacagtgtgtaccagaaaacccagggactatgggttacaaatccccctctgagacattctactcctcattcttagagctggaggtcattggtctgtaactacttcatgtagaccaggggcattgagtccccctaaagttagaagagtgaaactcttgcgctactgagttcaagtaagttttggggtcacctggagttgttcaaaggggccgatatttttgttgtaatacaagctagagatgaaactgttgaagtctggaagacacaaagtttgctatcactttaaatattcaaagaccaaaaagtaacaggggaacagtggtcactagtatccccaacagaggaagaacccaggtgaggtgaggtatagtggacttgactgtcttgcaaaccttgttgcttgagctacccttctggttgaaggaatgcagccattctgtgtatctgaatatttcttttacgttaacctctgttttcccagaggtgcttacccaggtgcaacagaaggtactggtgactgcatatacccctccctgttctgctagtaaatagtctaaggccaattgattgtccaaccctacactgtctagtgaatttggagaaatatgcacattttcgagagcctccctgtgttagctgccaaagtgttggatgatagggtgaaatttttttagggtgatctcatggcatgcaaaccccccaaggggcagccagccctacagcaagtctggtgtctgacaagattagtccaatagtccttttgggtctattatagtggttggtttcgttatggactattatccagatgagcccctgtaggctctcagtgcactgtcctaggtatattacattatgtacaacagagtaatccactgcaagttgtggaggggaggaaacggtttaaccaaccaagtaattagggaccccaaaggggagaagtagtctcataacactgagaagataaggattctccacaaatctccgctaagtaaaagtaaaatctccgttaagatttatttttccaatggagctcttcccacagctcgaggagtgctatatgatagtctgcaatatgcagggggttgtttatctcttaccaaattttacattgattgtgacatttggtgttagggtctatcgagtccccatagctgtctgtgagggcacaccaatgggtggtgtttagaatgcaaagtttagtgaggtcaaaggcaaggagggtagacatcagacttgcctccgttaccttcttgttctgaatgcatttggtgcttttctcttttttctgaacaatttaaataaatgaggtctactttcatggtgacattgcccttaggggtgaggtccacacaacccacagacagggaagggcccctttatgctgagataggttcaggcagtattttggatccccttctttccaccatgttgttaatgttcccctgcaaagggtaagcaacaggccactccatctgagtctggggatacgcatggcatattcaacattcagacagattatctctaccagctataacatgggagaagtttactattgcactggcctcccagagaccactggccacgggaactaagaggcccaagaagcataaggaaaagacagggttcattttaaggtgtcatatggagggctttactatcaattgaggacctaacagagtgaaagagggcgataagcataggggttcctacaagggtgagaaagatgcctagtatgttgagagaatggcaagggcacattttagttatatgagccttttcttctgaaaaccaatttgatatctctgacaggttcacaagtgtgtgctggggaggggtcctctaggggctcctgggctttcttctctcgtgagtgatgaatccaaggtgttaccctctggagtttaagggaagaatgaatacctagaagcatttggccaggccttgtccatgcaggctgagctggtccagggtgaggccagtctttcagttcttgatgtatacccagtctcttggcttgtacaggtcaagcttacctcagtggggtttgggagactgcggttgccttaatggttgagagcagaaaagacacatgcactcagatgaaatgtgcattcccattcagaaactgtcaaaagagaagcatctgcctcctagcttctgagagttcccactcagggttacgctaactgggagaggaggattgatgctgggagtgggaataggaagcccctggtactttggctgtggaagtgacttctcttgtagaggtggggaaggcccaggtggttgggatgacagccgtcctctctctgtcctcttgtttcctgaggtttatggagcagaggaagtcctcctcatctggggggctctctaggattgggagcactttctctggcagtttagtgggagatctgggtggtcccacctagagagtgcaaagcctgcactatatctatagggtccttttctggtacagggccataaaacactggacatagggtatcacatcccatttctcttatcccttacagaaaagatctagctgtagaatgatatggtaattaaatgacctgatattccaccatggttccttgctagggcccactacagccaggctgtattgcagaagaaaatcatctgcttttcagtcattggggaatacccaaagatcttccagcgttagcgaatgcaccctaatgggcctttctccgggagagaggttgggttcctgatacctttgggtcctcattcagggctgatcataggtcccaaggggtttaagtaaaaaggtattggctatactgatatgcgatcattacttctctgatgtgtaaaagaaaaataagcagatgtgcgagggtaagctggtggggccctaatgcagccctgcatgctccccacaaactccaactgtgctgcctacctacccaggcatcgggcacagtagctgccccttcttttaaaaacatatctgaaaacatacccagaatgtacccaggtagtaagagcctcttctcctaagttaaaattttcccagcctgtcaaggttgagggtttctgggcatacttgggtcccttctggttttgggaaatgtctcgcccaccacacacacctaaagaccttaaacccatctttttggaaaaaaaaaattatcttcacagttaatttcactgtttgttagccagatctagattaccagtgaccacaagggatatgtctctcaatcccccagggcaccaaccagccaaagacagggtttgtttgatcgcttgggtgacagtctaatgaccacaaccaaggtggatttaacaaggggttttattatttgcaacaagtaaagaaaatgttggggatagttctcaaagcagtgcctccccgaagagaggtgaaaagagcctttcatgaggctggttatcagagtcattgcatttagaggtggagtagcggcagcacaggcacagttgctgatcatgctttttcatatgtcacatgtataaaaatggacaataaactcctccctgggtggggtttttagcatgtttggtggtgagaatttgccaaagtttatctccaaatcaggcatctctggatctgactgttttttgttgttctggggctgagcttcttcctagaactttttgaaacaacaagaactcaatgtgcagtggttgcaggtaggtactttttcacagtgtgtaccccaaaacccacagactatgggttatatgttgaatagaagaggtgagaatgggcatccttgtcttgcactgaatcttagaagaaaaattttcaaatattcactattgattatgatgttagctgcgggcttttcataaatggcctgtgaggaaattttccttctatacctaatttgttgagaatttttctcatgataggatgttgaattttgtcaaatgctttttctatatctattgagatgatcatatagtttttgtcctttattccattaatgtagtgaatcacagttattgatttgggtaagttgaaccatccttgtattccagggatatatcccacttaattgtggtgaaagatctttttaatttacagttgaaaataatttgctagtattctgttgaggatttttgtacctttattcattagtaatattggcctgtagttttcttttcatgtagcgtatttttctggctttggtatcatggtaatgatggccttgtaaaatgagttagtattcccacctcttcagttctttggaagagtttgagaaggattgattctagttctttaaatgtttggcagaattcagccatgcagctttctggttctggacttttctttgttgcaagctgtttactgctacggtttcttttgttgttgttgttattggtctactcaggctttctgtttcttcttataagtacaccaggcagattggattcagattccttcgtacaatctcgttttaacttaatcacctcctaaaagatcttttctcgaaatgtgattatattttgaggaactaggattaggacttcaacatacaaattttgagagaacacaatgtagcttgtaacacatgacttactgaggcaggagaggtagtcaaggaaatgatcatgtttcctggcagcagcaactgtagtgaccatacatccgacacaataaaccttagcattctcattgtaattgagctcattcaagcaaagctatcttcagtagggactttcccttctagaaagtatatgcattttcatttcacctttccttttgctcattgtaatagtaaaagacacacccctgggtggagatttaagatgctaatgaaatatgccatgtatgagcaagcatgtacagctactgtgcatgtgcacccagaagaccacccagaacatgcttgctagtaacacctcttgccacctcctcttgaataatcatgtaaaactccaataaagggagtttctcaagcaataattaatgttgcctcatccttacaagctgctcaccctgaatcctctctttcagggtgtactgtctattctgcacctaactttcaaaatattctttttcttttgcagtgaattattctatactgcatctcctttgctgtgtgtctcatttaaattcttttaagccaaaaagaaaagaaccgaggtatcacaacagccatcaacatttccagactattcactaaagcatgaagcattgtaaagtaaagcatgtcccctcctcaaatgctctcgaaataatcaccacaaaaaaaagattaatgacaaaatgggagatattgaaatgtagggaatagtattgtagtaactttactgaaaatagtcattactatctgtttagtaacttatgatttacaaaaaccttttgcaaatattatgccatgttttttctcacaataatcttgcaaggaaaaaatgagattaggtgagcaagtcatactaaatgtaagaactgtcagttgcgtccatgtgaagagaccaccaaacaggctttgtgtgagcaataaagctttttaatcacctgagtgccggtgggctgagtccaaaaagagagtcagctaggtttgcttttgtgagtttatacaatggtttagtcaggatggttaaaactaggtatccaaaggcagaagtacctaaccatgcctaggaaggaaagcagttgttattttgtggaaggggttggagtttgggagattaaccagacacgatcagcagggagagcacgtgtgttttcatgaagaattatgctgagataggtaaccgatgaggaagaaatttgggcttgactaaagtaatgggggctgtccgtgaagccttgcagcagtacagcccaggtaagttgctgaggctgatgggtgtcagggtcaagaacaaattgcatttaatttttgaaataatcatgtgccaggtgttttataaatgttatttcaatgaatcctgataactccttttgcctactttatataagaggaaaccaaaactcaggatagaataggaaactaatttctttcttaaaagatcctttcatgataagtctcatggaattatatatgcatatgtgtatatatatatgtttgtgtgtgtgtgtgtgtgtgtgtgtgtgtgtgtgtgtttaatttagagagcatataacatctataagtcctagaatgaaattctgctgaagatatagtgaggctttactaattattcttattatttgtaacttcaagtatttgaggtactttttctggtttcactgaaatcatctgtgaaacgatttctgctccatatccattagcaaatcataataattaaaaggatgattggcttattttcttaggtattaacatgaaacttataatggaatagcataattgatgcagaccttttcagtgaataaggtggggcaatggatatacaagaaactcattaaaggctaagagtccagatagacgattttcagaccctgtatctcatttagcaagtgcttattgagccttaaccaagaatagttataatcttaaagatgttgaatcctggcccttgagtttacagtttgctaaagggtaaaggataaaaatatagttataattattgatatttttggcagctgtcagtttggtgcccatcatgaaattcaagatgtgatcagtccaggtgcggtggctcatgcctgtaatcccagcactttgggcggctgaggccggcagatcacttgaggtcaggagtccgagaccagcctggccaacatggtgaagccccgtctctactaaaaatataaaaattagcggggcatggtggcaggcgcctgtaatcccagctactcgggaggctgaggcaggaaaatcgcttgaacccgggaggcagaggttgcgggggtgagacaagatcgtgccattgcactccagccagggggacaagagcaacacttcgtttcaaaaaaaaaaaaaaaaattagccgggcctggtggcactgacctgtagtcccagctactcgggaggctgaggcaggagaatcgtttgaatccaggaagccgaggttgcagtgagccgagattgtgccattgcgttccagcctgggtgttgcagcgagactccgtctctaaataaataataacaatatttgatcacataatagaaatccacctgcacaggcaaccactcttcttcctttgactatccttttcccactgcactcagaactcccttgtcttttattgaaactttgtattgaaatctcttcatgctccctggatctagctaccaaaattacttaggtacttgagagctattgaaatggaaatttattaaaatgctagggttacttgtctctgcctctaagatacattctcccagtggaattctagattttagaaattatttcagaagttttttgaatgaaggcttcaattatttatattgtcttacactcccacgtgtgcgcgcacacacacacacgcgtgcacacacacacgatgtctgttacaaaaatgaccaattcattttgaacatgctgtattttgtatatttagaatttcatatacaacatttatgtttaaataggtaacggtattattcagatatgcccccaatgttttggctcccacttagagtcctaatctttctacctgctatttccatatccctgtctatgctgtagcttaactggacagttctccacccttgaaaatgccctgtattattttactttaatattactccacccagaaaatgagagcagcatatagaactcttacttttccactgggccaggaaatgcgctagtgcccttgggtgaacttacacacaatacagttgcagatcatggtataaagtggggttagttacaggtgactgtttaaaagaaggcagattctgtcctgggggagtagtaaagttaacaaaaagatttccagaacatcgttggagcatgatagggaatcgaattccaagcaatatacagagatctaaatggacacagtcagtcatatgctgacttcagggttataaggtccccgtcctatttcctgaaatgaagcttaagccagggcaggtcctgccttcgagaaatggatgtatctgatgtgatagctcttgccctctcatctcctgccagtgcctctcactggctggagccacatggaaggcagcaggcaaaggagggccaggttaatgcatgactttaaggatcaaccttctgggggtaaaagaatgagaagaagagagaatggacctggaaaggtcagcagttaatttgcagctcagagaagaacagaaaggactgactctagtatcgattgccttttatctctaaacatttcagaatctattattagaaggtaagatcttttctttttgaaaactaattcatgttttttttaaaaaatgaatgttttcaaagacaatttaaaatgaaaacaaaaatgccaacatactcctaaaaaaggctttgtgccaaagaaagataagtttattattttaaggagatagtatagttgctttgaaaagtcacatataattttgtaaatagggaagcttatttcaacctaactaatttgcatttgaagatatgtattatgtggtatctattaaacattttatcttaactataaatatttgactttgtcaatagcaataatgatggttatcatttgttgagtatttattatatgataagtgcataactgttacctgaagaggttaaacccatttgatctctttgaatgactcagcccaggttaaacatttaagaaacgaaaaagaggcatttggactcatgtctagggcaatccagtgccggtaaactttactgccctctgacagaccttttctattagcacttgtctccctatcacgttgtatttcttcgttcatcacttcaagtaggctctagggaatactttcaattccagttcccttttgtctctctgttacagttgcttgtcaatatttgtatcaattcaactgtttattttctttactcctacaccacaaattctgtatactgccaaagaagtccaaataaacaaaaagattgatttcactataagtttattttttccatcctttcaatctccactggattctcagtacataggaaatatttcatgtttctcagtaattctctctccatttcttcttgggagatgttttaaaattcaacttttctccacttgcaaactaactccctcttctactcaaaaattcagcaatgacttttagattaacagaagccgctaaaataaaattttcttaagttcttgccaccaatttctacaaagatttttgcttctgcactcatttttttccactctgcctttgtctctctgtctccatctctgtttctgggtctttctgctacagttaaggaggtattctgttcctttctaagtcacatccctccaatgtgcaaaggatttcatccctttttgccttctcgagaaactatccccctctctcaagcaattatatttaatttctaattctcatgaatttaccataagcatttaaatatgttaaggggcctgatgcggtagctcatgcctatactcccagcattttgggaggctgaggtgggcggatcacctgaagtcaggagttccagaccagcctggccaacatggtgaaatcccatctctactaaaaatacaaaaattagctgggcgtggtgtcacacgcctgtaatctcagctactctggagcctgaggcatgagaatcgcttgaacctgggaggcaggggttgcagtgagatcacaccagtgcactccagcctgggctccagagtgagactgtatcttaaaaaaaaaaaaaaaatttaaggattttcctattttaagcacacacacacacacacacacacacacatatacagagagagagagagagagagagacagagcacaatacaattattttcttcaattctaagtattcctccagctactgcagctaaacttttctctttatagacaggctttttatgaaaaagtttatactcctgactttattttctcatctctgaattcagtcggccttctccacctaaaacttcactcttgtcttcttcctgggacctttctcaattctgattttgcttgaccttttcctagcacttgatgttattgaacatttccttatattttggcttttataacattgcacttttcccattatataccaatatgtcaggtcatttcatgtcagtcatttttgtggaatttgtccatttttacatattggacatcgtaatgatgtccttcacactttcttctgctgcttcctacacttacattggattatcaaaattcccatgactaatttccactgtatgctgatgattcccaaatctttatctccattccatatctctatcctgtgtttcatgttgcagtgctccaaacatttcaaacttaacatgttgaaatctgaacaaacaattttccaaaacccatatttcctcttgtcttctctagcacagtgaatgacaatagcaaccacctggaagttcgagacagataccttagagtcatcttgtctattagactagttaccaattctttccattcctttatgcccgttattactcactggcaaataaaatgccacgtttttaaaattctaccatcaaaacatgttacatttatcacctttatccattctcattgccatgttttctgcctttttctaaagtacataccactctcaaatacgggcattattgcctcagtctcctcaaggtacccattcttaatccattcttaacacgttcttccctattgaaaccgttacgtgtgattgcttttagaatgacttttaaaaataaaatctggccatgtcgcttgcctgcttaaaattcattgttcataaatcaaagttcaggctttttaatgtggctgcagacctctgtttagttggtcccctacttacgtctgatcatttctcaatccttgttttatatactttagaagcagccatgcaagagtttcacttccttaaacacagtggttgtgtttgtggtgcactcccccgtcccagttgtccttccattagtctcatctttccattttcagataggtaccaagtttttttcagcctttcttaaaaagacacactgaaccgttcccactctgtatacttcaccatctaaaatcttactgctttgtaattgcctgcttttctatctttatctgccatgaattatattgttcatggattatatgctttgcaagggcagaaatcttatcaattttatctattattgtattcccagtacttggaatgctggcaggcacaataaatggtaaataaatgtttcttgagtgaattaacaaaaataggatgtgtgccataagaaaactataattaagaatatttactccagttggagggaatattaatatctaatatgtaaagtattctcataaacatgttatgcaatactaagaacaactctctgagtaggaaggactattgttttatgcatgaaagaaccaaaacagaaagtttgggatttgtccaaggtcagaaagaaagggatttttaaaaatgcaattaggataacctctaacctctgcttcagttttgctttttctgtcccacactggctaaaattttaaagtgctgaagtataaaatttgcatattttttaatcagacacaagattatatgatgcctagcagattacaactaacaataaaacaagaataatagttaccgcttattggatgtttgctatgttacttactagctgtccgttaactgttgttagcttgactatttgttttgtttttaaatttttaatttttagttttcaaattgacataatcattgtacatatttttggggcacatagtggtttcaatacatataatagtgatcagatcaggataattagcatatccgtcaccttatacattcattatttctttgtgttgggaacattcaatatcatccttctagctattagaaaatatataatatattattgttaactatagtcattttacggtggaacagatcactagaatgcattcctcctatctagttataattttgcatccttgaagaaatctctctgcattcctcccttccctcttcccttcccaacctttagtgtcctctgttctactttttacttctatgagatcaacttttttagctaaaaaacttgactatttgaaaagagctacttttgactccactcacttagatactatccccaaatgtatttgtgtttataatgaaaacagtaaacacatgctacacttctgtgaatatgaaatgtctagtatttcagttagctaatttatgactattctttaagcttcattgtaattcatcttcagtcttacagtggagaaatcctcatgctgtggaaattgtcagatttctgtggttttattgtttaaccaagtagctttttttgagagttggaagtaggggtgggggtatggatataaattttcaaattgtacaggcactagatagttgagagttgtcacccagaaattgctaaaagtaggaatttaaaaacatctttgagttcatttttttcttcatcttttattctcttgatacttcacttgcaaatggatatgaaaacttgtttggggagatatttatttgcataaagaatattggtgcagtcctttaactttcattattttataaaaccagattgtaattcttaccttcctatttatagcatgtgtgggaagtatattttattataaaggggacaggctgaagaccatctttgtttccggttggggcatttccagattggataaaatcgaaggagagccatctgttgaacatttagtattcagaactgtagaactactcctggcatctgagtttgccaagtcctagctaaaaatatatattaaatggggtttgcttcctttttttattggttttgaactcttctggcagaggttgtatattccctaaggagagaaatgtgagaaaaaaaatgtagacatttatttttcattttcattcacaaaacatttggttgaaatattaacatcaaatatgcccagacatttctactttcatttctatgtctctcctgtaagtttttttagaagttgttattaaataatgattaccaattcattgattttgtgtatgtcataaacacacacacacacactctcatacacacacagagacacccctgtctgtagtcacatattaagttgcaattttatgataatgtaataaaattgttaaattatactatttcgccagctcttgggaaagtatttttttttgcatgtaactcatcatcatttacatgcgaaaaaagaaacaaacaaaatatttttatataggttaataaatattaatattctatccacagatattaattaatgaatgtcttctctcatggagccaagggaccagtataccaaaatcaaaacaaacaaacaaacaaaaacaaagaaaataacaacagagatttgttatatttctgtttatttagaacctacccaaataccaaactctatttacagcttattgttattagccatcatacatcttgtaaaaaatttgagaagctcacattctttaataataatcattctgggacagcaaactagtgtttaagggaagaatcaactattttaataattggctctggtttgcctggcaaaatattacatcaaaactgtttgtttgtgaattatggaagggaggttttaatacaaaggaatgtcagtaggccccaccctggccagtctttaacaacaggatgagaggcaaaacatttgtcctgacaatacagcattgtgaaaaatatttgacttatgcacatgccaaaactaaagattctttcctctttaggaaataaataaataaatctcttcaccctcaaaagaaatgtttttgataaatgccaagaataaagaaggcagaaggaaattgtaaagaaaatgagggaaacaactgagtagttgagagtgattgtgtggtaaacagtgatcagctgtttgcactcagaggggcaagaatgacagttcagttatttctagatgcgcggaggtatacactcttttccaagagtcaggataaatcagtgagccttaaagtagtagattccgttgttgaattgaatagtgaatagctttgttggttttcagggacatatggctattttattctgaattaatgcatattaccttaactgttttctttttttaatgcattttaaaatgatagagctcatataattgtgaatgtttgaatacagaagaaaaaaaaggcctagagcactagggaaagctttaagaaatcaattaacagagcaatatgaaattataattaactaaatgaaaactttttaaggagataaataactttcctttgtatctttatgtcattttatttagataattaatgaaaatggcatctttgttcctttgggtcttcctttttgttagagaaaatatttttactctgtggcagttaattatgctatatcaactgaagataaagctaaaaagaagccatcgtgaaaaccattaagggaaaaatgacaaaatgaatggaaaaatggaatggctgcctatacatgagactgataagtgaaatgtagtgacatgatacaaagaacacaaacatatatttatgtttggttcaaagttaggcttttcacaccactttctgtcctcctttgagctgtgggagtattcagttcataatagactcacagcgtctcattactacttagaacttagttaacattgccttcctgatgtaatacaatgcccggaattcgataatcgttcctgaaaaaaacaaacaaacaaaaaaaatcaccattccttttaatagcttgagcctgtaccagaatgataagtggaaattagtcctcaaagtaacctcagctgtttcattattgtgtgcctcgagcatctggttattcaaggtgaggcttccatgttcaagtatgaatcccttgggatctgccgcaggactcacggtagtgctgcctgcttctcccactctgtggctgactcccctgaggtagcattctgccaggcaaagctgcctttccttcctcctactactgtgacttcagaaggtatggttttccctaatttatcccaagtatgaaatgagttcctttcctcttttttcccccacacggaacctagcctttaagtgtttaaggaagttttctttgtttaatagaagtacaacatggagaagaatttgctgctacttttgtaagtgttttatctgcctaaatctaggacaatttatctcctctaagaatatcctcaattgagcacccattctccagactgtaggcctacctgaaaaacatttctccgtttttccgggtcaacatcttcacaagactacgcattatttctatgctgtgctggaattcttcttagtaaaatatatagctgcattttctactcctatcacagaaaactagctactgcttccacagatataagaaaacaatattctgaaaggagtatattttcctagttctaggtttttaagtggaaggtagtaaagaatataagaacgtgggttgtgaaataagagatactaacgtttgaatctcagttccaccattcactagctatgaacctctgttttctcatctgtagagtgggaataattattgttcatttcatatagaaattgtagaagatatatatacacacatatttatatatgttatataaatatatatacacacatatttatatatataacatattttatatatatatatatatatatatataaacattttgtgctggacataaattttcagtaactgttagcaagtttaaataaataaaatcccgatgtaggaactcataggcctagcttatgaatggaaataagccaggccaggcgcagtggctcacgcctgtaaccccaacactttgggaggatgaggcaggcggatcccttgaggtcaggagtttgagaacagcctggccaatatggtgcacctgtctctactacctgtctctactaaaaatacaaaaattatccgggcctggtggtgctggcctgtaatcccagctacttgggaggctgaggcaggagaattgcctgaacccgggaggtcagaggtttcagtgagctaaaatcagaccactgcactccagcctaggccacagagcgagagtctgtcttgaaataaaagacaaagaaagaagccaggttcaggttctaggcacaccctctcccacaataccatgctgctgttttctccacttcagccctctgtcttttgcaaatagctgccgccaaaataacacagataactgcacaaaaatatttcaattacttctagggaaaggaaaacacataacacttttcttccaaggaacataaaaacttacagagatcatttttaaattttaaaatggatttgtcttagtcaaatatgtattatcaaagaaaatattatttgcattgaagtaacttcctattttcagattttcttgaacaactgagtgtatttgttttatttttgcattaaagaacaaaacctggacttagaatttactccaaattaagaaattacgtaccaaagagcagatatttcttacactttaaatagttttcattttacactttatcgtcatcagtgttgaaaagagtaatccagatttagtcacttcactctatgacatgtgtaaaatcagcttatttggccacataccattgcatcaggaagcccagaatccttggattttcttatggcgaatattattaatttcacttgcattttcttaagaaatagtttcccagccaacactattatgtgaaattcaactgtttctttgcatgttactaactgcaatcttccttaaaaggactgtttagagtaagatcaatgtggagggaaatgtaagttagccacattataagatagcagatgaaactgaatgcagtttcttatatagaaagcaacaacaagctgctgttaaaatgtgaagataaggccttcattcagaatgaaattataggaaattaaatatagagggtgggaccaatcatcagtacaagcaaccaacctgaatcaatattctcttaagtgttgggtctaaaatcacagaaacagcataacaaagcgggatgaattttatgacattggatcttgagtgtttgaatatataacatgactgaaacttaattctatctctgaaataaacaaatttcatttaaaatgtcaattataatcaacgtgtagtgattgcctggtctgagaatgagttgaagactgagtccagatttatgagaaaagaggaacttaattgacatttgccatgctattgcattaagaaatggcagcaaactctttgctgatgctcttgttactctgtctcataaaaggctacattcacaaaccctaagaggtcagtaagaatttttaagacaattttgaaatgaattgttggtttggttttggcactaacaagtgacagtgccaccagtatcagagacccatctggaaattatatctctgtgattgagatagattctccagagtaggataactagatggcactcgttattgatgtattctatataattaccctggatcctgaaattatgagtaaaaattagtattttggctattttttatttttcattttggtttactgactgggaaagaccacagtgataaaggatgtttggcttgtttggcactcctatttttcattataaattgacaagtaggaattctatttataaattggtttatgcattgatgtctggagagtttagctagccagaatcattccaattgagtatatcctgctgtgatctctggttgtgctgagaaaattaaatgattacctgtgaaactgaggacccctaaattatgactatcaagattgtctctggaaggcctctccgagtagccagccaacagcactgcaatgctatttttcctttcttcttctaattctaatatgagtctaagatcaaaagcaatttcttactcatatatctatctttagagcatacatatttgataaattctattattattttttaggactatgtaagtctgaatttgttgaaaattcagaataggactggcattactagggaaaacacctgtgtggatacaaactcatgattatataatgtatatatacatatgcttatgtaaatgtaagttagccacagaaatcatgctttctgttataaaatttttaagtatgtcttagtctgtttgtgttgctatacaggaatccccgaggctctgtaattcagaaagtaaagaggtttatttggctcattgttccgcaagctgtacaagaaacatggtgccagcaattgcctctggtgagggcttcaggctgtttccactcatggtgaaagaggaaggggagccagcatgtgcagtgattacatggtgagagaggaagcatgagcaagttggaggtgatgcctagttctttttattataacaaccagatttcacaggcacacagaccaagaactcactcattacatccaggaagacactaagccattcatgagggaatctgcccccatgacccaaacacctcccactagatctcactgaccacaataccaccacactggggattaaattcctacatgagatttggaggggtcaaaccaaccatatccaaactatagcagtataatttacagaatactatttttaaacttttattaattatgttctcttttcttgagaaaaataaaatctctttttgtattatttgtaattgcaaataaaatattactaatattaaataaagccatgcaaaaaatagtgtttcattttctaaatactaatgccagttccctcattcttttatacccctaaatatgacatacacacccttgtactttgaagagtatatgattataaatgaagacatgatagtccattttaaatagactccctgtaaaagatacaaatttattattagtgattaatttcaatcagtataaaatagacacatttttttctttctaaatacttaataggcccatagaaaatttcaaaatgagcagctcctgatgaaggtaatggctaatagtactgtgataattaaattaggattttgtgagccagttagaaaggactgtacatcatatgaacaacactacgtatccttaatgttgcttaacatcaagtttcaggagtgaaaatattcactactgggtttgacatacttgcaaatatttcagagttgaagaaatgaatcataatatctcatagctcgaaaacatgccttctgtgaaatagccttatctgaatctatagataccttttatttccaaagaaagcaattgttgtgttgtgagtagaatgttgaggtgtccatgaacctaccactacatctttgcagaattcttaacttgacggattgactaaaatggctaccactcttcaccaacctacttgaacaactattttcttagaagtgcttatttaggtattatgtgaactctgcctttggttatgattccaaacatacagctggattgataatgtgccttttaaaagagactaatattcatgtctctcaaaaataaacatatctatatatatttcatatatatatatatgaggacattatagcccatgatactagcaagatatgtagtctatccagatagaccttttgtgtttttagcatcatgtttcttctctcccgtggcataatagagttcttcagaggctacatatttaatatatcctatctagacagtaaaatgatttccataaacatgcacaagctgtttaaagcagaccatatcaaataaaatgaaatctcattcactctaatcctcatgatctagtttgatggcatgctaattaaaaagaacaaatacacaattaaggtataacagctattgaaaaccaggcttgtctcacctagattagtagaaagaataaagtaaacatacagattatttttagatactttcagaacaaaatcgttctgttgcaccatacaattatttaaaaactctcaaagggaaaatcagactatgtagtagcaactgcagtgcagtgttctggtgtgtgtgtaattcaaaacaacatatcatgggaaacaagatattttcaaaataaggggtattcatagactagcttacactaaacaaagtgggcaatgcaggtgtgacatgtagtttttttcttgatgtttcctctaatgtaaacatacattaacatacacagtctggtcatgtgatattgaatactgtataattctaaatgcttaatatcatatcatacattatgaaactaagggtaaaaattattaatagccatcatttgaacaacttatcccccccattttctctttattgtctctttctcctcctttatcaaatatctgatttcttttgattttatttttacagctctatttctaaaaaacatcactgtgctgtcagtctctagtagtatttatatctgagaaattttaaagtgcctctcctctttctcattctttaccttatatctacattttttatctttttctcttttaattcaattgacacaaaagccttgttgttcttgccaaattagtcagatagacgggagctctaatttataaacagatttgtatcaacatttctcagaaagaagaatagccagtaaggcaagttggtgcccacttttctcttaatcttaggcttttgatctgtcagtggcacccacatcacctcttgcagctgtgctgttactgaagggtctttacaaacaattttgaacatatagaatttttaacatacttacagattttaccttccttgaatttattactttatgtcattggtaatttctatgagaaactgagtaaagaatacagtttatataaaaacggtatcactataatttaatgtaaattacagttatagttagtattagggttgaaatgtaagtggaatcagatttgaaaagagaactaatgaatatttgtagttttgttgttggcaagatgtaacaatattcaagaaggcaggtacagatacatatttatgttttccacattggcatgaatgtgaaaagaagaaatgaaagaatggtagtcattcattcaacagataattattaagcatacattgaacatgtactacaatgggcactgtgctgggtactgtggaaaaaatggtgaacaagtcaaaaaagatgcctgaactcttttacactcaggaaactaaaaaagtaaataaaaaataaataaataaatataattaactacttcttttgagcactattaaagaagcataccatgtgatatgatggagatcttgagggggcctacttttctttgagggaggtgaaatttaagctgagatcttactgcattattaatgtaaaagctctttcctcaaaccctaagatgctaagactctaaataattaatctaatgtagtgactcaaagtgggtactttaatttaaacaaaataatttgtggttacatactattgcaccttactagttttgtgatctagggcaagttacttatacgtcaaaaataagaaaaataatgccaacttcaaagaattattaggaggatgcaagtatttcttcctcttaaacatatcttctcagttctattttctccttaatgccagtctccatttctttctttctttctcagctaaattcttgagatggctgggtacttgctggggctaatctctcattccattcttcctcagaattactagagtctccccgctgccctgcttcccatcactctgtccaccaaaactcttctgttgtggtcagtgatgacttgtgtgttgttaaaggtaaagatacatgaagtctacaagacatctcctaaatgttgatatttacaattcctgaccttttcctgagcctcaaaccttccactcctacactttttcttgtatgagttaggggcagctccatcactccattcaggtaaaaaacttaaagtctttatcgaattctttctagggcttcacactcagaaaagttctgtgcttggtttattgctccactatcactctactgaaattcctaaatttgtattgaaatttgaacaagggatcctacatcatttttctgtcttcactagaacccacaaatgtagctctcctgcccatttctctcctataccctacatttgagtcctgaagtccactttctcctgagttaaactgaaagcatcctaactggccttcctgcttcaaattttgtctctctttagtgtattttcaacacaacagccagagtgatcctgtatgtatgtatgtatatatatatataaaatatatgtgtgcatgtgtatgtgtaacatatacatataatctgacacaaatacatacatctgtacacacctatatgtatttatgtaagattacattatttcattgtttaaaatcatcagatgacttcctaccttactcagtgtaaacacagagattaaaagccctacacaatctgatctcctgtaactgttgaccttatttgccatgactgtcccctcagtctgcatgattctctgagctccatctcaggatccctccctctcaggatctttgcattattgcttccaaaacttggaaggcttttcgcctacatatccatatggctcattccctcgtctacatcaaggctttgctccaatgtcttcttttcaggaaagtattccctgacccaatctatttaaaattgcaacccctcaacctacggaaacctttttttttttttttttttaccatatactttttttttttctgtgtagtactgatcaccaaataatgttgcttacattttatttaagttgtatctgtcttggctgctacaatatatgaattacaaaggcaagaattttgtttgctttttcactgctgaacctcatcattctaaagagtaaggggctagcatttagtaggtattcagtaatagctttaaattaatgaaattaaataaggaaagatacataaagtgcatgctgttggttcatggatagcctgcaacaaataataattttactgctatcttacaaaccacccaatttcaaagctactccagattaccttagcagttatgcaattcacattcccattgttttatctggaaagccaaagctcaaagattttaagtgctaattcaacagatattgcccattcagtgtaaagacagagctgatctggacctccacctcagggatccttccaccacattagataaactttctgagcagtcacagttgcttgtattttattctatttgaattatcagtcatgccacagcctgcatctttacaatactgaaaatctggccagagagatatcaataacatctttactttgcttacagaattgtcaagaaaagattaacaactcacataatctaattttcatttgtgtataacttgaaagaattaaagatattaagagcaatatatttaaataaaaatttagatataaccactatttattcactgcatgtggtttaaagaaattatcccactaatggtctgaacaatcctgtggatgtattataatcccgttacaactgagaaaactgatgcttccggaggttcagtgatttgcctgtgatcgtgcaagtagtaaataaagtatgaactaaaagctatgctaccttactccagaaacttgcttttaaaaaataacaccacacaaaacagacatgatccactgaaaatgcagatttcctacgaaaaggatttttaataatgaatgtataattgtgtttcattgtggtgagtcaaaatcacaagacataaggtttgaaaacaggtctgatatatctcaactctagatattttttttaatttttgctttttctgtactaagtctgtgctgtagagcaccacaaaaaagccaagaaggttttttgctttgtttttgtttttatatgtcatttgaagatttcaaatattctatatatcaccttttgagtgtgatgagtcctaattccattatagacttatttttagtttgtcattatcatccctgttgagagctatatttcctccaaattctgaatgccaacattttcctagaggaaatatctgaaccatatttacaatatatagggatccagaaatattattgtttatcacttgaaactgagaaatcattttaataaaactactactacaaatatattttaaaatgtaggcacagagtatttttgtttctcatctgtcaagtcaaaatagaattttatatcaacatacattacttagtaaaatagatttgagatcatttttatctgtgaaattatcttattttattaaatgatgacttattaaatttgtgtgagtatgaaggttgagagtggaaattgggagaaataaaggagaaagacttatttgtgttgtgtggcctattgttgatagtggaactgtgattaaatttataactttaaaaattatttctgtattatattactaacaaaaaataatattatgaaacaaataaaaattgtctgatcatttggattatagtgatcaagacttcatagccaaaataaagattttcatatttttggtaatttgggataaaatattaatctttacacactgttcatctactgtgactacacattagaatgtaactgcattcaaaataattggaaacatggattttctactattgtgatagtttgtggaaaaatcatcatacaccagtcaggttggctattattaaaaagacaaaaaatgacagaggtcgatgaggctgcaaagaaaggggaacgcttttacattgttggtgggaaatgtaaattagtacagcctctatgaaaaacagtatggagatttctcaaataattaaaaatagaactaccatttaatctagcaatccccctagtggttatatatgcaaaggaaatcattatatcaaaaagttacctgcatttggtatgtttatcgcagcaatattcacaacagcaaagatggaatcaacctaaatgcccatcaacagatgactggataaagaaaatgtggcatagagatacaatggaatactattcagctttaaaaataatcaaatcatgtcttttgcagcaacatggatggaactagaggctattatcttaagtgaaacagctcagaaacagtaccacatgttctcacttattagtggaagctaaataatgtgtacacatggacatagagcataaaataatagttattggaaactcaaatggtaggaggttgggagggggcgagggctgagaaattacttaatgagtacaatgtgcacgattttggtaatggttacgttaaaagcccagacttcaccattagcaatatacccatgtaacaaaactgcacttgtaccccttacattttacaaatttaaaaaattgttatttaatttttgttttaaaatatgaaactagaattattttctgaaagatgttttacattaacagtgagttaacttagtgtttagttttgaattttttttaagtgctttacatctttttctttcaataggacttgatgatgaccaaagttccctctcagctgcataggcagacatgtgctattcttttttttctgatagggttatagttttgtgtattaactcaaattggctgtttaattttttcttgttgccattgttttaatgttgtttggattcaacagcatgtctgaattctgccaatgttgtgctaacatgctgttgccaaaagtgactggagtaaggccagtgtggtcacttggccagtttctgaatgcaaaccagtcactagttaacagaatttgagagcttgagggaaacttcataaatgactgtctttcagctttccagctgagaaagctgagacaatgaatatgatcaccttgtatggaattacacagagagttaaagaagtttagatttgatccaggacttaatgggataaaagtaacagttcatgtagtaaaactcaatattattattttgtgtgcatagacatatcctgaatcattctgcaagtttttattatgactagacatgcgaataactggatataatttcctattcttccatttttctgtatccttggttaaattgtttgacttctttatgccaaaatgttcgtacgtgctaaatgagagttgttttatttgatttccttttagaaaaacatgcaagtggacaattatcgaaaaggactgtttttgaaatgtttgagatttagaaatgaaaattcactaatacataaatttaattactgacagcaaaggtgtccctgatctagttaaactaataagtgagtgcaaaataaggcaattggtctttattaatcctattatataatctaataagcttctctttcccttagtcctgataggctagtttggaagcaaaaaccaagcaatgctaagtagctttccagacaagtattaaaataaccaggaaaaatatcaagtcatttgagaaaaagagaggaaatatgtctgcatgaaatgtggtatgaaagagtgggagagtcagtaaagaatctgcgtcaacagaagcattgtgaaaggaactttttcagatgtctatgtgtataagctaaactaactacatatagattaaaatactagtttctacagtataaattttatttgagtaccttcctattggcataatgacatctacagtaatatttctgttgatttttctttcttgcttcataccaaagtgctcaaggctaaatacaggaaattatatttttctttctaatctcagcatttgattgaagaattatgtcacctaccagtttataaaaaagtattttgtcataaaagtacgttttcccctaatgttggaagtagtgttgtttttcaatattttggggaatttatgtatgtttatgtagatatatgaatttatctttaaacttaacttttcattgatctctaataaaattcttaatggaatggtacagcaatttacaaaattttcattataaaaaagttgctggtttagtaaacctaagaagaattggatttttaaacactgataaaagcagcctactcagtctgaatttcattaatagtgtccaagttccacagctctagacatcacagaaacatagagataacacagtctattaatgtctaattttttcatagaaactaccttttgactttattgaaacacacaaatttagatagacaaaggatctgaaaaatattatggaatgcagctgtttaaatggattcttcattttactcatatgtatttcagctgtcaaaaaggaaatggcctttgtggttaaatcatttgcttaggtttttgagcctaagtatctcatatctttgatttctttttttttggtggctgtagaaagatgagaatcattatgatatagctttattataatatttactgtagtatgctacctgtcatgattgaaattgacttgggaatacaagttatactggttatgctcatcagagacaaagacatatcctctgtatatttaaacctctctttttgaagacacagtttcactttactatcagagttctgctttcctggcttaaaatttaccaaatatttgtagattatttcctctaatggtgcattgaattatgagccatgtcatataaatactgtttgaaatatatgtccttctttctctgcatttctttgtatatcccagttatttaaagcacagacacatagcacaaactatggcatttgatatctcaagtagaaattttgttataggttaatatatctaaaatatataaaggaataataattcttgaaatgtgtatcagctttagatctaggtatatacaaataaatcaaattgacatacaaaatacctgatataaattaaaatttatattaagtgacctgtaattcactcataaaaattagagaaatgtaacctttaaaattgctacttgtgaaatatacatataggtgtagatacaagtgattttgcagttcttccttttaaattgttatgccttaatatttccagcccaagtggtttccctgcagctattttaagaaaataaacatcagtttgaatattattaaaacacctgattggttcattgaaattatttgctttctttctctctttctaaatatagaggattttttccccactttctattctatgatttgggctaaattttaatgttgacgtctaaaggtgtggcttttgggtaaatcacttaatttttctttagttttctcattataaaatgattgctagattacctagagttctgtgattattgatttttgtatgtatttttcactatctgttcgtgtcaaattgtatatattaactagcaataattagttcactatagtcaacacctggcatttttattataaaaatttgagactttccaagtattcatgatatatagtttaaaaaatttcttggagagcagaagataaagaaaaaaagaatttattaaatgatcataatcaactttacttttgtttctggaagaaaataaaccacactggaatcttacagaaaagcgatatgctcattaatgggaagtgagaagcttttgaagaatatcaactttgagaaactcaggcagagcacctatcgttctatgctaggaactactaaggttcacttgggccctccctattagagtgataccctctcatattcttttcttttctttcttttattttcttcacttcccttcttccttttgtctttttttcttttttacaaataagacatgtttaagaaaataaatatctagtctaacaagctaagctacattgtttgtctttagatagttcttcaacataatagagactacgggctgagcatgatggctcacacgtgtaatctcaacactttgaggggccaaggcaggaagatcacttgagtccaggatttcaagaccaacctgggcaacatggtgaaaccccatctctactatatatatgtatatatttgaattttccccctagtttataacaaacacattgttttaaaatatgaattagctttatgtgctttcacatatatggtatttattaaataggcaattaagtttaaaagcaagaactagttaaaaattttgtgactcctgctctatttactgtatccacaatgtgagagcaaccaaatgttgctatgattcttatcttttttatttggggatgcagtgccttccaaaacacttatattctccgcaatcttaattggcttattgggcagcaggtcctaaaaagaatccacaacttatattttaaaatcactcagtttgcttgcttctcttcgttgtctcatatttataatgtgaatttccttcagtgaaaggctttttctctgaaggttgttcttacctctcacattagatacctggaaaagtaaaaacagaaataaatttaaaaaaattcaaaacagttggatatgtacacagggacacagttctttcagacagacttacgaattcacacttgccaattagttccaagagtacaggctgtgagcacgtacagtgtgaatgaagtttcttccaagaatgcataaaacgtgcaaattgtaaaaataggtttgtattacttaggatctttaaaatgcagcatgatattagcttaaattttggttgtatgccctgaaagaagaagaataggttctttaatatgtagttttcttctccaaacacttcttttttgtacttgctccagctgatcattaaagtttccctgagttagtagaaatataggatttcatagcagttgacaaatactgtgtggagaaaatctttccctttctgtttcttcaggaatttgtgtctaaatccacatttgtcttccagtgatttagtttatccccctctgcccgatatggagtgctcagaccataaaattatgtgatgtcaagtgatggttaaaaaatcacctcaatcttttgatcatgaagaagcttcagaaagagagtgactttgttaagattatcataggaagaacagtgtttctgtttgtttctcacaaacacaatgtgtaatagtacattactcgacattacacaaagaaaatgtgtaagagtacattactctacgtcattcagcaattgtaggcaggaaaactttgtcactgagagtgagacacttttagattcctgtaacttgcattctagcttccaccttttccttaatatgtgaactcttggtattcacttactttctctaagctttaggattcttctatgtaaatgatgatgagacaagtatcctaggttgttgaactttaaatgagtaactttatgtgaaacacacaacaaagagcccagtatatttaaaatcatggaaatacacacatataaatgtttgtactgtatatgcataacatgtgtgtatgttaaatttataatttgtgtagtaatttgcattatacgatgtgaataaatcataatgagaagcaattctaagagccaggaagatgaaataaactgttatttctggaagacgagtgcaataatctggtcttgctttccattaggatttatcagcagtaaggatttattcatgtctccacctgtcaaaatccttgcaataaggcagtgggaaatggaagcccagaagccttcttgttatggagaatcagatgatatccttgtttcttacactcatgtaggcctgaattcatacaatttaatgtcaaagacaaaactgttatatataaaggcacacaaatgcgctggatgtttccgattggtgcttccatactcactctctaaccctgtctacctggctttgttccttgatgggctgactcagctgagctctcattggattaggccaatggaacaaagggggaagagattgatttctaggaagagaagaggttgggggtttattgctctaacttcctcttttagggagccacagtttgtcaatggctgtgttcctctgtccaagtaatggctcctgcctggaggccctcatcagctaaatgtctgggcagatccagacttcttgtctgttcaggcccaggtggggaaggggcttctagccctcctagttccagagtctttcacactcctcgctgtttctcaactccatcctctccttggtaagcagcctctttgttaatatctcttcaatcatgattttgagtgtgctatctgattcccgacagggctttgactgatgaaaaaagcttcaatgaaataaaattaatgatttctctgtagagaggaaggaacaatacattatttaactccagggatcaatagcaattaatgtctccgtttctaaagccaagacaagccataaccaatttccctgaatttctctctgtgtgtgtgattaagagtttagaaaaatgatacaattgtgtgtgtgtgtgtgtgtgtatactatcttactggcttcagggtagagggatgatgtgacttgcattttagaatgactggggcaacaacataaaggagagtgacttgagaaggaataaaactgaaggcagaaacattcatttggagacctttgaaatttagataagaggtgaaagtaactttaactagatcagtaggaggaaagttgtactagagaggaataattggaaagctatttgaggggtgctatagtacaatgcttaagaatgctcagattcttactccctttgtgaccctgggcaagttatttaacctttctgagtctcattcttcacctcttcaaactcaggagaatagtacctatctcatagagtgtttgtttggattaaattggtatgagtaaagtgcatagaatagttcttggcacattttaagcataatataatatatattttaaatcttattagcagtatatttatggatgtggaaagatgttggcagagagaacatgtctaaatgacttgcagatataggatgtgacagtgtgtgatttttttggtaccattcactgaagtaggtaatttagtaggaagttcagatcttcaagtttttctgttaattacatgcacatatttttcctcaaattcacattgctgtcatcttagattaatgtctaatattgtcatcctcaacatgctcaaataaacccctttgcatggaatctcaagtgaattctgggcatcttccgcaataactgtcttaatttggtcccgttatccctagtagagtcctccgtaatgatccaatgcatctttctttcagttcatcctacccaaagtggcctctctataattttatctaaaaccaactatggctctctggtatttccagaataatctacaattcaaagttcttgctcgtttggcccacctattatatattgctttatttcttcactgtactccattatcagatatttctgagccttgttaaaatttattccctatacctggcatatatacttctctcctgcacatgcctagtaaacttctaatcatcttgcaaagctcaggtcacattcaatttttgattccttcttctgatcttagttgtgttctatcaatccctcatgtcctcgtgtcatattaagtgatgatctattatagtacttttcaaagtatttttgtattaaaaaagagatcctcagattatattgtgaatatcattaatgcagctccttgggtaccctgacccaagagattctgatccattaggtcttcaggttttaatgcagaagcttattttctgacaatcaatagtcaaagagaaaatgattgacactacttatctacatgcctatggtgtctcctcttggtataaagttattattccctcatggttgtgatatctcctatgggataaatggatggaggcaatcatccccgttacatttgatgaatgacttcagtgttgctgaattttctatttcagtttcatagtttagttgagagatcagtcagatactgaatacccaaccaaaacaatcagaatataccacttttcatacccatatcttcaatgctatttcccacttctctattacacactagttctagttttttttctctttctcctacgcttatcaacttttactcctaaagttgtgctacaacacaataatcatgtcctgttttttacttttattatagcaccgttcttctactttttattcagatatatgggcctattttcccttgatcaatctttccccattttgctatgtcatatatggagcctacagctttttgatttaattactctgaaaactgccttatctctctctctctctctctttctctctctctctctctgtgtatacaatactgaattacaacatttacaacacttttttctgtttcacgagggtgagataatcactaatagaaatcaagaaaacctcttgcatgtttaaattttaaaaccatttataaaagataaatcaactgatactagaacctgaactattaacacatagacaaaggttcatagtcaaaaaaaaatgcatgaatttgtgatctttgcattttcatcacatttttcaaggaaactaagatgggaaataaatatgaaaagaatactcttgtgataatattgataaaacagtgagttggctcgatggttctgcgactagaaagatacacagagaactccagagtctggatgaaattttaccaaagaaaaaaaagttctgagtttctctaaatggaaggtaactttgatattttcagcctgattaatcaaatgtgcattttttcacatctatatttccagtgattctggtgcatttggctcatgggtaacaccaatgtatctgactctcctaattatactttgcactttaggaagaaataaaaactgttttttatacttttgcatcactcagagatctttttttttccttttgagatggagtctcactctgtcacccaggctggagcgcaatggtgtgatctcagctcactgcaagcttcgcctcctgggttcacgccattctcttgcctcagcctccctagtagctgggactacaggtgcctgccaccacgcctggctaattttttatatttttagtggagacagggtttcactgtgttagccaggatggtctcagtctcctgacctcatgattctcacgcctcggcctcccaaagagctgggattacaggcgtgagccaccacgcctggcccactcagagatcttaatacaccattttgtatagagtagctactcaattaaatattcatcaaattgaattaaatttagttacttaagatttgttttttctcataccgatttcttccatgctatttcatgctttcataattatcaaattcctttctagtttaagttcttttccctcttgtgcttttgccagcttccagtttcaaagttctattgcaaactaattctaactgaagacgtcattccagttgaaaatgtttagtaactgttctatagttaaagacagttttattttctctgtcatgttgttttttgttttgttttgttttgttttttgagatggagtcttactctgttgcccagcctggagtgcagtggcgtgaccttggcacactgtaacctccacctcccaggctcaagagattctcatgcctcagcctccttagtagctgggattacaggcctgcaccaccatgcctggctaattttttaaatttgttttttagtagagacaggatttctccatattggccaggctagtctcgaactcctgacctctagtgatcttcctgcctcggcctcccagtatgctgagattacaggtgtgagccactgcacctggactgtttgtcttttatgtaggaaatgaaccatcaatttcatcacatctactaatcaagtcaagccacaagtcatttaaaaaatacctgtacttgagccttttattagcagttttacatacagtcaccgaaatgtcatctgtaactatataccatatatatatatatatatatatatatatatatatatatatatatccatgactcttttttctctggggcttattcaacacataacaaagttcattccaggaaaatgggtggttagtctttaaaatggggagaagagttccactttggaatttgtggctctgcttctctgaaagagccttaggcaccatctctccttcattatgtatggcaactacagaatttctattaataccatgcagctgtccaaaggaggaggatgtatgtgtgtgtaagagaatatggtagtggcgattccagttatggttggaagggagagggaggtttacgttagcagatgcaatccaatgctgataaaatatttcctgcatttgtattttggctttatgattttgaaaaaaatattcagacttcagataaataaactttaaagaatagtaataacaacaggctactcttcatagaagctagaattattacactgtctgaacccgaactgagaatctgaatatccacacatggtaaatagaatctgagatgtggatataccacagaagttacgttacttacgtgcaggttgcgttttctgggtcgtgtcatattaaaagtcctgcctgctctgtctagcactgctcctgaaggataaaatctgattgagctctgttcttccagggtctgtatctcctcgtcagattgtttgagttcaaaaaacttagcagtaatttttattttttaggcttccttattttcttgctagaaagcactgatattaaaataataataataataaagcacgaaatgaaatatagcacaaaattacttcccaagactgttgtcagaggataacctaattttcacactttaaagcttgtcagtagaatacctattaaagaagagaaaatgttattttatatgtggaaatcttcagcttccctgctttacaactgtttactctgctgtttaagttatttctgctaaggtttaaaaatgtatgctctgtgacatatggcccatgtctgttagtctgtttctccactgataggaaatcaaatccaaatataacactgttaacaggaagtactttttctatggaatatctgggaatcgctctgtctctgtctctctctttctctccactcagtttcctcttacgtttgaagttgagtatttttaaagaagagccattcttagcattttaatgacaaataaactagctatttatttctaagtggaatgttttatacagttgtaaaatagtaagctccagaactgaaagggactttctcaatataaattattaaaaatgaattattaaagaaacattctttttttgaatgttaccaattagtagttattaaggagagagaagatggaagtaaaggcatagcaattttccagacaaaaagtttatggaaatttagtaatgcaatgtgactacattcttattaaggtcattgcactgctcttggtttgtaagcgtctttaacttgtataactaaacaatcacttatgaacagtgttgtagtttttcttttttctctggctcagataaaattgcagtaagttgagtatcacagggtagtctgtgactgttaattagctttaatagttcctactaaatctgtttgtagcacagaagaaaccacagaatagcagatggtaatctcattctctggtgggagacaactggcattgaatgttgacaagctgagcaggtagaggttaggtttcaattaccagcctttagggcaatcaatgtttgatagtcaaaaatagaatgcatcttttagtcaagacatttcatttgataaaatctgcaggaactatttttttgtgatgttaacgatgctctattaaacaccagctgtgtcaaaaagctattaattgaaaggcaaggaaaaataccaaccaagctcttttcttaatccagtgaccaaggtcaggtctgccacataagagaatctcaagagcaaatgcatagggttacccagaactgagtacagagtcacttttgtgtgtgtgcatgtgtgtttccactctcaagctaagacagagcagacagctaatcattcaggacacaatctactctgtctgccttcattcaccttcaaatatgtcctgtgtagtcacctatatgctttacatgtgtttcctagaacggtcatatccttgccataatatacgataggatgtccttgaaactcctctgccgatgaagcccttgctcatgtcttctttacccataatctcttataagattttggttcagtttaatctggggtacaatgttttttgggtaaatggcagagattgatagatttcccctaactttagggcaaacacaagtactcaaagcattcttaaatctctttaaccgaggctcttcccctccaggaaaaatagaggagattattgatataaattcagattttataaccatccttcacttaagtttactatatgtaagtttaaggtacaataaaattgggcttcttcacttggaaaattcaagtttctctttattagtatttggaaggttgagagcatcattattcatcacactattcaaaggaagaaaggaagggaggagacaggatggagggatggaggaaaagaggagagaaaaatattgaaggaaaagaaagtggtagagagaggaaaatggaagggagcatgaaggaaggaaggataggtagatgtatcggatgctatcattcctactcacctacaggtttggtaactatattctcatataatcagggagaaatgccaaactgtaagcatcccatctttctcacagagtttttgtttttgtttttgagacagtatctctgtcacccaggctggagttgcagtggcacgatcgtagctcactgcagccttgaactcctgggctcaatcgatcctcctgccttggcttcccaatgggttaagattacaggcataagtcaccacacccagccacaaattgtttaatagtgtatttgtttgctagggcagctgcaacaaagtactgcaaactggatggctttaacacatttattgtctcacagttctagagactctaagtccaagatcaaggtgtccacagggttggtttcttctgagggctgtaaggaagaatctgcttcaaacctctcccctagcttttggtggtccttggagatgcaacgcatccgtctctgctttaatgcttatatggcattcttcttgtgtgcttgtctgtgtccaaatttcccccttatacaagaacatctgtatatgtattagggcccactctaaagatttcaattcaacttgattacccttgtcaagatcctaactctaaataaactcacattttgaattaatggaggttgagactccagcatttctcttttgggggaacacattccatctataataaatgacatgtccttttttggtaatattacagaaaaaaagttaatctttaaagtatgtttctcctattgctgccataagacaaacaaacaaaagattcaaggtagtagagcatagtgtactttcttcccatgaaaaaatagtagatgaaatatctattaggaagtatctctatcatggaaaataaagctttgataatttttatcaggtctatagaaaatatggagatgagcctgaagagattaaatacccttggcaccttctttctataggttggagtttagtagcatgtgttagctgaaaatgggatatgcttttaatcatttagtttacaaggtgttgatgtaataggaggaacatatatttaatactttaagatgaataaaggtctagaaatgggtaaaaacaatttcattatttggaaaacaaatataattttgcagattataatagacgttttacaacttgcctgcaaatcagaaatgtacactcacagaagagaagatttgtttgaatttgttcaaactcaaggatgttatttacaaatgtcagtatctgtgacttgcctacataaagcagatagtctactgttccagtccagaataataggaggtgattgacgatccaccaaccagtaagaatattataatatgacacctcgggaaaatattgtaatacaatcataatgtgcattttaagcagcacactttcagacatttttatatgtaaaagttaccacataataaatagaacataggaaaggcaattagtctttactcctcaggttaaaggaaagtatgacataacttatcttaccataagagatattgacctgaattagtttcatttgatcaagtgacaatcagttaggaaaagatagaatttagaaatacaactgcaagtaatttgtaaaattagagttagtgtttgcacatattcaagaattatgtttaacttctctatttccttccttccttccttccttctttcctccctttcccccctcccctcctttctcccttcctccctccttttcattctactacagatctagataggccatttttttctgctgcattaattaattcattcggtaagcgttgaatgaacaacacaatgtgctggtcacattgcttggtccttgggataaaatgccaataaaatcaggtgccgttcttgcttgtaaggagtttatttttaacagaaggtgactgactgactttaacaatcacagatatgtgtgtaaaactgtatcacgttaagtagtatgaagagctggtttatggagctctgagtacccataaatgaatgattggatttgttcacaggggtcaaggaatgtgtccatgaggaggggacactggagctgagttttaggtaagcaattagattagtggaaaggacttcgaaactagggagaacaacatgcatgcaaaggccttgggccaggattaaacagagcaagttagaaagaccggaaagagagagaaacgagtttgaataccctgaggaagcagaagaagaatttccagcgtttttaaggtcatgttaatgacaattttacttttaaagtgttagaaaaccattgaagattcttgagtaagggattaatatggtcattttgaaaagatcactagtgttctccctggagattcaatgggataggtaccatcagactgcttttgcagtggttggagtgagagatgatagtggcttgcattggcatgagaatggcaaagatggaggaaatggacagattaaaagggcaagttcttatgtttgtggtatatgaaacatttccgatggtattgccattcaatgatgtaggaaaggctgaaaaaagacaccttttttgagagaagagaggtgttgaacgtgaattcaattggatatattgggatatatttaagacatcaagagaaactgtcaagtagacagctgggcacaggggcctagaagacagggcaaagtctgtgtggaaaatataaatttgtgggccatatagatggtaactgggccattctaaacgtgatgtatgtgttctccaggtaagaatggatgagaaaaagctagagcagcatagggacagtcttgtggttttttactcttttccctatacaaccaaattgggatgagccctaggtcctctccccatataaatcactaatgggagaacatgatctttctaggggaaggcttatttagtgttgactagcattacaggaagcttttcttgaaaagatataatcagagctttaggtaaactcttccaaaaaaaaggtataaatgcccttagcttcacagcacattgtcagcagtctccatctcaagaagatacaaaataattcaaaacaaatatcatgacataagtaagtatttttgatttgaggttttcataaatatacacacatatatcatgtgcaagacagtccttaggtttctcaaaattaatgattacttctctgtttatttaaagaggaagtttatttccagaattgaattatgtgatctttgcactaaatcctaactaaaaaaagattttgagtacctgtacagctatttattattgtatttatcttttctttagtgtcacttatcaaatgagtaatgtaggcgcagaaatatttgtatttcattgttactgaggtgctcttctaaatgtttggctagagactgtaatctgaattaggatcatgtgtaaccattaatttgctgtcatagtttgatatactaatgtaggtcagtgacaaaacaccactttaaggtactggtagctaataggagcttatcgacatgagaacttgtcaaaaaggcctttcagtgtaaattaagggaagtttgatatatgtcaaaatagctctggaattagaccctcagttctctcattctcaaccattaattaaaatagaggcttcatctgcataatgacatttctggtttatgtcactttttgactattcattttaggtattgaaatttcagtatggaaaatgccattttataatagcttgtttggatatttcttttaattttctacaaatatttggctccttttgagattataatagggaatcaaatacatactttgcattctaaatattaaaatgttatttctaaaaatgctgattctagtgattgattagacagaagcctaccagaattgcttctctcttgataagcctgctagttagttattagatatttccttatttttatatatttaagttgtttgtgatattaagtaaatgaaatagtacttaattaaacaagttattttccatgtttatttttgaaaagcccagtttcagttgaaattttcagcaataattttccttcatttatttgatgaactgacctcaaaaagagaactttagatttgttgacaattttgatcatttctttacatgggcaatatacataaagttgcggtttatttttacaaatgtacttatttttggtttctttggattttgtagaaattattgagaagaaaatgtaatgttttttagtaatgagcaataatattacttttcacatgtttgctccatacatggagatttcagactctcaacaaaaactaaaaatttgaatggttaatgccatgagccagaaagtatggtaagtcctagatatgaattatataacatgagtgctacaacagtatgaggtagaaagccatatcatccccattatataaatgaggaaaaggagattaccttagattatgctagcatttccaactcagcaaatccaacttcacacacatcacaataaattagcaacattgggaagatttaactcttttatcattggagactttataactagaggaaagttttttttgtttgttttttgttttgttttgttttgtttttttgccaataccattaggcagatgtgaaaaaaaaaaacttgtggcagaaaattattattgaaagaataacattgcttttttttctttgctttaaattttgactgttttagttactgctctaaattatgttgatattgtaaaattgtaatgttggtatttgggagataaatccttaggacagtgggccactaaaagtggccttgccaagttgacagagacggtgacctaaaccttaatgagcttggtcattccttggatttttatgtattgtcttatttgctacacaaatgaattgaaaagaattcaaatgagattggaagagtgcaagaagctgttgagtttcattaaggaatgtgggaggaggaaaagcaaaaatctacactggcatcttggaaaatgacaaatacttgttatgctccaatgatgacccaagatttataccacgtgatgcctactgagaccctgccaagaaagtcacttacagtaacacaataagtgaaaaaggcaaactttttagaagttataaatagaggtgttggttttgcttcaggcagacttggtagggcaaagaagagggtgagctttctgaaggccagaaacaaaatttaagacaagtcagaagattctaagtcaataaaaaatgtctggaagttcacagagaaaaatatagtggatccagatagataagtgtttcctttatccatctggattaagagaaccagggtaactgtaaagtagaagtagaaaaagtattatagtcagggagatagagcttagcttagaaataaacttagaaataaactacagaatcattatattagctctgggggaaaaaatgtgctcattgtacaaaaaaattgaaaaatacagtaccatattaagcaaaaagcaaagatatcagaaaattaacttttccaagcatcatcattgttaacattctagttaacgtccctctagacaagtctctaggtacacaatatgcaatagtacattaatggggtcatactatgcacattattcttagcaatatattatggatttctcgtcatgtcaataaactataccatttttgtattggtcatattgtaatctatttatggatttttcacactttattaatccaatgctttatggcttgatatttataattttaccaatcatttaaaaaataaaaccactttaatgattatacttgttcatatcttttccctcttgtatgattatctctgttatcacttttttttttgagacagaatcttgctgtcacccaagttggagtgtaatggtgcaattatagctcactgctgcctcgacctcctggactcaagggaccctcccacctaagcctcacaagtagctagggatacaggctcatgccaccaagcccagctaatttatttttcttttgtcgagataaggtcctgctatattgtgcagggttgtctcaaactcctggctttaagttatcctcctgcctcagcttccaaaagtgcgagattacaggcgtgagccactgtgcctgaaaaattatgttttaagaaaaaaattttgagaacatctttttagagaactcttatgtgtacatactatctgtgtatgtactaagtttacacataaactagaaaatattaatggtgtacacctgcggccagcacactatgggtgggacatggttccattaagcattaatgatcacatcctcataaaatcttttgtggaaggttaaattattaatcagctttacagatacagaaacagaggcacagaaaggtcaaaccatttgcccagtgtgacacagttaagtttagagctcttgctgaaaaaccacagtgcttactcaatctctatacacttcacactcttctcaaactgtgtttttaaaaatcaaataatgtcaatatttttccatgccaatgtaatatttggagttacaagtgtatatttttccatatatgctgttattgacagtttctcccaatataaatattatggtgggcatacttgtatatgtatcttttggcaatttgtcgtcttacagtaatttttttagagatggaccaaaagttaagtatatttcatatttggatcaacattgacaaactgcttccccccacaactgtactgactccatccagtaagtatggaggtatatatttcttcacacttactccagctttagggtaaccaattcattattttacttattacatttactaatatctcaggcaaaaacaaattattgaattatgtaaatttcttttaaaataatttagatagaacaacattgaacatgtatagaccacttgtttttgaaagtacattttgagttgggcatggtggctcatgcctataatcccagtatatggggaggcagaggcaggagagttgcttgagcccaagtgtttgagaccagcctgggtaataacaatgagaccccatctctacaaaacaaaacaaaacaaaacaaaagaggaagaagaaattagccagtcatagtggcttgtgcctgtgtcctcagctacttgggaggctgaggcgggaggattgcttgagcctgggaggttaagtctgcagtgagccaaggtagtgtcactccattccagcctgagtgacagagccagaccttaccttattttaaaaagtaaaataaaaagaaagtacattttgaaaggcaccgatccatgtgttttacagcttagattagttaaagtctaaatagcttatttggtttgacatctaacaaaaacatgatctcatcacttcttcggggttaaaatagaataatttccaagataacatttaaaattaaagttgtgcaaattttggtgtgagaatctaagcaaaataattttacatttaacaatgagagagtatggctacaaataatgcttagttactttttatgtattaatatttcttcattagtttaaaaacggcagggaaatattaattagcagtttgtattagagaaaataggtttatatatatatatatgtatatatataattaaatttaaaaatcttgtatatttaagtgttgtgagtcatccatttgattttccattattattaagattctaaggttctgtgataggccaggcatggtggctcatgcctgaaattccagcatttcaggaggcagaggtgggaggatcatatgaggctaggagttcaagaccagcctgggcagcatggaaataccctatctctacaaaaaaaaaaaacaaaacaaaacaaaaaaaaaactaaaaactagctgggcatggtggcatgaccttgtagtcctagctgctcaggaggttgagatgggaagatcctttcagctcagaaggttacaggttacggtgatttgtgatggtgccactgccttaaaaaacaaaaaggactgtcatgacaatgcaaatttcctatattgtttattttattaacaaactctaacattattaatgacacttcttagaagaggtgtttattaatttattcaggagaatgaagtatattctctttaccactgaaagtagggtcttgctctatggcaagccaaaatggtaaaagtgcttgtggagaggccagagtgtgaggctcagccctgggagcctgaggttacaggtaatctggaagatggcagatataagaaggttcctgggaagtaccatgccacattgccacatatgtgaatcactgagatacatacttacagagcgaatttcagaactccatcctcaaataaatgaaaattgaattgtttgagcagaaattttggataattcagctcctatatataaatctatgagattgtcaaagcctaatattttaaaaattaggagctgaattgtaatatgtactaataattgcttatgtttcacattgtatggtttagacaaatgtttttactttagattctcatggcaccaattaacttaataagagtatcttttttatcagagtataaattatttatatttctttttctgtattctattcttgctccccaaatccccaaagacacaaaggaatgtctagacttttaaaaatgggaatgcagcagggtaaaatgaaattataatatatataaaaaatcacaaaatgtgtttctagcataaggcagaattggcatcaaaactaagctttggcaattcacaaaccttcactggggatattaattttgttcaaatggaaataaaaaacacatgatcttcagggttttagagaggactatagatcatcaaaaaataacatgaattacacaggtgcttgatatttactaagtttacagtccatgagggtattgccccagtggagtctgaatcatttctaccttgtggtaaactgttcttctgccttttgtagaaggagaaaagagccagacttggggtatgttccattatctcactgatctctgtctcctgggatccaagatgtttttttttgacaggctaagaaacttgtccatggggctagtcacaggcagtggcagtgatttctcaatggagagaaacagtggggacattggcaggccagatcctcacaattctctgcctactattgctactcttggaaaagcaaattgaagttttcattgttgtcatatttcacagtaaattttatttgttttcttgatgagttaggctggaagaaataacgtctctctctaattacccaatttatgcttaaggttggagcacaatgataagactaatttcattttggttagtatttgctggggctttgtggatgtttccaagaaaactgaagagcccttaattttagagaaggatttaagtatacatttcagtctacagagattaaaaatgatgtcattagtacctctgcctttaggagtcctgatctcttaaggtgctgtgataatttataagaggcaaggaagatttggttcaaagaaccttgaagagttcattgcccacatgatatatggcttctgacactattaacaggatgccatttcacaagtttgatttggagggaaagacctgatcaaagattttaaggattaaatgccatcctttcctgcagtgttataatagcttctctcccacttttactatattcttgtacaaatttcaaaacctataaaaagtggtaccataaaggcaagaggtaagctccattgtttttatctcagctttcttgtttgtttgtttgttttatactctatgacctagttgccaagatttctggaatatttatggggtttttggtctaaaatttactgatttggtaaatatctaatttaacctttagtgggagacaattcaggatgtagcataggatccaatataaaaaaaggaacatatatatatatattcattatgtgatgttacattcataccaaagaagaggaaagcttagttccctacaatatttaccttcaagttggggtattccacttagtttatacaagtcgtttgagcaacatgagattagttagatatttgatggattttcaaatatctcccaggttcaggtcaaatctactgggaagaacatagtgagggacttagggcgggaacagccaggtagagacagggaacatggatgaccgatggctatgcgtgactgcctagacttgatggcccatggttcttctctggcatacttgtcagaagttgtcaaatgctgtatttgaaaagaatgttatgaaccttagattcagtgtaactttttttttcatctctaaaacatgcaagggtttttgaagttttaggcttagatgctaatagggaactcttctaggtgaaaacaaataaaggtaatcctgatgaaatctgaagctgccaatgtgtaaatcttcatgaaataacatttttagaattgatattgctttgttttaaaaaataggacacttgttgttttgtggaagataattcagaataatattttgcaattttgtattcaattttttataaagttaatacttgtcaaacaagatagtttttacacagaaaatatgattgctttttatcattgtcttaccattagaatttaaattacataatttattttttgtttaccattaaaatttaatgtacatttaatgtaagtttaaattgttattgaatgtcattgctctcttttgatgacaaactttcatctgtctttcaaaatagtataccatatactgcacataaacaagtaatttgactttaaataacaaattaaattaaaatttaacttaaattaaatgtttaaagttttttctttaaattcttggttaacatcaacctaaaaaattatgtcaacttttattatttagcaaacgttaataattgccatctgaagccagaagcttctggatttaatttaattgccttactttgggctttgtaaagtctcttagagtggttcagttactttataacaatgctacccaacatgtactaaggaaataatacaaaatattaaaaacctttaataatcaaggcctttcaactaaagtcatatgagaaagatataaccttctcttgattaaatccagtatatcaataggatcttactactttcactttacaactcatcaaattaaggacaaaaaaatatttatctctagtggacaggaatacaatgttaaccaaacatggcggtgggaggttggtagagggagtgcagaaataagtttacattgatgtggatattgtagttagtttaaaataaccaatggaatcaaacaaataaaatgatctgcagtctgacttaaaataatatatatgttgtttatgtatcagaatatttttctatttgggattacataaatgacaattacagaaagattttaaccattttttgaagaaattattgaatagatatacaagttgaacatttagcttatgtgcatgtttggatatgtgtttatgttcatgggtgcagggagtatggcagtgggataaaagaatagtctttattgtgttatagtataggacaagtatgtaatttcaaagatctttgcatagaagtaaaagcaagtaagctaaggctgaaggagagcaaatgatcacaataatgaccaaaaaaagaaatagcgatttaccaaagtggtcttctattttcctgccctgttcttttagaaatacaaatgataggcagagccagactgtagtagacagaggagggcaaagcacatgccaaggatggctgtgaatgtgttatcattatttctaatcactagacagtaaaggaaagacaagaggagtcctgttgatgggaggataaatgttgctcttttgtctctgtttttttttttaatgggacacactaagcttatttatatgctgtagcatatttaaatgctgtgaggattagccttgattgttttacagaagatattaaacagctttgagagattccctcatatgtggtcctgaagttgacagagttgaatttgtaaaaaaaaaaaaaaaaaaaactaacagaaagagagggaaaaaagaaaagaaagaaagtggccttttagagaaatttattttttaagaatgtggaaggatactagaaaataatattgtagtggcaaaaagttgcagttgtgctagaagtacaaacatgatgagttgttgtttcttatgattaaagtaattattctttgcagtcctaaaatgctggtacaatattgttgaaatattcagtttttcacttatcactcctttttacatatgagtaagcctaaatagcggttttactatttgcttcaagcttgatttgacctactgagatctttttcctcagtcaaaccacacatcgttcatcttttgactccaattctctgcagccattgctcagtcaaaattcactaatgctgccttaattcccaaaggcaatgaccttttgtctgtgctgctcctaactgacaactccatggtatgtaatatttttggacagtccactgtgctcggctgtctacttatgtaacttctaaagcacctcattttctttgttctccttctacctctctgactttataatcgcactaagtctctttctttagcttctctagttaagaatacatatttatcatggttctatcataacttattctcactctacatgctctcctatagaactctcctctattctatgtagcatcaactaccattgaaagctctaaaacttaatgtccagcaacaacttgtcaactattggtgaactcaccatcagcatccaaaactgaattctccaccttcttcttcaaatcttcatatttttttcctgcctttttttttcccccccacagagtatctctctgtcacctaggctggagtgcagtgacaagatctcggatcttgtctcactgcaacctccgcctcctgggttcaagcaattctcctgcttcagcctcccaagtagctaggactacaggcacccaccaccacacctggctaatttttgtatttccagtagagactgggtttcaccatgttagccaggctggtctcaaactcctgacctcaggtgatctgcctgcctcggactcccaaagtcctgggattacaggcataagccaccacagctggccctgtcaaattttttgataataaaacatgtaatgtaactaggctaatgaggaagatgttaggcaatggagttgtcaacaacaggagtaatatggactaggactgtatgcacaaaaaatatataaaaatcagtttagaatatcattgtgaaaaagggaggtgggggagatctcatgtaatatattaaaccagaaactcagataggaaagaaaagaatggaagccaccatatccttgaagtactatacacgtgctacattgaacattttgagataaacagaagaaaccaatcattgacaatgctgattagctaaatgtaacatgttgtagaaaactgagaagtgttttatgaaagcgtatgatcacttaaatcaatagaaagctgggaagaaagtttgattattgttatgtttgctttacaagcaaaacagaatgacagctaagagaatggtataagtaatacatactgactcttggccatgtgagaacagtaaggtataggctgtctgtctgtctctatctgtctatctgcctctctctctctctctctctctctctccctctttctctttctctgtctctctatctctctgtctgtcttcaaaatatcaatagtacatgagtaatgctggcacagcatggtttgctgagctgttcactagaggttctaggagagggaccagtgaacatccttctctccacactacttaactaaacagatctgttaccttaaccaagaacataagttacattgacctagtgtggaagagtagcaacatgccagtggcaacttgaattcccagagaatagctgcgtgagggatttgagagatttaactaaaaaaccaggctcttacttgaagctcttagcagagaggaagctccttgtaccaaaaccataaataaaaccataaatgcctgattagcagcacgtttttcaggaagcatcgccattactgaaaaaagtttcttcatcagaaacatttctcatctaagccctcatgccaacaaccctccacccccaatgaattgggcttagggcccctcatctcaagattcccccaacggtgggtaatgtgagttccatggcgatcaagaaactatctcctattaaaataaaaaattgtcatctttcacctagtcagggtataaacttcagtgtcatcttaactctttccctcaccctcagattcagttaattgtcatgtcctttctaacaagacctctaaaatgcatctctcctccattatccattcccaggcctctccagtgtctctcctatgtctgagacatagtggcaagctgataaggctgtacagtggcaaggtatggagtaaatgataaactacaggggatacatttttacatggttatttcagaaacacaatagacactggcatattacaaaggcatatttcagatttgcctttgagcacactgttttctctctctgaaatctccttcctcttttgctcccaagagcatctctccaaacttaggttaaatgtcactgactttgcgaaacttgttagactcccccaggcagatttagctatcgtctgctttgtctttgtttagtacttttcattttcttctgttagagtgtctatcctattcaattatcatataattttaaataatttagacaaacccagtaggctgtaagcctttagcaggtgcagctcatggcattaatcatcatatccccagcacagagtctcatgcctgctatagcagctgctcaataaatatacgcttgaaagtctatatatgaggtgaaaggattaaaatgcccctggttgttgccattgtagaataatttatttgtactatttctccagagtgaatttggtttaactttcaaaagtatattctaacaagataaaagaatgtctctcttttgcccttttaggctgacctcttcaacccaaagccaaaatgtcctcggattaagacagttgatatgattagtgttaggaaagattttacataatgaaatttggtttacttcaagaaaatttggatgaatatgagtctcatgcaatattttaacattgtaattcattgctgactctacagggcaaaggagatcttaacccttagtccaatttaaggatgatgaattgaggttttttaccaacaaggcagaggatcagagatgtcttgcttcaggtataaaactgcaaattgcatttatatttaaagtaagcaaatgcactgccataatagttgatattttgctaaagtaagaagttgatgtcattatagtgatagttgctaaaatagaaactaaaactcaattagtaaataaatacctcctctgtgctgtgaattatgtgatatggggatgatgccaaaaatgatgctcagtctggcactgagatgcttactatcgtgtttgaatgtggagagaaaggaaaatcacaaagcaataaatacatacctcatggaagaaaagagaagataatcatttataagtaatccaagaaggtatcaggaacatgggtccaattattggtatgggaatcttagatgggagaacattataagcaaagacacttaaaatctcagggttctttgcattctcactgaggatagcctgatattacagagaaatgggacttttagttggatggtaagcatgaggacccttgacagagggcctaaatgccacccatgcacagcgattaggactctatgaaatgtcatagggagatattgtaggttcttaagcagagaaacaacataatgtaaatagaaatttcaaaatactattttgatcattgtgaaatgtcatggatttggcaggtactggaggtaggatgatgaactgggacaacattctattgtgaagtttggttaagtttggagcaattctgctacttacattcttaatctagtttatggtgctctaactgctttattaatggtttctcaatagttttttatacccctagcctagtctaggtctgggtctagtttgggagttatttagaacactaatttaactatgacagacatagtttaaatagacagcatcaagtaatgaaaagaacaataggccagtggctttggtctcgtttagccacaactagccacaggattgtgacaaagtcatttgatgtcctcaggcttttctttcctaatcgggaaataagagtgctgacctatatgaactctaaggtcctttcaagtgagctttgtgcacataaaagaattaagggaagcttccaaaatactctcattatcgttgagcagctaaaatattgagcacatattttgatgaatactaaaaggaagacaacttccacacttaaaatttgatgaaatattccaccctcctacaggataggtggtaggttcatgatgactgcagtatgcaggcaattaccttttccaagaatgtgttataatatagaagaaaaatagcagaaaattaacccttgtaaatgtcacagtgtgcttactgtataatttaagtggtttaaataaagctacttatttgcataatgatgtttttgaaagatataccttaaaaataacaatactaagcattgatttgaaattaaaacaaaaataacaagtgtaaattagtctggaaaggatgtcatgtcactatataattagatatattaataaacgtgggctatcactatcacatatgaagctaaagttagcatggaaatatattttaagataatagatctgtattttctattgaacatttattttattttattttgcaagcatttatagattttcatcaattcgttaacctctataatatggatatgactatattagacagatgcctaaaaataagtacttcactagtattacttatctaaattgaagtccaaatttgatcactgcctgaaatgatttgtaggaaatgtggtgtgaaacatatcagagcactaagagaaacaccaaagataaggatttctaatgtcataaaaccaaacgaattattacaatgtctagacagagtccagagacatgatggaaaatttttaataaattggttttatagaccaagctggacatttgacttaagcatcatttaatttttcaaatcagataaaatgatgcatagcagaaagtttagttactttaaaaagacaaaggaaaaggatattttattccttggagtatttttctttagccaacgaatataatacccagaacctagtctaactagctctgtcattgcagctatctgagtgtttggtaaaaatgcagattcctggggattcctgcagatatatcaggtctctgaacacctttgaaatttgtatttttaacaagttcttgaggggtgtttattatgcgtatttaatgtcaagaccacttttctagaagtactgttttgttcttattctactattggaaacttttacccatcattttgatgatggatattggaaagcagggttctgagtttcaaggttgagtaacaggattatgctttggtacctagaaagagctggacataaccagttgttttattaatcataagcggtcttttccatcttccagtttctgcctgaaattgagaaagataatgaaatacaacctgatgtcaattattaagctctatgggtagactgtgcatttatgttatataaaacaaaatagtagatattgaaaactattctattttactttcagaacacagcttttcccagaatgatttttttcatgagttggccttataatctttttttcttccatagaatcaccaaatttattttaaaattctataagattcattgtctttaatgttagataaaacattcctaatatgctggcactggcgttaatttttaagcaatcacaacctctgctagtaatactactgtttaggttgaagatatctatcaggaaattcttgagatcactgtcctttacatgaagatataacctttccacttgcctttaactgaaatgatcattctctttcactcccaaatgtatgacaaacaaaaatgcttagttcacaaaaggaattgatctccaatttgaagctagtagctgtcaataatttacttgatggcaagcagcatatcttattagctaagtacttctctcatgactcacagaaagtttccatgtagttgtccccaacgatgtgtaagtcaaggagtgttagttaaattttactggccccttggcactgaagtaggagaaaattatatttagaaatttgggcagctttatgctaatgaagtttcttttgaatcagaattttagactcaggcgacaatggtatattgtcttcttccatggcttaatcaagaatcatactttgtttacatcaatacagatgtctataagtatggtaaattaagttggttttcacttcctgaaaaccaaatcatcttattcgtgagcttattaacttgcgcgctacatgacttaaataattaacagacaaatgtcaatgtcttccattcaaattcccttttctcctccaattgtcttctttcttttgcactacatatttttggtgcaatattccttactatgttaaaatttgaactcagaaaggaagggaccttctcacattttaacaatcaaattttatcttgtggtcttgtattgatggtgatttcctgaggttcttccactaccttgttcccctggaaatgtgttggtcactgttagataaatttgaagatttcttccagcaaaatctttaatgccttggggaggtgttaagactgatgaatctgactaatctgactatggtgaagtctaataagaattgcttttatagtcaagatggttcatgagaagatcactgacttaccttttcatgtatcttgtctctcttcttcctgactcgacagctcctcccacggttcgtattgtgcactcaggcttggcctgtaacattgaagaggagcgctactccgaaagggtctacactatccgggaaggagaaacccttgagttgacttgtctagtcacaggacatccacgtccacaggtgagtcccgaactgtgacactggagaaaacattctctgacttttctcagaagtcaaaaagtgtatattttagaatatttagctaaaactgtgtgtgtgtgtgtgtgtgtgtgtgggtgggtgtgggtgtgtgtgtgtgtaactcaagtgcaagtatatgtgcaacgcaggacaagagtgtggatttcggaacattcaaacttgagctattcttttgtataagatgaaaaaagaaatttttgttttggtattgtgggaaatgtagaagacacttctaaggaagctgttaaacagacaactacaaaaatatctcagtaggataacaattcatatggcaatgagtttattttaaaacgtggaacatgatttcatgatgacataattgcaaccgagaggtatttgttctgaagaatgtgaagcatgaggtcacacatacttttcttactccttgtcattttattcatagaaaaccttgaaaaacaaacagttgcagatactgtatgcactcaggccttcagaatcgtcatccacagctttcttaaactaatttaatagaagcaataaaaatggagacttttaaagggcactaaaattacaatatgcaaaggcaaagcccaggtgtggtggctcacgcttacaacctcagcactttgtgaggctgaggcaaggggatcatttgaggccagaagttggcgaccagcctgggcaacaaaaggagactgtgtctctacaaaaaaaaaaaaaaattaaaaaattatctgggcctggtgttgcacacccgtagtctcagctactctggaggctgacgtgggaggatcacttaagcccaggaggtcaaggctgcaggttgtcatgattgtaccaccacactccagtctgggcaacagagagagaccctttctcaaacaaacaacagccaaaaaaaaaagaataaaaaatttgtaggaacaaaagaaacagttatatagaagataatatgtttaggttatatatatatgatgcaacaatctaatttagatgcagaatattgaggatgttttactcaataattgataattcttattgtcaatgaccttactagctcaaaattcacatttgtaatcaacacaagcactatggtaggaaaaatagtttcactcagtagacaaaattacatattttaagtatttgtgttacaggaaaaaagaaatccagctaacaaagctacagagggaaaagcgaaaagtaatgtggagattttatgaactcaccattttaaccctgtttttaacttctgccattcttaactcttactgacggatccttaagtatctttttatttaccattttgactctgaaatgataaaaataggcatataaagcatcacagaatgaagcattaaatagataagactatggctaaaacagaaatggtaaaatatgtttaataaaactcatgctgttggtaaaatgaaaaagaacaaaagtaatctgaaagaataattattaaaaatgttgaaaaaggaaaactcacgataactaaaatttcaaagtataacatttgctattaactgaaaatggattaaagaataaaattgtcataatgaaatttagagaaacacaatttgagccaggataattacgcttgatagaaaaaaaagattccaaaagacaacatacaaggacagactgatgactgataattgttaaaaattgaaacaaggaaatggatatgtgaaacattttcattttaaaatttatacagaaaacaatgaagtccagtgaaaataatgttaccaaaaatttaaacaatgatagacttaattcaagataatattaactcaaggaaaatatagtgttgttataatttgattatattttttgttttgtagacatggaatagaaatttcagaatcaaaagttgggatctaaacaggagggtctaaacacatccaaaagaagccttgaagagctttatgagaggcagtttatggcaagagaagactcattgaggttcccattagtcccacaaagagtgtactaaatttacaccttctgaactccaaattatattttaaaatgcaacttcttatctctgtttctaacataccccaggtgttgctctgctgcctctctctccatcctcctgtccccttaatattagaaatttcccattttatccatacattttccctttttatcattcacaatcaggagtacaaactttgacctctagacaaaccagattaggttctgaaacaaagtagatcatgcatttttatttttttcctaagcaattccattttttggaaacatttcaaggtgttttgatcctaagaaaaatgtattgttttggtatcaatatttttttattcctagaagtaattaaggtgtttgcaggtgaatcagtttcagcttatattgcccattgaaaaattaactgggcggctgggcgcggtggctcacgcctgtaatcccagcactttaggaggccaaggcgggcggatcacgaggtcaggagatcgagaccatcctggctaacgtggtgaaaccctgtctctactaaaaatgcaaaaaaaattagccggacgtggtcgcgggtgcctgtagtcccagctactcaggaggctgaggcaggagaatggcgtgaacctgggaggcggagcttgcagtgagccgagatcgtgccactgcactccagcctgggcgacagaacgagactctgtctcaaaaaaaaaaaaaaaaaaagaaaaattaagtgggcctcttcattgtcaacaaactgtataaggaaagctgacagaacacctgggccctggcatcccggccaaagtctaaagggcaatgctgttggcagctggtcctgaggatgatttttcttggctgatatgagaaagctggaatgactttctcgcttggtctaatctgagtataataatagttggaaatgcagtggaagagagaggttcctcattcactcatcagcagatttcttaatctgctgcctattcttgtagcagtaagagtcataaagattgtttatttccaaaagtattgtaaacagcattttttctagcctctttaattttttttatggtatattgtttagtgatgggtagtggcctgagagtattgatgtatccaaagaaaatgaaacaagtgaaggagaggtcagtacgatgcaatggttaagagcatgatgctggaatcagattgtctggatgtaaccctggctccaccaggactaacagtgtgaccttggaaaagttccgtaatctcccagctttctgtgcctcagttttcttttttatatattagggatgataataactatcttatatcatagaatccttttgagagttaaatttatattatggatatatatacacacatatattctgtgtgtgtatatatacacatattcatatatatacaaacacacacatacaaatacaactatacattcttggtacataagcattatgtcagcatgtaatagaaacatatgttggctttattatttttcagtaatttaggaccatcagctctaagatctagatttggatgtgtaggtatgaaaataagtagattttaaaaatggttttagcattcctatatcctgctttaaattacatgcatttaaatcaatttcagtatttgttgtgttttattgctctgcatagcctttacatctctgttaattagcctttttagcttgcaaggaatagaactatgttcagactacctcgtttaatgagggtttattacaaagatgcatgaagaagtaagaaagaaagaaagtaagggtttgccagtaaatctaacaatctagtacaaactctagatgtctacagcttcaggattcagctaccctttttctttccttccctgcccccctcctaacctccctgccccttcccttcccttcccttcccttcacacccctccactccccttcccttcactcccctccactccccttcccttcccttcactcccctccactcccctctcctcccctcccttcctctttcttctttctctctcaaaattgtcacgtcaataatttaaatacattataaatatagtcttcttgtaaatgacttaaacagtaggatatttaacataaatgtttctcttctcactcctacctgccctccttcccagcagtagatattaaatagtttggcatatcacctttcagttctcgttcgttgcatttccttaaatgtaattatttatgttcatgttccatttttaataagtgagataatgaaaagtattattctatgactagaatttttcacttggccatgtgtccaaaacaccaagtatgggtcaaggctggtagttcttaatatgtggtttctggagataattgattaaaaatgaagattctcagatcccttcacattagaaacccctgcattggggccagcaattcatgttttagcaagccctccaagtgaatctgatgtccactaaagtttgaaccagtggcctggatcattgtcttcactcaggctgaatagttctttgtatgggtgcactgagttttgctgtgagtactctcaaatgtgtataattgctgctgtgtccttcatcatgaaattacttacagatggtcactgttataaacaatccaatgaatacttgtagggtatatgtttgtgttgcctgtatgtacatctttgtgaaatgtatggtagcattgctgtagcatagtttccttcctcaaaatggaattatttagccaaagttgaaagggacctgttacttgctttctcaacggcagtgtattttttttatttttgtcaatttgattcaagaaagtaaattacactctattgtagtttaaatttgcattttaaatcactagccaatttgaacattttcccacatgtttatcagtcacttgtacatctctatttactggttgctgtttatcttctcttttcttactagtttgctgcttatcttcttgtagacttgtgacgacaaatatactacgtaaataaattcaattgctgataaacatgttgccaattgcacctcccagtgtgttacttgtgttttaagattgtttaagatacttttgttctcaagtttttgtttttaaaagatgaattgtttttggcttctgagttttgtagctactttagcaagatctccttatatccatttttttttctaacagcttaaagtcatttatgtatttgacaatttaatcatcaggaaatcattttgtccttagtatgaagtgttagtctagtgttctctttgtctttttcttctctctctttccctcttgcccttatacaaacaagatggtcaatattccactgcacagcttcaaaatgatatttttagcattagcaaaattacattagtctgcaccttactgttattcttttctgtaccaattccattttaacttctacagctttactatatctatctatctatctatctatctatctatctatctatctatctatcttatcatctatctatatatgtatatttttagacagagtctcactctgtcgtccaggcttgagtgcaagtggcacaatctcggctaactgcaacctccgcctcttgggttcaagtgattctcccacctcagtctactgagtagctgggattacaggcacgtaccactaccccctaataatttttgtatttttaataaagacccagtttccccatgtaggccaggctggtctcaaactcctgacctcgggtgattcgcccacctcagcctcccaaagtgctaggattacagttgtgagccactgcgcccggcctataatacattttgatatataaatgagcaggtcattcctttatagttgttttaaaatatttcctcagttgacctcaaacattttttatctaccctatgaattagaaaatatgattttcatgttctccacccaaataaatgttgagattttagttacattgctttattcttgcaatgaggtcatatgtagaaagtatgaccggtttttaaaaggaagttctcagtaggaatactgaacatttgaactcttaatatttcagacttctcagatagcaatacaatttaattgtaaccagtataatgtgtgggtctttgaatttcttttaataataaacataggtatgcctgtttgcaaggttggaagatactgaccttctccgttcaaaaataaaacaaagaaagaatgtgcatcaatcaaagcagctctgcttttcttctttttatatgctggctttctgggtaagatttcatttgaataatatttttcatcactaaaatatttttgaaagccactctttaaaaataattatgtaaatccaaaacactaggaagcattaaaattgtctagtagtttattacaccttaaccttagtgagcatttgctttttgcataaaaaaatttggctaggccatttttcaattttataatagaattgtattcagtcatttgattgttgtataaatgcatttttaactaccaaggctgttgcagagttattgatgcttttgtccttgttaatcttctatgcagattctcaaatggtaatcttaccatgataaaaatcttagcaaacattagtagccagttcttcagtttgaaaccattagtgctacatgtattgttctttgcagatattttatatatcttgattcatattcctatacttttttctgatttagtctattaaattttttacaaaatgagagtgcatgcacttgaataagaaacatactagatttttggatttatctccaattaatgtgggcaggtttaggttctactataatcaaatattatattaattcttttttgtgttttataaaattaatataatttgctttttttcgtctgtgataaacatatctagactgaatctgtctgctatatcatgttagagagtttccaactaaaataactaatactttttcaaataatctttggataagatgtggaaaatgtttaggataagcatccaaacatttatttttaaaaaaattccacatcagctgggtgcagtggctcactcatgtaatcccaggactttgggaggcccgaggtcagcagattgcttgagctcaggagttcgagaccagcctgggcaacatgacgaaaccttgtttttacaaagaaataaaaaaattagccaggtgtggtgacatttgcctgtagttccagctagtcgggatgctgaggtgggaggattgcttgagcctggggaggtcaaggctgcactgagccctgatcttgcctgggcgaaagagcaaaagcctgtctcaaaaaaaaaaaaaaaaaaaaaaagattgccatatcaatggctgctttcacaatccctgcctctacctcatgtacttagtcccatctccaggtgatgtacatctttattaagttcatggttacatgaataaatgtattagcatagcttgtttaggaggaaacacttacagtcttccttatagtcttcaaatagttttgtttccattgatttttatatagaataagaaaggctttttggggtcaacactttaacatactcctaaattgctaatactttttactctcagtgtatcagcatcaaccaaagatttttagaaattttattaaaattctcaagaaaagttatttttgttcatcatatttacctatctactattctctcagaattcatcttttgtttaattttatgaacaatctaaaacatctcattcattccagatactatctcaaaaaatattagatcatttaacagagtgccaagcacaacataaatgcttagtaaatgataatcgtatttgtgattgagtcgttgatactaaataataatttatttacaaacttaataattataagctattactcttatcactatatacttacatttaactcaacaaagtaggtggagtattcttgcctgtcccattgaaatttgtctcttctctatgcctggatttggctcctggactttgagtagaggtaatgtgggtctagagtgtgacgatactgggctaggactaatttaagaataaagtactcttccatgacttgggttaattatgagtaagaatacctggagctagtcctaatatgccgttatgatagttctttgaaatttaaacatcatgaggacttatagtaagagagctagagatataggagctatcttcacagaatattaaaacttagaagactcagggaggtgggaatgttagcacatatttattatatgagactcatttttagagggttcccaaggcattcactgtgagaaatgcagtagtcagatggacactggcatctctgagaagctcagggtgactgtcctctgtatcccagggtgtagtaggagatgctaccatagaacaaggatctctaaactcaatggtctgactgccattttcagaaatggcagaagtttagtagtaacacttcaccaacagactcaatatagatatcaatagtgtgaagagcaacaaggtcagaatagcaaccagaattcgtttatcaacaagggtttatgacaatggataatatatcatagtgtttttagggatgaaatacaagggtagctgactagagtggtacttgacttatctaaaaagacaaaaatgacaccttgaggaagtaggcattttccgctataatggaagatcacaatcattcatccagtttccaaatttaaactacttcatggagccaactcttactggttgaaagggaaaccaagttttcttaaagaaagacctagcaatatccctgaaagttacacaaaaatgctgtctcaatccttccttcaaaggatttatggccattttacatagcagcttacactggaaaaagtgaactagcaaagccttttgagggctcttaaaggtacagatcctgagctagcactgacatcaatggacttctaatgctaatgggggcttatgaaagacaagcgataaatggagttctagcctgggtaagtggattgatctacggttatttccccagactcccaagtacataattgggaccaacatacttagcaacaagcaggatcctcacactggttatatgacctgtgaaataagtcagaatcattttagtagaaaagacctagtggaatcctataaaactgttcttcccaaaccgatgtatgaaatcatcagtaacactgcttctcaggagaaacttcagaggctatatgctaccgtcaaagctttaagagtgaaggagtcatagtctccatcatgcatctattcatttcacatgtaaagcaactaaaaagtcaggcggattatgatatataatagcttatggtaaacaaccaaatcagcgcagctgctggatcagatgtggtatcttcactggaacaaaatcacacccctggcactagctggtatgcagctagtaatctaacaaatgcatgctttttaattcttatcatgaaagagaatttagaagtttgctcttatgtgggatagacagtaatccacatgtacatatctgccctagatcagggctaacgctcactctctgtaatattacagtgcacaaggaacttgattgtcttggtaacctagagatgattacacgatggtctcctaacatgattgttcaactttacaatggtgcaaaagtcataagcattcagcagaaatcttactttgaattttgaaatttgactgtttcccaggctagtgatgtgcagtacgatattcccttgtgatgaggtgcagtggcagcgagcttcagctctcagacagccacgtaatgctgataatctacagcgtactgtgtatccagatgattttgcctaactgtgggctaatgtaagtgttctaagcatgtttaagataggctaggctacactatgacatttggtaggttagatgtattaagtgcattttcaactcacgatattttcaagttgcgttggggttatcaggagataaccccattataagttaaggagcatctgtactggtccattgcattgattacatcatggcattttttacctagtgaacaggaagcagcgagtagtgtggatgccatagtaagatgtgtgcataacggaaggtggtaaaagttgttgctcttcacaagtcctatcactaagaatggggtgcagaataagatagacctttggattctatgggctgcacatactacatttaaaatatttctccaagtcattttatcagttaattttgaaggctggcagtttcgagtagggctaagagcaagaaagtgttcagcagcaagtccagctttcagtgaaaatcgccttactgctcaggcaatacaatctagctgctttgatgttggataaagatgctgtgtagattcttcagtaagtttgagaagagaatcacagcacagaactttagattttggagcaagactaagctttctgcagcgaagtactaattgctgtttgaaaagcctctgtttggttaattaaaagtaggttttagttgatacatgctccctttgttgtcccttggtcagggagttctgggcacattctacatgtcttctcagagattcacagtagaatggagtctgttactctaagcaatgaccagaggaatcacactttcttatattgtgttttttttttttcattctttgtgtcactgttctaaatcctctacatggtttccctgggattatttcccaaaataaactcctttttatagaattttcaagctcaatgaggagtgtatccatacatgtgaccctagtatcttcttctttgctgctgacctgtgttgcttaactgtgattcagaattattgtacttttattttcttatagacttgtaaagaaaagccataagtcattagccagggtataatgtttagtgaaattttgtttttatttcttaagacctttatgtaacataattagcatgaatatatttctaagtctgtctggactgctataacaaaataacataaactgggtggcttataaacaatagaaatttatttttcacagtcctgggggctgagaaatccaagattaaggcacctgcagattccatgtatgatgagggcttgctttctcatacttgttctcctttttattttaatctcatatggcagaaagggtgcacaagctctctagggtctcctttttaagggtactaatcccattcatgaggtctctacccttgtgacctaatcacctcccataggccccgtctactaataccatcctactggggattaggattccaaaatatgaatgaattctggggagggacacatattcagagcatagcagtatagggctatattttccttgtttgttcttctcatctcttaaaaaaaatgtcttttacttgaactaaatctaagcattttacgtttgcaagttcatgcacaaggaattttgtgtgatagagatttatgatataaatgcaaagtaaggatttgtttggtcctaacaactttgccactcacattttctgatggtcaaaattggatcatgtgggagctcagaaaatggatctgaaaactcagaatcaaaataattagatatacaacttagttgaaaatttgaaattagatgtctctctgtgaaatctatgtattttaatgaaaaatattatataggtagaaggataaggtcagaaccattgttttactacaagagttgatatgaaataagtatttgaagattatcagggcgtttcaagaagaaagaaataccatctgtcaacatagaattgaaaatctattgattgcattgctcatagttataaatatatcattttaaggaaaacagttgtaatttttttaatgtggaaattctgaacagttacatgaacatcgatgaattggattttgtatttttattatttgaagactcttattgacatagttcagaaatgtattatttaagtaggaagatcaccaaatggtagatatttcacaatatgtttttgttcctcagattaaccaacttcagcatagcctgaagagacttttttaatcatgaaatgataatcaaattaattgatctagtatatgagtctgtattatgtatatgccttaagtatgagagtgtgtgcgtgtgtgtgtgtgtgtgtgtgtgtgtgtgtgtgtaagtccagaaagtatgagttatttgttatatccacccctattattttaaaaaggtagcatgaaataaatatagtagcaatctacttgtggtcctattgaacacaatttatccttttcacttttggttagcacattaaagatgccaattaagacaattaatttacttgagttttcaaatctctaatctaatgaaacactcattaaaatgactttaaaggaggtttcagacttaagtttaataacttacaaatatagaaaatactgcctatctgcttctatgctaaggaatatgccgtcagtggtaattaataatctatacaactgctggttgtaaacatgatacatttattctaaattacgctcatcacagccattttctgaaaagctgcaagatgcttcaaacaaaatcagtaaggaataacaatctttctgtgatctgaaaaagttaacttatactacacaaggaaagtgcctataaaatgtatttccagaaccgaaaaataagaaaacagttattaagaatgattcaatcaattctttttttaaggaattgttaatcttttattttgacttccttttaatgccaaggtcttaacaaaaaaactaaaaataacatttattttcctggcagttttatccttttccatcagcaaacattgatttcttcctttttctgcttcttgtggtacatgagaaaacattatcttctacaacctggccccttcttgtttacttactcgcctttggcagaaatcattaaatgatgctggataagcttgagcagaacatgatccttggttaattagtgccttcactggtggatttcatagaaattctgtatttttaaaaattaacttttgtgcatctgggtctgcaatatggtatcaaattgacgtgaattttttgtgttgatacgatacataatcagaacaactctccattttgaataactctttgtgatgtcttcaggaagatgtactgtagtcagtcaaacttacaggtcattttgaaaagaattttctgaaatagcacaaaagcatgatgtctgctactgcacagaatgaatgtaaacatatttcatgagatatgtaaattttatatctgctaacatccgtggagtctaaatggttctcaaattccaaaattgggcaagtgcctgaattgtgtgatagtgccttgtattacttcccttgggcttccataagaaagtatcacaaagaaagtgcttaaaacaggaatgtattccctctccgtttggaggctagaattctgaaattacggtgtcaggagggccatcatccctctgagattctgggtagaatccttccttgcctcttcccagcttctgggggtagctggcaatcctaggtgtcccatggctttcagcttcatcactccaatctctgcctctgttatcacatgcttgtcttcacatggggttttcctcttcttgtaacgacactggtggattggattaagggctcactctattccagtatcctcatctcaactagttatacctgcaacaccttatttccgagtaacatcacgttgtgaggtactaggaattaggacttcagtgtatgctttaggggcacataatcaacctgtaacatatattatttattcattgaaattagataatccatacttttactgaacaaattctaaggctacctttaaagggtctattgtacagcattgtgactatagttaataataatatgttgtatacttgaaaattgctaaggaggtagatcttatatgaaaactatgtgaagctatggatatagtaattaacttgatttaaccactttacaatgtatacatatatcaaaacatcacattgtacaccataaatatataattcatatttttcaactatttgttgataaaatattaataagtggaacatgataaatatgactggtatgcatcattaatattgaaggaagcgacagtgcttttcctactgactatatttgtggtcccttctacttgttcccaccccttcctctttgctaactaagtaaacaccttatttgtcacctcttcccaaaagctttggttggtttaaaaggcttggcatatatcacaggacgctgtttgggggagtgaatgagattataggctttggagtcaaacagcatggttttaaattctactgtctccactttctagccctgtgaatttagttaatttatttaacctctcttttacttgttttcctcttgtgtaacataagaatagttacagtaagtatatagtacagttatttaatgatcaaataaagtcacacaaggaaagacttaaaactctggataataatgattatcgtagaattataaaagagaataatcaaattattttcaaattttctgtctttcagtgaactacaaattcttagagaacagggacttcatgttgcattctcattttctatcatagtaaagtatatatatatatacatatatatatgtatatatatatatatatatataatgatatgcctgagatagtcctggtttgtggctgttgttccactatacttttcaatagcattctctctctatttcaaaaagtgtcctgctctggagggtaaaatatatgggatctattgcagcaccattcacaatagccaagatacagaatcaaccgaaatgtcctccggtggatgaatggataatggacatgtagtgtataaacacacaatggaatgttattccaccacacaaaaaagaatgaagtcacatcatttgctacaccatggatggaactggagggcattatgctaagtgaaataaaacaggcacagaaagacagatgttacatgttctcactaacatgtaagagctacaaataaactaatctcatggaagcagtgaatagaatggaggttaccagagggtgggaaggggaatagggaaggtgggataaagagggtttggttagtgtgtaaaacatacagtttgatagaaggaataagatctaatgtttggtagcacaatagggtgactattgttcacaataaatttttctacatttcaaaacaattcaaaccgtagattgggaatgttcctaacttaaataaatgataaatgaggtgattgttacttccaattactcagctttgattattacatactgtatgcttgtatcaaaacatcacatgtactccacaaatacgtaaaagtattaggtatccataaaaattaaaaagaattaaaagttatatatatatcacacacacaatgcaaacacacacacacacacagacacacaatataggaccctaaacataaaagcttcacacgtagtaggtctcaaatatttatttaatgagtgaatatgacaggcattattacttttcagtcaaatggcatggttttaaaatctaatgtctccactttctagtcctgtgaatttggttaatttagtattttaattaattatgctgcttttggaaaatactgaattgtatttgcctgtgcttctgctatttacctctaagaattaagcatttaataaggaaatcttccgatttacttatgtccgtgaggtactgttggaagccatatacctcaatgcctgtaggaatgtattaaatgctcccttgatggcttagaagacttaatttgtcttcttattttactacccagcttggacttaaagacacttgggaaatgggactcaataatatgaagctattaaagcccttcagtcagagaaaattctagctttaaaccctctacattacttttgacaacagcacacagtttaaagtacagatgtaatggtgaaacattgggatctcaagtcattggaacatattcacaaagtaataaatttttagacaatatctctaaatttactgcttatgatttattgcttacaccaaactaaaaagttataatcctgtgtcttaataatacagagatgatgaaagctttttttgttagaaaaggaaaaaaaatcaatttagtagaaaataaaacagagttacaaaaagtgtatgctaaaacattcaacttcatactgacaactagccatagttaattttgctagaaggctttgagggaacattgtctctggcacaaaacagaaagcccaagggtaaatttaattcctttagaggcagagagaatttggatgcatgaaataggatgcatgggtgatccgtaagtcatacattctatgaagtataaacttctctaatatatctttggatcccctctctggagagcaacatattgacttggccaatatgttagttaatagagttggtaaatgttccaatattgtgatggcactctgtaacattatgtttagcagtctgaacattgctaagcattctagtccacctctgtagagatttggtatgttcatggattaaactaaaaactatatttaatatactattagacataccgataagctaagtcagtagctgcctaggtacaggcagacagtcaaagatatatcatctgggtaatgctggcttgcttcttaggcagtttcttaccacaggagagcattaaccttggtaaaataaggccactccaggttctaatattcattttacaagttcataaatatggttttgttagtataatggagtagattagagatgggtttgcattttccagactcataaaggctgacacatgtacaaatgatccaaaaatcaggttggggacatttctcattatgtttgagaaataatgagaatgcatgcaagtcaaccaagaaaccaaatagtatcaggttgacaagcaaaaactttcggctggggtacctgaaggccatcttacctactatggagtaggaaaccatgggcttgagtccaatggcaaagagtttctctctcacacagttctcaaataggtactacttgccaagctgtccacccacaagtttgtttttccattctcagggctgaccaattactgttttgattgacacattctttctttagccatattaatattaatacattcagtcacattacactcaagtcccagagatgtgttaacaatttggcttcattaagctgactttgcatgtctctattccaaattctacttaattaatcataactgccctctctgaggatagtctcttttaagttatttgggatgggtgcttcttcttatattttattagaaaaacaaaattttgatgaaacttttattttaccttatttgttcctttgcatttcatgaatatgcagactaaggctagaaaaattaagtgacaagaccaaggccacctagattgttggggacagaggctaccaaagtgctgacttcaagctgcttccactctactgctctatgtcttcacacgtttatacactttgtcccctttttaggatttgcatactttccagctttgtagattgaaatgatcttacttgacttgttcagattttattatcgtcacccatcaaaagcacagccaatgtaactaactccaggacttttccactgtcttgctgtttatttattaaaacgactatagaaaggaaagctggtggttaatttttgttattattttttaaaaatagcactacaggattatcatcatttcttaaaagacaaagcaaaaacaaaagtatagtctcctgaaaatggggtttgagaatttgacaatgacaagcaccgagcatcaaaaagatttaaatttatggcagaatgcataattgtttctctctttggaattttatttacagtttacctggttgcttttgtaacttgcatcaaatgtaacaaaatggtattcatgtaatgtttcttcctaactgcactgtagatgcatgaagtatacatatgtataaggttatgttctaggtgacatgcaaaacacacacaaagtgtaccgtatcaccaaatattaaaattttaaattttattgcattaaatagcaaaaaatagagttgagtgaagcatcttctcagaagagcataccagtattcatgctatccctttccaaatctcattttaatttacttttcttgaaggtagaggactgattgaaattccattcattctttgtgaacttttgccctcatctaccaacttattgccctttccctcaatatgttttcctctcttttgctttctatttctttccctaaccctcacttctccttcctttctctgttaccacaatctatacatttaaaataagcattcaatatttgcccaaaattaatagccataagcataataatgtaacaaagacctttgatatgtgatgacttcatcactaaagagatttttggagtgtacatttgaacaatagacattttcactgcctttccatttaaaaaatgtatgttatttatttatttattaaagacaggatcttttctctgtcgctcaggctggagtgcggtggcatgatcatagctcattgcagcctcaactcctgggctcaagcaatcctcctaaccttagcctcctgagtagctgggattacaggcacaagccaccacacccagctagtccattcttaatattcacatgtattttacatttttaaaaagatgacaggttgtatagaactgattacctgttttttgttttttgttttttgtttttttttttgagacacattcttgctctgtcacccaggctggagtgcagtggccctatctcggctcactgaagctccacctccctggttcactccattctcctgcctcagcctcccgaatagctgggactaccggcgcctgccgccacacccggctaatttgtgtgtgtgtgtgtgtgtgtgtttatttttaatagagacggggtttcaccgtgttagccaggatggtctcaatctcctgacctcgtgaactgtctgcctcagcctcccaaagtgctgggattacaggcgtgagccaccacaccctaccctgtttgaatttttgtaaacatctgtccatgaacatttaagtgggaatttctagctcttcaggtcaactatttatttagtattattccatggaaagttgcatgaacctcaagtgactgcattaatgtcaaatatatcagtatctattagtatataataacaccagcccatgaaaacaacaacaacaacaaaaagaatgaatggccacatttagaatgcttatgcatatattcgtttttcagaaaaatgataataaagagtctagcattttcctgacttttctatacaaacatcatttcaaggtatccaaataattgttgaagaaagtgtctttttttttttttttttcccgagacggagctctgcagcccaggctggagttcagtggtgcgatcttggctctgcaacctccgcctcccgggttcaagcgattcttgtgcctcagcctcccgagtagctgggacaacaggcgcgccgccacacccgactaatttttgtatttttagtagagatggagtttcaccatgttggccaggttggtctcgagcttccgacctcaggtgatcggctcacctcggtctcccaaagtgctgggattacaggcatgagtcactgtgcctagccgaaagtgtcttctttacagatgaatttcaattaatacatactgaagaaattacagaattcaaaaatcagcattttacaacacctaaaaaataatggatttatgccgtgatcatcaatgactgctaaaatcattagttgaaatatgttgaggaaattaaaaatggatggatcagtatgacaatacctagattctctgataagtcctaacctaagaatggtgcaaccagacagtatatacctctacgtgcctcttgataagcactaagcactaacagtgctatccatgatttattcatgctctgttatcaaatacattttaaaaatggaaataaacacaattaagcctctagaatgaattacaaattctggaaaatacctggatagagaaatgtattaattggcatcaaaatataatcactaaaatacataatgtatgaaaatctataaggcaaatcacctaatagctgacatgggatggggggagaggggtgaattttatagattaattaagatacttaatggtcatgtcatccttatgcaatggatagaccttgtccagattctaattgaaaaaaaaatacttaaaaagatattttgagacaatagaggaacacaacttggttatattaaactatattggttatttcatattacattaaattattatttcatagcatatttaattatattttattttatattatattaattgaacacagcttgttaattttatattatattaattatatattttattatatattatataccatatataatatattaattatatattttattatatcatatataccttatatattatattattttgtttatattacaaggtttaaaaatggattatggtggttttaaaaaatgtgtttgttagagattcatactgaagtatttacagagaatatgatatgtcttgaatttaagaccaataaaataaaaataaattatttaaaggtgagagggaggataggggaactataaatggcaaattatcatttgttgaagctgtgtgataagtatatatggccttactaaaccatttttttacttttgagtcggtttacaattttttagtataatatgatgaacatgaaaaagtagcattggattggctgtagcatgcagatgaacaggtgatagagcatccagaatcctgtcccatagagctctccacaaatctccacagttggagatttagtctggaaaacattttaaaacattgcaagctaaatatctagaaaatcatatttttaatcatagtaaaacacctataaaaagtttaaccttgaatgtagtaacttcctgctacagccactataacgtgggttatacaatatttaatgaattgtacacaagaattaacttgcttttttgtttgagtaatgagatagatcgatgtctgacaatctctcttttttttttttttttttttttttttttttgagatggagtttcacttttgttgcccaggctggagtgcaatggtgcgatctcggcgcaccgcaacctctgcctcccgggtgcaagtgattctcctgcctcagcgtcccgagtagctgggattacaggcatgtaccaccacgcccagataattttgtatttttaatagagacggggtttctccatgttggtcaggctagtcttgaattctctacctcaggtgatctgcccacctcggcctcccagaagtgctcagatgggattataggcgtgagccatgtgcctggcctgacaatatctattaaaaaaaaaaaatcaaaaactaggaggctgaggcaggatctcctgagtccaggaattcgaggtgatagagagctatgattgtgccactgcactccagactggagcctggaaaataaagtgagatcccatctctagtccttttaattgtgagcagttaaataccaggaccagttgtctaataaagccatatttaggggatggcgggggcaacatatcatttgaattttttaaaaaagaaaaagtgtgtgtgtaggggaatgggtaggtgtgtgggtgtgtttgtctgtttggaagagatctagagttaaacataaaaaaggaatgaaaatactagaggaaaacatgatttttttttaaaaaaaatcacaggatagggaagcctttttaaggatgacgggaaactctgaagccataaataactagtatgtttgaatacattaagtagtaataataatgcaaaatatgtctagggaaaatcctgaattacattaaaggcaaatgtcaaactggaaaagaatatataaaatatttacagcttatatccaagaaaaagagataatgttttcaacaaaagaaaagcacagcatattataagaaaaagtacagtgcaagagaaacatggtctaagaatgtgaataggcagaaatacacacactcaagtgtctcttagaccaaaactagcttaatctaacacttattaataagcctgataaaaatggaaaatagagacttaaaaatgttacattgtagagaaaaaagtaattgataatatactctatcagtatgcataccctcaaaatttgctgatggaagcacacatttttaatcaatttggaaatatcgattaagactaatgcacctagattttgaccacaatttcatttcagtgtattcatacttgcatatgtatatatgtgtatactgtcatttatactatgtacatgtataacaagggttttcattgcaacattatatactagcaacctaattgtcaaactttagggaattagatacataaatcaatcaaaaagcagaatactatgcagtttttaaaaataataaagccttcctatatattctgatgtcaaactttccccaagatatattattaaattagaagggaaaatgacaaggcaagtggaaacacagtgctggcatgtgtatgaaaaattcatggaataatcctgaaagaacatacaaaaagctaataataatgtaggggacaggggatgaggaggaaagatacttactttttattatatacatttcttgtttcttttgaattgtgtgtcatatgcgtatattatctattccataccttaaatttaaaaattgaatagtactcagtttttaagtactgagaggttggtgaggactagaaaaagaaaaataatctcattctaatctgacatccttcactaagccctgatacttaacacaggtctttagatgactggaccataattttggacccggtttgaggtctctgcctggggatcccgggtgcctgagtctgtggcttggctcctgacagtttatggtgaaagctggtctcgctgaaaacacagaggacctctagggggcagtgtttcccagagctgtagccagcttcacagtctgagttctggcttcatgaccctgatctgatcactatacattgtatgtatcagaatctcgttgtggaccccatgactatgtaaaattattatttgtcaatttaaaaataaaattgaaaaaaatttaaaatattctccaagagtaacctttttactactcttactttatgtattgaatttgatccctgttattgcagtaacttttctgatttttttgtgtgttcattcgtttatttttatttaattaatttatttatttatcttgactcttcatcattcaacttgaattgtgtatccattcttgcagccatggaaattttaaacctcagaggtttttctttctcttttccatcctttactcccctctatagctacttgggctttccctccctaactctttttcccctctgctggctgatgcctggaatcccttgcctgttttttgcttcctcttcatctctgggctcactttgtcatagagcagaatgatggtaaagaaattcttacttagggtgaggttcctagccatcagcatttccaggaaactggcggggttgggcaattgtcagtaagtactctcaagtttcagtcctgttaccaagacattcaagagaaatgcatgaacaatttagccttcctgagattttaattcatctcagtccaactcccactgtatttcttagccctatcattttggttggagaaacatttcatagttttggtagattaggtccaagtgacctatatgcttttccccaactgatgctttcaatttctcatagttaatattaaccctgttttactttccatcttcaattaaataaatttcttctctgaagtccttctctggtcaatattgtccaatcaaatgcataagaattagacaatgaatatatgtattttatatttgttgcttaatttaatatttataattgttcactcaacacatatttagggaatatctgctagagcattgctagttaaatcaaggtgataaaaatggtctaaatgtgcaattaattatttaagcctgcctcccttgaaaaatagaaggatgtcttgttcactgtttatccacattgcatatatgtttttaattgtttatcttctataagcaagtcttaggtcaggtttcctggaaacagtttctgagatgaggattaacatgaaagagatttgttaagggaagtgctcacaggagattggcagggtctgaagaaagcaggatggagcagggaaggaagcaaaacaagggtgtgagctcaggcaaaggcactgagagaatggcttcagcctgatccttcataagagctttatggctcagagcttcgctgtcccttgtagatttgagtccactgccctgtccgccgtggtcaggccctgttcctagaaaagagaattcccaggctggtagtggtgtggtatggtattttagtcttggatttctgactttgtactccacacagtaacctaggactgctaaatatatatttgtaagagaaatgaatggaaaataaactagtagggaatatcaaggagcttagactctagtcagaagaagatattgaggagcgtgatgaaagctgaaaaaataaattgctgttgtaattcagaggaagaacaaaagatgtgtacttcagaccaagttgaccaaactcattgaccactccaaataacacatttctggggcacagaatagtcatcacgtattaattggcagagacattggcaattacagaattacaatttgtttctttgctagtgtcttttttaattggaattttttttatcagagataacttccattggagacaaaatggaattatagtatgacccattatctctttttacttagaataaataaaaatgacccatttttataaaggtggtttactcaattaaacaaaacacctccatcaacatttggtggtttatctgaccaccttaatatattaatctattattgcctgatacacatttttctggattttagatttaagaataaggtatttgcacaagtatttatttcctttctgataagtaatctggagagataccagggattacggctaaatagtagcatgttttttaatcaatttatcatttccaagacttagtttcctcattcatctaaggaggttccctttcacctcatagactggattagaacttataatttggactctggtagtgttatgcatttttaaaccaatgcctgattatgtttaattaagagatgaatagctggaagatacttctgacagactgaactggcactctcaaataaaatcatataggtgacaaactactaccactgcatgtctacactgccttgacagaggtgtttatcactggcttcaccagtagtttctgcttggccacttcatccaggaaagtcacagttgaaaagactgtctagtcaaacccttgaatttttcgcttgagacaatgggaatgtagagatggcaagtgatgtttcagaggacacaaagttaatgcagggaagaacaggaactgtgtgtcaactcttagaccttggctcattacattacgcaggctgctctcatgcagaagtgaagtatttctctcctgtaagataagatgatcgggcgcttctctgcttcagttcaatgtactaaactctaaaaaaactaagcaaaacacttcatgtttaaaaatgaaactggaaatatttgtctaaagcaaaaaatattaacatgagtgctatagttagcaatattattaaatgtttcccccttttttcatggaattatagtattacataaagctttttaggtatatttgacagttatctagatttagtttaaatctaggatagtaactaaaatatttaaactggactttgccttagggcctccacatgagaggcataaatattttaattgtgtaattgttattttaattatttaaagaaatataaatattttttaaatgtttatattacattggccttctttcagcacatatactctttcaactgagcttaacctgtaactagcaatagcatagtgtgaataatatccatctgggaaccacatcgtacattagaaaatctatataatggtatgccaaagttgttaggtatggctctgtgggactctaccctgttctaagctaacaaaagaggaattcacagtatatcatgtttacatgacattgcttgttcgctaacgtctgtctggaataaggttccactattcttgatttgttccttcttactcatcattcaaacctaagctgaggtgatttcttaatatggcaccaaaagcacaagcaataatcacaacaaaagtagataaattgtactaaatcaaaattagaaacgcttgtgctgcaaatgggaccattaagaaagtgaagcaacacctcacagaatgggagaaggtatttgtaaatcatatatctgatcaggaacttgtatagagagtttataaagaactcttacaactcaatagtagaaaaataatgcaattttaaaatgggcaaaggatctgaatagagatttccccaaagaagatatgcaagtgttcaataagtgcgtaaaatacatgctcaacatctttagtcattagggaaatgcaaattaaacctacaaggagacaccactttatattcactaaaatgcctatgaacaaaaataaggtcaataacaagtgctggggaattggtatccttatacattgccagtagtaataaaaaatgatgcagccaccttgaagaactatttgagaattcctcaaaaagctaaacatagttacaatatgacccagcagttttactccttagcgtacacttgagaaataaaaacataccttcgcacaaaaacttgtacacataaatgttcatacaacagtgctcatagtaccaaaaagtggaaacaacccaaatatccgtcagttgatgaatggataaataaaatgtggcctatctatgcaatgaaatgttatcagcaataaaaataaattaactaataatacatgcgcaaaaaggaagaaccttggaaacattatcctaataaagaaagtagtcataaaaaaaaacatcgtgcatacttctgtttatatggaatgtccagaataggtgaatccatacagacataaagtaaatagtggtcgtttagggctggtggggttggggaaagagtcaatggcaagagatgatgagtgataactaatggctacagggtttcttttagagggaaccaaaatgttctaaaatctgattttggtgatggttgcgcaaccacgtgaatatattaaacactgaattgtaaaactctaaatgggtaggttggatggtatgaatgaaatttcagtagtgattgcagtgaagccgttaaaaaaataaaagccctactcttagtgtagcctctagaataatttatctgaaactcaatttgagctcattttcctttcttttggttgcttgtgcttatatttatgttgacataaaagttcctcatatgtcaatctttatagctaaactcaaagttcctcatgatcggagacaaattcttctttattattattgttgtttttctaaacttttgccagggtctggcataggtcttcatgcatagggagcatacaactgaacttcactatattatcctttacattcaaacaggcttttgaaattatttttaaaaatgttaatattcaaagtttttatggacaggaaaaatctctctctaaatgtttgaaaataaatataaattttaataaggcaaaggtttcaccttgaaagtgtgaatgataacaataaattgtaagagaagacaatcaatatttacatactgaaagtgacaaaatgtaccaggccattaatatgattttatgaaggaaaaatcagatcagcttccttttactttcttcttgttataaggatcttataattcaaaaaatcccttatgactattttatctttcgttaaagcaccattaagcttttcaaacattgtgagtttgctctgacttttccttgcctcagtatacttgagcaaaagagctggactgaaccactaaaatattgttattcaaatattatcatatggttttactgaaagattccactgtcatcctggcttcattaataatatcagaatataatttgacacgaattttgaagatggctttaagtaacaattatgagttgattttatgttcaaaattatgcttgagaaaaatagaaagtcccttacctcagtgatttgcaagattttttaaactgaactctttgttccaccaaaatcttattcaaaatccagtatataagtcagaaggacagagttgttctgcttatcagggactaaaaagggggtcaagagatccaacccgtggccagcgtcatcccctgggatacctccaaagattgcttcaggctccttagagtaaaaaatcactgccttagttaagtggaaagtaggcctatgcatttccctgcatctaaggagttgtatttttttatagtaaccaattaccttcagctaagctaatttaatggcatttcgctaactgattagcaaacacctacctcatatgtatattgttctatagactttttaaaaatggaaaggtgttaataggttaaccccgtgaaaacacactggtgtgatgaaaatagctatggaatgaggtgcatgaaatttgttaccaataatatttaaagtgtcaatttttgcaaatggtttccttgggaaaaaacttgaagatatttctatagtcaaattatctgtattcccttttcttcttcattaaaagcccaactggagtactagggaaaaagtggagtacagctgatatggggattgcttctaaccctggatatgagtttaagagtgggtgaagggagtgaacaggtccatcctagaagggcagaggataggtgagaacttttccttcccttcgtctttcaactccccctcccatcttcttcttctcttgaccatgattttaatctctatttctatcttgttctctctcctttcttctggtgtgacataactggtatcagagatagcttggccattcacccacaatgaaaccttcagtaagacctttagctttgacttcagtttcttcatctgtgcaatagagataatcatgatgcctccctcgtggggttgtgtgatggtaagtgaggcagcccatagaaagcacctagcaaagggcctgggcaggtagttaggtctcaacgaaattaacaattgctctttcattagttgtttcctttccctcgtcttcccttaaatttcattttaacacttaatgtgttgtatttcttatttatacttaactaaagaaaaaaaatgctaagcattttcatttgactttgtcaaggttttggcttgaggatactttcatgaaataatagcatgtaaaggaaaagcaaaacgttgtttatgaatatctagagtgtcaaaactggggtgtacacaatagcaaactatcaacttaaaagtgattttcagcatactgtgacttgtcaagggtgaagtcctagattaaaacagtttttctggaatttggtcaccacaattgagaaagaaaattattttagaaatccagaagaaaataaggaatgaatatttgatatttgagaaattatttataaacaaaattttactgataaaattatttataagtttttaaagttttttagctattttctaacattattgatgttttatgtctaaagggagaaaagaatggtctctgtagcttaaatgacttattcaaggtcaggaggtgcagagccagccacaggaatgggacgggaactctgacttttatcattcctactgctgtttgatgactccttccagggcaatgagcactcccagcatctttcaaatcagtctgtttttcccagggttctacttatacgcaattctcattctctgctgcagagtgaatatttgcgaaagaacctggaaccacattttagatttttacatttcaactttattttcatctttttcaaaaagaaaaaacacatgcaaactcttagttggccaacagacttgctcgcactgtacttttgtaggtattttctgttcaaaattagttgtggggaaataggacagaattgcattagggattttcaattaattgtgcttaaaatattaaaaataaaaagaaggaattcgaaggtgaagctgttgctagtattggagcagcactaatgcaaaggcaggtagagctaagactttgggggcaggaaaggtttggggtgcagatatggaggtctggaaccatttttaagttcctctctctgataataaaaccctaaaaccttgcattttctactgcagagcatatgcattcaagactaaagttagtaatcctacacaggaaagaaaatggcaaacagacagaagaggaggagtgacttccttttaactttccctggaaagcttctagggacatcttcaatcctgctaagtatagattttccctgcaggattgcggttagaggaaatcacatgagtaaacaagcctcttttgttttgaaagtcaaatgaagacatatatttctacgtctttctattattttgagagcatattcacatgtgtgctcacgtgcccacacacacacacaaacagtgcacgcttacatacagcctattccaagcataaattaaaatgtatttgtagttttcttacagtgatgattactctcctataaaatatttaagaagtttttgtatttttccatcactgtattttgtcctaaaaacaccgtaaaagagcttcctcacatcacctcctcatctcatgccaccttgtcatttgagccacacataaaccaagaagagatgtaaagtggtattaccattccttttccccattaacattaatctatatgttttgaatatatttgggtctttttattttatgttcttctgttaaatcatagcaactgaaactactttctctccgagttcttacatggcatatacaaatattacccacatgaatattaacgcttctcttctcagttatgccacttcaagatgactggcagtctctagtttatggaaccgcttgatcctgttctattagacacaatcaggattgcacatacacgcagtagaaaattctggtactctggaaagtaggtagaaaaaaaatcacattaccttttttggaacacaaataacagtgtttaagtgtctggtattgcttaatggaaaaatccatggtacagttcaaactaaatgaaataatgatgtaagttagggtgctccttcaaacagcatcttaagtagatagttatgcacttctgagatcaaccccacagcagccgtgcagcctcagagcttgttatggaatttcatattcctttaatggaaatggctccacgctgtgctttcacttttccaactgtggcagtaatagttagtaatcaagtcataatgtaataatcacaactacagggaaatgctggctgatgtaatgggttgcaaggggaaaaaatattggtgtttttccagactttatttcatcagtctcttttgtcatatgttgaaagaatctaagaatatagatgaaaacagaccctcaaaggtgcctacatagatgatgctatatcacttgcttatttctactgaatttttctcatctcagtactcacaaagatgtcacaaacttgaaatttttatgttaaaatctgaaaaaacattatgctctgagtaagagcctagaacttaccaaattctagagtctgtcatatactttactgatactttaatgaagcaaggatcaacaaagcatatttatgttctatagtttgcaattacttgaatttttttcagaacctggttatttatgatgtttcaggaattttcataaaaaatgctacttgctgattagaatgagttattactactgcttctttgattaattatggtctcctaaattttcaatgaagacacaaagtcctctgatttagaaatacaaattatacactcattctatgaaaactgtcctgtctagtctttttactttttggataaggaaattggtacatgagaaagtaactgactttatgttcttcacgtacagaatggtataaatgaatatagttaatgatgaccatggatcgtttcaaagggcctatagcttcccttttataagaatacatatatgacatagcttcaccaaaaaaaaatgcttagggaagggcccatgaagtcctactacgtatagtactaggcagtgatcttaaggatgacagaatattttcctaaactatatccctcagctaaacctaactactgtacttaaatgccaagtcctaccattggagccttcctcaatccacagagatttttttctcctcctcagttttacccaggtattaacaagtaggacttagctcacagtgagccttacttcacagtactctgtgaaaactttataatcccaaagtgttaatatgcttacagaaaaagtaaagcatatttatttaaatcatattttgctattattctattgcatatggcagcatttatccttaaacactgatttccattaacattgccaataatttatctactcatagaattaattcatgcttcattaatgcagagaatgtttcagacatagtttgcagtagagtttcatagtatcatcagatcatcacagggtagacataactgtgcaacccaaactgcatctttgtttctaaaggttacataattataaggttttggcaccaaagagatcagaattgcatctagacatatgacagtaaaacacttcaagttttcagaaatggagagtttagaggcatttggcaccttgctttctcattattatagagtttcaggatggaatgtgtctgaattctagtcctgactattgtttgtattcctgtcttttctgttttttaaatagtcagtagaatccagccatttgttcttttagtatcattctttttaaaataaatttttcaaaattatttttataatgaatttgcctgtatataaaaaggaaataagggcctggcgcactggctcatgcctataatcccagcactttgggaggccgaggcgggtggatcacatgaggtcaggagttcgagaccatcctggccaacatggtgaaaccccgtctctactaaaaatacaaaaaaattagccaggtgcagtggcacatgcctgtaaccccagctactcaggaggctgagacaggagaatggcttgaaccagggaggcggaggttgcagtgagccgagatggcaccattgcactccagcctgggcaacaagaacgaaactctgtctcaaaaaaaaaaaaaagaagaaaaggaaataagatgttttgaggctgcatgagtagattgtagcctttgtcctattgtgttaggtacttaagcccataaacaaaataatgtttaaaactcaagggaagggcagaaagaacgttgctcagtactaccaataaatgtttgttaatcaaaccataacattttgaccctaatgttgagcacctagaaactataactttgacttactaaagggcttgaaattattttaagtgctttatattttgttcagaaaaataaatcaaattattaatcatttatatcattcataataaataataccagtacaaataacacaaagcaaacagtggacaaaatttaagtttaaaatttgtagaagaaaaaaacaattgaggaagattgtgttttctatgggattttcaaattggtatgtgtgtgttcattagaagtaacctataaaacagatattgttcagatatgcatacacttaaaccattatttccagaaaataatggaaaaattaaattattgtgacaaagtttctatttgccattcgtgacctgagaaattaggaatcaacagtcacagtgactggaaaagaaaaaaaatgacataaataacaattaaaaattggatatggacaaaattaaatcaatgagtcaaattttttatgtcattaacattagttatgatgaatacatataaaaacattcaataaaatgaattttaatggaatttaaaatcatttcatttcctttccaagtcattaaattgcctttgtgatcttaattttaaagactgttttttttcacttagaatatttccacattcatataattatgattaaaaactgtgtatttaccaaaaaaagaatcatattttgagatcaaagtggagaggtcaaaatagcttttactgtgtcatttcccttttccacctttgtatctatagacatggttagattcttaacaaggacagtgttaccaggtacttcatgcaatcatccctcattaatcctctgaataaactcatcaattcattcaacaaatgtttattgattaccattaccatgtaagccactatattcaaagttaggtatatagacaaaaataagacagacatagtttctgacttcagagaacaggaaaattatgaattagtgtgctaagtgttttgaatggggatgttctggataacatgaaggcagagcacctctcctagactttgagagcccaaaaaggctatgcataaagagtgaagttgaaagttgaataattaatcaaattacactggaagtgttggagaagagtaggagcagaagattagcacctcaggcagagaaaattacttgttagaaagctaagtggtgagagcttgacaccttcagagaaccagaaatcagtcactctaagaggggaaaatacaattccagagactgaagagattatagggaacagatcctgaagagctgaggaaaatctacataaggactttggagttgagtcctctctgaaatattttaattaagatattgacagaatcagattttaattttaggaagattattctagctacatgctaaagaatgattgagcatgaggaggcagggaatagtggcaagatggaagagaaggagacgaagtagaagactcgtagttacattggtcagatatgacagtggcctgaccagggtagtggcagtggagatgaacgtgtctgagacttattttggaagtatagcctatgggatttagtgattgaatatatgtagggagtgaaggactagacaaaattaaataagtctggggtttctagtttgaacactgggtagacagaggacaggtgagtagagataatatgataataaatgttctggaataaagaatgggcttgggagttaagcagacctgggtttgggttccagctttatccctgcgataatttgggctagttacttagtctatttaaactacatctctttgtccacctatacattgaagatgagaggtacctccctattttgctgtgaggattaaatgaggtaacatatgaggattatgtgacctcatttaatcctagacccatgccttgctcatagtgtttgcaatcaatagcattagttgtaataatagtagtaaagatttgtggaggccagagattatgatttctgtatatcttatgtggtaggtgttgtgatttgtgatttgctttttaaaggtctgaagagagcttgattggaaaattttaaacttctgtgttattgggaacttgggcgcattagtttatttggtattaacatggaaggcctctaatgtgagataagattatagtaatgtcaccactccttacagtggagttgtgattcctctaggagttttcagatttggctagtcagtttttaaataaaataattttatcctatgataagctaatgagttttttttttttttaatgcattcccaaaacgaagttaaacactggcttccacaataatgtcaggtttatgccattacatttagggtcttctccatgaacttcaaagcaaataagatagtaacatactcaaactatcatgaatagaaaatagaccaactaatgaaaactctctagaatgtttttatatggatatttaaaatatgaattttgctatcatggagatacatatattattaaatcttgattaactttataacatagggagtgatgtgctagagccatctcttcatggcctgtgaaagattattcttaaacacaatgaccattacaaattaaatgacacggtgttacaattaaatatattaaaaccaaatgtaatacatactcaaaactaatcacttcataattcttttactgtattacaaatgcttttgaaattatttatgtctactgaatccatatgatggaaatgctatgtaatgatgtacagtgcatctcttcctaactctgcattcaatgccattatagtggtaatttgaaaactgccctgttgagaatatttcatcatagaaattggcaaatgctacaaatcgaagctttttgttttgcttggtttcatttgtttagagagctacttgttaaacatttaccagcataacactgaacataggtacctttttacagcaacattaaaaaataaaatcatgttctcacacataagtgggagttgaacaatgagaaaacactgacacagggaggggaacatcacacatgggggcctgtctggggatgggaggctaggggtggaatagcattaggagaaatacctaatgtaaatgacgagttgatgggtcatttacccatggcaagtgtatactaccatggcacgtgtatactaccatggcacgtgtatacctatgtaacaaacctgcacattctgcatatgtattccacaataaaaataaaataaaataaaaataaaatcataaaatttttaaagaaaaaaatcacaaatattttttaaaactgaagtgaaatatattgactagagtcaacagagtgaaaagccctaattactaagaaaatattttaaattatttgacacttccttagaaggtaagacttggaatgtagaaaacttagttcagccctttaaaaaagactttcgatgtccaattcactctgtcttttttaaaggtatcctttttgagtaatgccatagaagactaattgtactgtgttccaaaaatatgctttaagaaatggttgaaaaattgcagtcaacccaatacttttagcctacctggagcaaataattatgaattttagtagtttggctctattattttttgtttattatcttttactgatgatgtctataatgacatgttccatttgccaaagattttagagcagaaacacctgtgaagaaattttcagtagtatgtgatttattagtgagttcattatagatgggtctcagaagtacaaatataggacagatttcaaaactaatgcctccctgcttcttgaaaacaattgcagttattaaattattacacaaggacacgctgacttaaatagctttaactttcttcatgggttcgagaaatggtaatggggtaaattctgtgatataaaaagtggtttgaatatcatcattttggctaaacctgttacaaaatggaacatgactttgaaagcttgtactgctccatagatgtaagtgtggtcacaggttggttggtgcttgttggagtttttgaacttagagttcaattgttatttttctttatgaaaatggtaaaaattgtaaatgacaaatggtaaaaattaggataaaattaataaattaatttttcattttgatataaagaatggctaaaaatgttgacttataagtgaatatttgtcaaggcaaatcatcttctgccaaatgcaagcaaatgtgatgcttttgctattcagatgtgatcaccaccatggaatgaagcctgagagttggcctaagaaagtccaatgcagattaatctattggaactttctagctctttgcatgtatgacaatcacagtaatggtcagaaaataaagaacatcatcagttgtactaccctataacagttttttaatgaggactccactgaaacactaaaaaactagtagtagatcaaagacttttctaattcaaaagacagtccttcagccagaaaatataaatcacatattttctaagagaagcttgaaaaatatggcttcatattactatttagttgtgtcctgaatacttttcttaggtgatgagatcataaggcttttggggatggaggatgggtggcagtggtgggggtggtggaaacaaaataacaatttataatttgaatccacgtgcctaactaaatccacgttcttaagattgtgagacatgaaaacataaaggagaaatttccaatttattgacccaactatgcagtgccagattgaacttagaaaacttaaagtagtagcatcttagaagccggatgtcaccaggacaatacagccagactggcaggcaggcaaaggcaagaattaccctgctaaatttgcctttgtgcaggatctaccccacagcccgataggccctaaaactcacactttgcaatgaacttgggaggctgactcatgctgaaaaaactcacaataatgttaagtttataagcagaatgatgattaatttatgtattatgatacatttacctgccaaagaggtagtatcattctttggctatgacattttttccttgttagaaagctgtaaagaaagccaaattttcataaagagagatagatataggattcacatataatgatattaagctttcaaatctatgctcttcatctccatgaaagtgaagtccaagataccagggcctgtcaggccaaatattatgaccttttggtcttaactttcctgttctgtatttgaataaggtctgccatctttgtcttttgactgtactttgctcaaaactttccctattgaacttctattcttcagattgatggcctagatggtgttgcccaagcaaattcatggagtaagggagaaaaacatcagaatttccactggtgcctatttgcatcatttttctattttatatgtattttacaatgcacatactatttaataataacatcaaacagtgtatggtgtaaattttgtgtcagtcgctgatctaagggctttaaacacatttgatatttgggacagccttgtgagaaaaatacaaataaagccaagattaagtcatgttaactcatccagagtggaggagctgaaaattcaaaacaaggttgtctgatttgaaattccatgcttttaaccactacaccattcccacagtggtccctaaatataatccatagatgaatgaatacacatatattagtgaacaatatgtattgatagggctatataggtgaatccatttgttcagccttagcctgttctttctgatttgaaaaagtcttttgcatttctgagtgtcagctctctgatctgcttgtcgtagcctggttttgtagttgaaatgtctgtgggtaatcacagctccctgtttacagccactactgtgtgtctggattctggaagtgactacctggcattacctttataatcttaagatcactctagcaacatttagtgtcatcacagacttaatgagtgttgctttctttataactaattcaaagaccaatgagtcccccactctccttgtttactgtgcaaaaaattatctgcaagactatacagtatagtgcactctttcctaggttgctggtttagtttacactcatttatctccatcacacaggtgggctcataagacaaggaggccctcatttaaggaaagaggttagcttctttcatctgggcatggtgagcacccagacacttaaacatatgcaacagaacaagagtaattcagaaaatagcataaagtgtaaagaggaaaaacctttcttgaagtgagatttcttcctaaaggtatttttgctgctgtacttggcatcttgttaataaaaatattacttaggctatttcagttctagtcttcatacttgtgtaatgtagcactgtgacttaggccatctgctttaacatcttatgatatgccattctttgctgcttttagcagatgaatctttcaaacagcagcttataaaacttgatccttacttacttattgcattacctttttccttgttaaaatcttctggatatccaagatctaatttcacatttcactcttgaccatgtgcttgagatggaaaggggataattagtaaatggagatcatgcagttgtaaaagattctagctaaatgccaatttctgttccaatttggctttttgttttgttttgttttaaatctgaaggcttgaattttaaaaagcctgaagaacatgatattgaggaggcatcaaaaatgtgctgctagttataaataaaactgtttatattttttgatggatttgtccttcctaacgatgtttttccaaaccctctgaaccctcttaagcctacacagctttcattgtcattgctatgtgatatgacattgaggtaatttgcttttgctcaacttttatgccattcttgtccatattattaactcagtgggctagaatgctaaccactttaaataacccatttgttgtcatagtaactgatattaaagccaaatataatctgtctcttggattccatatttaaatctttgctggtagttgcattctttagtaatgctatggactgaccatagtacaacgtactatgtacaaaggggatacatattacaaaggtatcctgaaaatgtaggtttgattgaggagtcaattcagtgacatccagtatcagctcccagcttacaatgtgttcagacccagtccagtcctgtcaaatgtatgttcagagaactctaagaaggatgctgatctaaatattacagggactatatagacaaaaattgtattttttcactgtggttgttgtctatgctgttcagtttttctcctttacttatctttgtaattttttctatgatgtttctaaacctttaaaaattacactgtgggtactgagaagagaacaggtacattatagaaagcctttcaagagagacaccttctggacacaccttattatcagctctgtatcttaggtgacttctgtgtcctttagaggctcagtaaagattccacctcctgcttaaagcttgactgtcgtctttcacttctcttatgtcaccttttttccccaaaatatatgcactgcattgagcacacaaaatttgattatagtgctagggtatctcagagagaaagctgtctgtatacgaaaaacaaaacaagttaaatttccctcattcacatattaattcatctgcatcaatttaaagattcattgctctcatctggactttgtacccattttctccaggcaggtcagtttttcacatattcttatattttgggccatgctatcctttttctcctcctctaaattaccatttttccatctagcaccatttgagactgaatgaattttcttaactcccttgatctctggagatgcagagttattttttgtctaggctccccatccgcccccagcttcaaaatgaaagaatattctcagcagcagcttatctgttgaatatgtatgaaatatcctagatgttagatcgtcttgtcaaagtctcttatataatagcttggtggcaacattgagtcttctcccttcccccatatttcttcaactagccctctttctgttctaaatgtgcaacatcctgctcagcccctgggtccctctctactctctcagattccatagttagcaaaattcactttcctatgacttcagcaaccagtgtcattgagcccttattttctaaagccacttttcttcggagttcctattttatatatcgccattcttttcagtagccacatctagtatagtgctacatgtgtaccaatggaatactagtactgtgggttgtcaaataatgtcacaagagaaaagtgtcctgtgttcaaatttgatttagaaagcctgtgttaaacaagccaaacaggtttctttaccaaagaacacccatatgttcattatatgccaacagtgaacattgtgagttttttaaggagaaaagcaaaagtagcatttctcaaacatatctttttggtacacattttaggacacttatttataggattggttatttttatttgcttgttttaaagtacaagcttcaaacaagggtatgcaagtagaaggatatttttaaggaatcaacctaaatatctacaaaacctgtatgtgtatagtttcctaaaatctgcttcagaaagatttgatgagatttaagttctcctcccccacccattataatcactcttatctctttataaaagagaaaaaaatccacatactgagcaaccttaatcatattattggtacattactccttggaaaacaacaacaaaaacgctccagggcactaaacaaacaaatggaaattggtcttggtgtagaaaacagtgaatagcttttaggtttgagtatcagattcttctgaaactaaggtggttttcaattctttttgttttcaacataattgaagatatacctaatagagtttcagctgacaggttatgggaaaccatttttgatgatttagtatggcactgtatattctttttgtagcttggaagaatttccaggaattaaaatttccatattcttattatgtgagcaaatttctcagttcttaattagaaaaatgaaaaaaaaataagcagcatactgaaccctctgttccattccagcaacaagtgatgatcttccaagtacatgaattattagaaaaaaaaatagcctcatccatctgattaacagatgcatttccaataaatacttttcacattatataatacatttatattgtttaaatcaagtctgtactaatataattttagtgataagattctcagtctcaaaaaacctacattttcccacttcccatgtgattatggtttggatttgtgccccatccaaatctcctgtcgaatataatccccagtgttggaagaggggcttggtgggaagtgatttgatcatggggcgagtttcttccttgctgttcttgtgatagtgagtgagttctcagatctggttgtttaaaagtgtgtagcatctcccccttcactctcttcctcttgctctggctatgtaaaatatgcctccttcctctccgccttccaccatgattgtaagtttcctgagcctctgcagccatgcttcctgtacagcctgcagaactgttagccaattaaacctcttttctttataaattacccaatctcaggtagttctttgtagcaatatgaggacagtctaatataccatgtaatatgaaatcataattagtaaatgattttccagcaaatgaacatactacatgaagataaaattctgtggggaaaagtgtcatggaaaatgattcaaggagaaaaagaaatatcatagcatttctattaaagaaggcagtgctttcatatttttcagtgaaagatattgagtatcagattgtatattccatggacctatttaaagaggtgatgtaaccattttactttcaaatctcaatagctaaaatgcatctttgcaactagttaaaacttaggaaaataatattagatgtcaataaaaaaatacatgagaagtatctgttttttcaaaagtcacctaggaggaatatgaacaagaagtatgtggagaccagtgctacaaaacactctggaaagaactgacctaagtcttcaggttctctttctgaggcccagactcctctgttcttcctgtcttttcaggccaagtgacgctttctgggtagagttcttggactataaaaagtgattcactaatcaaattatgtagtcagtttaaaaaattattaatagtttttgtgttcaataattacaaaaattgcgttaaagtaattctataggccaggcacagttctaggcaaaccacttatgaacaaaatgatgccaattcctgtcctcatgaacattctaatgaggggatgcagacaataaacatatataataaaatataagagtagtaggtggagagagctggaagaagttgtcaaggggtaaataagatccaattaaatgtttaggaaaatctttgtaagaagctgatatttgagcaaaaatctaaaggaggcaaaggagtgacacatgtaaatatccgaggcaaaacaagagaaaacagcaagggaaaggtctctgaggtgagatcacacaaatattaccgaggaaaatgtcattgtgagaggactggtgtgggctatgagagtgtaggagataagatctgacaagcaaggggagcagaaacacagagccatggtgtctattgaaatgacattgtcttttattctaagccaggaagctatttagagtgctttgaacagaggagtacaaatactgcaagccacaacaaagtagtgttgttactcacaactaagctaactttcaaacttgggctctcttaacctaactgttcctgtatatatccttttctttccccattcctatccccttcctttttcatcttgtcccccctcttttctctttttttctttccctttcttccattcctcacttccttcattcctctttctttttctttctttctttccttcttttttctttcttttctttcttcctttctctctccctctctgtcttcctgtcttccttccttccttctttcctttcttccttccttctctctttctctctttctttctggctctaattttaattaaattaccattttatgatttgttacatttaataaaaagtgttattcgatttccttccaaattacaaaccaactcaatcaaactataataaagaaggaaaaagttatatttaaagtcacaactatgtaaaatcacctcttctcctaatggagtatcagaatttccttccagagaaatgacattttgtttagcatatcttctttaagtgtgcaagatgcatacttccgtgcatgctgtgtttggaaagaaagaagcaaatagataaactggataaatgtactgctactacaagtaaggaggaccagagaaatgtaggcagagaaatggggtgagacaggagaaagaaagggtcataggagcaaagggtactgttggtgagtgtcactcgtggataaattcctgactggagtggaaggaaagtgacggaaagacatttaggggcaggcatattgaatattttattttttgattggtaatattgatactcctatgatgtaatcatagcccctttctcaaaccatcccaaaattcagtagtctcccacacatactccatgttaatcatgccctggccacgtcagttttaaaggaaggtattataggttgctgtggggcttgaataaaatagccatcagagtgagatataagatcagggcttcagaaaaaaaaaaaaaaagaaatttgatttaaaaccaaaaaaggcccattaaaataacccaaactttgaggaatttgtaggaatctggaggtgggcatcaaacttcccactaaatgtagagagtggggtaggggaagggaagatgcaggaaatgggtcaatttaattttatgtaaaagtctcaaaagatgggataacatcagttaacacctggactatacaaatatgccaatactggtttccagtaatacttattctatgatctcatttaccagacaagcaggactaacatgcctacactgctcagatataagaataatatcctggaagcttattttatgttagaactgcattgggtaggaccaaggaatgtgaaaatatgaggtactatgacaagcagttgacagaataaaagctaatgcacctattaaaccaaattatcatttttaagtaacaaggcaaagatgaaaaatttaatttcagtgaaacttcatcctatggaaattggggaagctgaaaagaaaatgaggattaaaaagaggagggagaagttagggcctaggaaaacttcctgtgaagaaagtagttgcatataaattttgaaaagcttctgaagatgcaggcatagggccaagggacaaatctaagtgttaacaacctgaatctgaacacctacaatgaacacacaaatctgatcatgttatatcttacataaaagcacctgttggatcccactacctgtaaggcacacagtcagtcccctgccaccactctttcatctcccgtgactccctggagggttgtttgtctagtcaaacccattccaagctcttcctctgagatactgttttccttcatactaccacgctttgcctaaaatttggtatatcctttttccctttgtcaatttacaatctctttaatgtcttagatacttcaacctttcagaattctgttttctgttttcttgcaaaattaaaatgggtaatatgtcacatgttaatgtgatttggttgtgtccccacccaaatgtcatcttgaactgtagttcccataatccccacatgtggtgggagggaacccgatgggaggtaattgaatcatgggggaggtttcgctcatgccattttcctgatagtcagtaaatccttataagatcttatggctttacaagggacttccccctttgttcagctctcattcttctctctcctgctgctatgtgaagaagaatatgtttgcttcctcttccatcatgattgtaagtttcctgaggcctcccacccaagcctctttcctttataaattacccagtcttgggcagttctttatagcagtgtgagaatggactaatacagtaaattggtactggtaatggggctctgctataagaatacccgaaaattggaactggataacaggcagagactgtagcagtttggagggctcagaataagtaggaaaatgtgggaaagattggaacttcctagaaacttggagggctcagaagagaggaagatgtagggaagtttgggacatcctagagacttcttgaatggctttgaccaaaatgctgatagtgataaggacaatgacgtccagtccgaggtgatctcagatgaagatgaggaacttgttgggaactggaggagaggcaactcttgctatgctttagcaaagaaactggtggcattttgctcctgccctagagatctgtgaaactttgagtgtgagtgagatgatttagggtatctggtggaagaaatttctaagcagcaaagcattcaagaggaaacacagcataaaattttggaaaatttgcaccctgacaatgtgatagaaaataaaaaccaattttctgaggagaaattcaagccagctgcagaaatttgcataagtaacaaggaaccaaatgttgatcaccaagacagtgggggaaatgtctccagggcatgtcagagaccttcatggcagcctctcccatcacaggcctggagggctaggagggaaaaatggttgtgtggggcaggcccagggcccccctgctctatgcagcctcaggacatggtgccctgcatcccagctgcttcagctccagccatggctaaaagaggcgaatgtacaactcgggccattgcttcagaaggtgcaagccccaagccttggcagcttacatgtgctgtttaacctgtgagtatacagaggaaaataactgaagtttggcaacctctgcctagatttcagaggatgtatggaaatgcctgaatgtctaggcagaagctggctgcaggggcagagccctcatggagaacctctgctaggccagtgtggaagggaaatgtggagttggagcccccacacagagtctccatgggggcactgcctagtggagctgtgagaagagggccaccatcctccagatccctgaatggtagattcaccaacagcttgcaccgtgcttctggaaaagccacagccactcaacaccagcccatgaaagcagcctggagggatctgttccctgcaaagccacaagggctgaactgcccaaggccgtgggaacccacctcttgcatcagcatgccctggatgtgagacatggagacaaaggagattgttttggaactttaagttttaatgattgccctactgaattttgaacttgcatggtgtgtgtagcccgtttgtcttggccaatttctttcatttggaactggtgtatttacccaatgtctgtaccctctttgtatctaggaagtaattaacttgcatttgattttacaggctaataggaggaagggacttgccttgtctcagataagactttggacttggacttttgggttaatgctggaatgagctaaaactttgtgggactgttgggaagtcatgattgtgttttgaaatgtgaggacatgagatttgagagaggccaggggtggaatgatatggtttggctgtgtcctcactcaaatctcatcttgaattgtagtttccataatcctcacatgtcatgggagggactcagtgggaagtaattgaattatggaggtggtttcctacatgctgttctcatgatagtaagttcttttgagatctgatgctttataagggacttccccttttgctcggctctcattcttctctctcgtaccaccatgtgagaaggatatgtttgcttcgccttctgccatgattgttaaatttcctgaggcctccccagccacgcttaactgtgagtcaattaaaccactttcctctctaaattacccagtctcaggtaattctttatagtagtgtgataatggactaatacacgtgtacatgttattttcttcctttattgagaaatcactctcaccttttccttctcctcactcctttgccagttcttgctgtattctaacatacagatctgtttagcattttcatatctgtcaagctttgaattcaggttgttactcccaaactgtgctcctgtaagcacttgtgtttcatcaccaaaatggtataatgtcagtgtgtctcaatttgcagtaaaaacatagtaaattaacagattcaattttttaaaattctgcatgtttcttgcatagttttaaacctttattgctatcaggagcttactagattatgaaaaatggaatagccagttcacatgaacagaaatatgcaaagttgtgattaaattattcttttgttctttttgagaagggacttgtgtgtgtattatgattatattttatgtgaaaagatgctgtcacaattaaatatatcacaaccctattctgttctgaaagtggtttgcctgaataaaattagtaatttatttcttatttattataagattatcttattgttaacaatgtttgtgtacttcatgagaatctagtatttatgaattctagattttctatgttgtatcctacctttaatcaaagtatgttccctatccactttccctttagctgtaaaatggcctgataaagtaaaaagtgaccactattttaccatcttacaaatctggattgaaagtgaagttgtccagatcatggcagtagaggaagaaggaagaatagctggggtgagggaaaggtcactctgggaaactatagcctcttcccttatttccagtagcacctttcctgcaaaccaccaccaataataataataataataataatacaagagaaaccaaccttgttctgagtcaaatactattaacttccctattttttagttggaacaaacccaataacaggttaaagttcttgtcaaggacacccaactaataagcagagacagcattttctttatgttgattgtgttttttaatctgaagattttaaagaaacgttcttttgtcttgagtgagattgttttacttccaaacaatttggtatctatccaagtgtgagtgtgaatgatttatgggaaatttgaacatcttggtgtgctttttgtgaaacagcaaacaagtgatatttatttgtggtagctgtacttttaatgacagtaacaacaatctaagaattgtacgatggtttattcatctcccatatatcaatgttcaggatgtagtacgtatacttcgggggtaatgagttatatagtagacaacgtcaagtgtttttttaaaaaaattatgtactaaatataataaagtgcttacactgtaataggactgttctaacttttgaaggtacaacagggcatgagatggatcaagtctaacctcttatgaggcttacattttagtggagaacacaaggaatacagacagagttatcttgctgagatctgaatgatgagaaagacctgatccatgtgaagattttggtgagatgtatgaggcaggagataaaagggaaattttccaggtagatggaagagtaggtgaaaaggccctgaagcaaggactgcaatgaagaattctaggacagaaaaccaaacatatatgaaagtcaaagtttctgtaggcattttaaagctccataatagacaagagtagtgggaagctattagagacttttaagcaaggatataattagtgtactttgacttatatttaaacattattttttatctggtaagaaaaatagaccacaggggaagaaagaatgaaagcagatcaacccagtaagaagtgactgatatatttcaggtgagataataatagtggcctggatggtagtggtatccatggagatgcagctcctcccagattcagatgatgaagacataaaccccatctttcaatggacaaagggccaaggaatttgtgcctatgccttaaaattgccacaatatcttaaattcttcttctcttcttcttttttaacaaaagacacatatctgtgtggaaaactttctttgtctcttcaggctgctacaacaaaaaacttagaactgggtggtttataaacaacagaaattcatttctcacagtgccggaggctgggaagtccaagatcaaagtgctggaagatctggtgtctggtgagggcccactgtcctctcacatggtggaagaagagaactctagtcgattcagtcccttctatgaactctattcccattcatgagggctccatcctcatgacctaattaacctctcaaaggcctcaccttctaatacgatcacattgggaattacgtttatacatatgacctttgtgggtacatacacattcagtccatagtaaagagtgtattaactcattaaattataaataagtaagtaaacaaacaaataaataataaaactttaaaaatacagcataatccagaattcaccaacggcagtcttgctccctgaagccagcttggattgtatcatgtggtctgttccaagttttgagtattctgctccctgaaagttccagagaactgttctgcctttagcagtaaagtattctgatagatggctccatgctggtgtttttgtcttttgctatagtccaagggtaggaatacattgactcagtgtctaatctaatgtcaagctacactacagatacaatgaattaagacctttcccacactccagaatttccttcataatcttgtgtctctacccatgtcattctgatgctttttaaacaatttcttcaggacttctggatacaatcataatagtctgtgggtgttctcttttagcttttcaatagtgtgagggtctgtttccttgccatgttagtgacaggttacagatgtattgtctcctattaccttctctagttatcaacactttattgacaggatctgcaacacaaaagaaatacaaagaagaatcttgtgaactttttttcagtaaataagtgaaataagtgtcttactccgtaggacttcagcttattcctgtactgtttacagaaaaatctaaaactgtttctctaaaaaaaaatgtagcctaaagttactctctgtcttgtcttaacaataaactctgaagaaggtaaagaggccataagaattgtggtcaaacatgagtctgggcatggtggttcatgcctgtaatcccagcactctgcgaggttgaagtgggtggattgctgaagcccaagagttcaagaccagcctaggcaacatggcaaaaccacatctctttaaaatatacatatataatttagctgggtgtggtggcacatgcctgtagtctcagctattcaggaggccgaggtgggaggattgcttgagtgccagtggtggaggctgcagtgagttgtgattgtgccactgcatttcagcccgggtgacagagcaagattttgtgaaagagggaaagaaagaaagaaagaggccgggcgtggtgactcatgcctgtaatctcagcagtttgggaggctgaggcgggcagatcacgaggtcaagagatcgagaccatcttggctaacatggtgaaatcccgtctctactaaaaaatacaaaaattagctgggcatggtggtgcgtgcctgtagtcccatctactcggggggctgaggcaggagaatcacttgaacttcagaggcggaggttgcagtgagccgagatcgcaccactgccctccagcctggtgacagagcgagactccatgaaaaacaaaaaacaacaacaacaacaacaaaaaagaaagaatgaaagaaagaaagaaagagagagaaggaaggaagaaagggagggagggagggaggaagggagggaaggaaggaaggaagggaaacataaatttacttttggtttttaggcaatggtaatatcaccaaatatactaatttttttctgagttcttatagcagcattaattgaattttttttcaaatcaatcttgctattagagaaatacaacaaaaattttaaaattactttgataaacctaatactccgttgcttttaagcaaactgtttttgttttctagccactaataagatttacaattatctgatgctcagaaattatattaaaaaataaagcaaaccaagctgaacaaaaataaacaaaacccagacaatatagtttgcatgatgccagccatctgccaattttgacttattttattactataaaaccgtataagttcaattagatattaaagatttgtcacataacttttaaaaaatataattttatatttagctttgccctgtctaaattattaccttgtggctactatctagcaatgattttctgcaaattcacagaaaaaattgtcttctttcattaatctattttcctaaactttctaacatgatattctctcttctgtgaggcttatataagatgtggaaagaggcatgctttttatgttataattttctattcctattattccgtctgatgtttctcatttttttgtaaaataaattcatcctttttactctcctactccttgtataatatatgttatatttattttttttatttattttttcacttatttaacaataccatttgacccagcaatccctttactgggtatatacccaaaggattataaatcattctactataaagacacatgcacacatatgtttattgcagcactattcacaatagcagagacttggaaccaatccaaatgcccatcaatgatagactggataaagaaaatgtggcacatatataccatggaatactatgcatccataaaaaaaaggatgtattcatgtactttgcagggacatgaatgaagctggaaaccatcattctcagcaaactaacccaggaatagaaaaccaaacactacatgttctcactcatgagtgagagttggacaatgagaacacatagacacagggaggggaacatcacacgtcggggcctatcagggagtggggggtgctaggagagggttagtattaggagaaatacctaatgtagatgacgagttgatgggtacagcaaaccaccatggcacgtgtatacctatgtaacaaacctgcacattctgcacatgtatcccagaacttaaagtataataataataataataataataataaatatgtactgatgttaaacatctgaaactagtctggacacggtggctcacgcctgtaatcccagcactttgggaggcccaggtgggcagatcatttgaggtcaggagttcgagaccagcctgaccaacatggtgaaactccaactctactaaaattacaaaattagcgggcatggtggcaggtgcctgtacttccagctaccaaggaggcggaggcaggagaattgcttgaacctgcgaggcagaggttacagtgagctgagatcacaccactgcactccagcctgggtgacacagtgagaccctgtctcaaaaaaaaaaaaaaaatatgaaactatatcagcactatgggatatacacacctatttattttatttctgtctccacacccggaggagttccacagttgactccttcgtttaaatactacccttatcccaaagatgcaggttcagcagacgcagcacctcttgtcctgcaaggtttaaattttccttgtggccaaaatggtcctgagaccaaaagacactggttaagatacagcctgaagtatagccttaacattacatggtagaaagtaatttttattcacagaaaaacacaccaacacagaaaaatatgtacaatgcccatttgataactgaggatcgcacaatatagcagtaacttcttgctttggccataggcatcggatagattatggggaatcttcctattctccaaaccaaggactgcagcctcaccctctgctacctattatgctcctagggatcatctggctttttgttgatacgtctgagtgtgtgtgtgtgtgtgtgtgtgtgtgtgtgtttcattacctgcttcagaattaatgggtttttgttctttcctgttaacctttcttcttatttcctttggaaaccttaatacagctttaaatacttcttttatttaaaaaataaagggaggagtcatttggtttttgcagtttgttgaccttattactagtcttcattcctggggaaagtgctgttctttccaaggcagttagtaagtaactggctctttccacacttatctggatgaacctgaggagtcatctagctcaacctcctatacctgtcagtagtctcttctaacaattcactgtaggtatgcatacagtacctattctaatacacgagcattttgagttgcctgaaaggagtttgggaaattgcagccttctggagggtattgaagtaggtgcctttatatctctcccagcagccttcaaatgcctcttattttttaccaatattggtgatgttagaaatgggtgtgaaatgactagatcaggatcgggggaaggactgataaatttttggctagctattactgggaacaaactgaaaagctggacttaccagttactggagataaagctgtgttttgcacataattggtgctcaaagcattatttgtaaaatacatggatagtaagtaaatataaaatcaaattgttgattagcataaacatcaggttaatgtttggagtgggctgccgagggaagagcatagggcagcatagtgtaggaagtgagcttggagaaaactggcctctgagccaaagaatctatctgtgaagctcagctccactaatcattagctctatgtgactttgagcaagaaagttgcttttcttacctcaatttcttcgtctgcaaaaagaggtgataatgaccatcactttgtagagttgttgtgagtattaaatgagttaatgttcctaaaaatgcttgaatggagcactctataagtgattaccattattttcttaagcaaatggttgcaattacaaataggatgttcctatttgagtgaatttccaactaggtaatgaacgactttaacattttgtatgtttttctttaaatattagaaataagaataaatttaaaatcttgtatgtttacaaaaaatactaccactatgtacctacagttttacaacttacttttttcacttaaagtatgtcttgaacaattttctgtggtcaggacagaaaaatttttctcttatttcatagttgtttagacttaggaaggcactttgaagtcctttattctacccttctaactccatatcatgaattaattgtgcagttggcccttgaagaacccagtgggtaggggcactgaaccctacacagtcgaaaacccatgtataatttttgacttcaccaaagcttaactactaatagcttactgttgaccagaagtcttaccagtaacataaattgtcagttaacacatattttgtatgttgtatgtattatatccaataaagtaagataaagaaaagaaactgttatgaagaaaatcataaggccaagaggggaggatctcttgacctcaggagttcgagaccagcctgggctcgtcacagggacacctcatctctacagaagaaaatttaaaaattagtgaggcatgatggcatgtgcctgtagtcccagctactcaggagacttgagttgggaggattgcctaagcctgggaggtcaaggctgcagtgagccatgttttgccactgcactccagcctgggtgacagagtgagactttgtctcaaaaacaaacaaataaaaaaagaaatgaaaagagagtcatgtggaagagaaaatatccttactatttattaagtggaagtgtaccatcacaatggtctttatctttgttttctcattgagtaggctgaggaggaagagaggagcacttggtcttgctgtcttagggatggaagaggtagaagaaaattcacatacaaatgatcttgttctaagagaacatgggaacaaaatactgtttcggtatatgtatataaaaatatacagacacagaacccacattttcaaagccttttcacaggatagcatcttctacacctttaatcaagatgtcatgtcattgaaaaataccagctggtctgtgtactataacctagacaacaatatgtttgccataaaggctgactctattttatgaaacctttagaaatcagtattgacatagatccaagagtcaaatgaaaaggatataagcaaaattaattttgaagaattaagacaattatatttataagtatataattgagattctttcaatggaaaattgtagagtattctagtatacgtggccaaaaaaatatgttagataccaaaggccagagataggccttccaatagctaagaagttctagtagaaaagacagatatataaataaaaatggcaagagtgtaatattggatacatagggacttattcacttaattccagagggtacataacttatacagaaaatacattgctttagggcaaatagaattttatttaaatactttaaaattaattgacttctattatcttctctataataatacattgggtattattcatttgttaagccaatacattacagttctgcaggtagtttttaagagactactacatgtcaggcactgtgctaactgttggagataaaataattaacaaaacaggtaagtttgtccccttaaaagcagaatctctcacaagagagagctaaataaagaagcaattatcaagcctgctaaatgccaaaaaagggaaaatcatcaggggtaggaatagattatttatagatcataaattttagaattattaagctagaaataattgcagtggtcatctaattttttacaaagccataaactaagacccagagagaataatggtgtagctataggcagaaatgaaacaatcacacgtatgtcctatcaccattggttgccagtcgccacttaaaattgttggagcgtttggttttgtgtccggaattggtgggttcttggtctcactgacttcaagaatgaagcctcggaccctcgcggtgagcgttacagctcttaaggtggcgcgtctggagtctctcccttctgatgttcagatctgttcggagtttcttccttctggtgggttcgtggtctcgctggctcaggagtgaagctgcagaccttcgtggtgagtgttacagctcttaaggtagcgcgtctggagttgctcgttcctcctggtgggctcgtggtctcgctgggctcaggagtgaagctgcagatcttcgctgtgagtgttacagctcataaaagcagcgtggacccaaagagtgagcagtagcaagatttattgcaaagagtgaaagaacaaagcttccacagtgtggaaggggaccccagcaggttgccaatgctggcttgggcagcctgcttttattctcttatctggccccacccacatcctgctgattggtagagccaagtgtgctgttttgtcagggtgctgattggtgtgtttacaatccctgagctagatacaaaggttctccacatccccaccagattagttagatagagtttagacacacaggttctccaaggccccaccagagcagctagatacagagtgtcgattggtgcatttacaaaccctgagctaaacacagggtgctgattggtgtgtttacaaaccttgagctagatacagagtgctgattggtgtatttataatccttgagctagatgtaaaggttctgcacgtcctcaccagagcagctagatacagagtgtcgactggtgcactcacaaaccttgagctaaacacagggtgctgattggtgcatttacaatccctgaactaaatataaagactctccacgtccccaccagactcaggagcccagctggcttcacctagtggatcccacaccggggctgcaggtggaactgcctgccagtcctgtgccctgcgctagcattcctcagcccttgggtggtcgatgggactcggtgccctggagcagggggtggtgctcgtcggggaggctcgggccgcacaggggcccatggagtgggtgggaggctcaggcatggcgggctgcaggtcccgagcactgccctgcgggaaggcagccaaggcccagcgagaaatcgagcgcagcgctggtgggccagcactgctgggggactcagtacaccctccgcagccactggcccgggtgctaagtcccccattgcccggggccagcaggactggctggctgctccaagtgcggggcccaccaagcccacgcccacccggaactccagctgccccgcaagcgccacacgcagccccggttcccgctcgtgcctctccctccacacctccctgaaagctgagggagtgggctccggccttggccagcccagaaaggggctcccacagtacagtggggggctgaagggctcctcaaatgccacaaagtgggagcccaggcaggggaggtgctgagagcaagcgagggctctgaggactgccagcacgctgtcacctctcagtttcatgagtttaatatcctctatgcaaggcaatattttatcaaaccattgaataactacgtaattattgaaaagcagaactgcaagcgtgtgtgtgtggggaaggtgttataatctgtatgaacaattattctaaatgaaatagtagcaatcttcataggttattaggataagacacttagtaggttttattaagtgccagggaagcagaaaagatactaaggaaaataaaaacaacacctattgtcattttctatgcaccatctcattttttcttcacaatggccttctatgttggatataattgtctctattttactgatgtggaaatgaagttctagaaaaaagagtaccttcttcaggatcacaaaatgatttcatagtaaagaagggatttcaatttagctattttgttttgttcccctatgcaaaaatattcttggtaggtaaacatcactttgccaattgaatgttaaacatttttttttacctcagtggaaaaatcataaaatatgtgctagggttttatgatacaatgaaacattatggaatgcaggacagtcagaggaaaagagttgggagatgaaagtgtttgggacaacatttctactcttttcacataattattcatataaataatttgggccacaaataattcactggcgacttaaacttttggttcaaggagtgacctttaattaaagaaaacacctttgctaaagcaaacaactaaaacctttctaaaattaacaaatttttacaatggaaagaaacacacacaaaaaacaaacacaataatttttaaatttcttctatcctgtgaaggaattgacattttaatggaaaagataggatttttctaagtcccagggagttggccctatgaaaatagcctgaggcaatatgaggatgtttggatgtttatctaaaagtgcatggagcctgaaggagagcaatggtttcaccattttgcctgcatgtgcctccaaccataaagcacagacttagctttcgttaggattacttaaggtatttcccttcccccaggccatcttaagcttcctgagagttgaattagttacacttgttttaaggaagtattaaagtaaccttttaaatgatcaactttgcaacatcaagtgactctgaaagcccatctcctggattggtcatccactcctaaaggttaagttttcaagcagaacatgaaaaccctcaatgatttcaacaaacatatctggagcaagtttccttcaaataacccattttctaaaatcacacatgtgcctctttatactcttggatggtatgcataacatttccaaatttagctgattcagccaaatgttatgaagaaaccatctgattaaagtaattggtaataaaatatgaataattaagtgacaccctccttagaggtatttgctttcaagagagttggctaagtgctcactaattgggagatcaggagagggcaacagcaatttagcacactgcttctgctttacattttcctttctgggtaatgtattttttgctaaaacccctcagttgtgtgtgcaatattctaagacatgcactacttacatagtaataatcattaattattttctatccatgatttctgagacttcttttcaaatacttctttttctctccactcccataccacgttccttttcatttccaatttgtaccttttcctaaatggagtatccacaaagaaaggcacatttggtgttatttttccagacactgacaaaatacagtgcttcttgaactttttaataaactagttactctttattattatgattgctgttttattgaatgttcataacttaacacactcctataacccggttcaagaaactgaacatgacaagcacaatattcttcttcttaaaaaatgtttctagctgggcgtggtggctcacacctgtgatcccagcactttgggaggccaaggtgggtggatcaggaggtcaggagttcaagaccagcctgaccaacatggtgaaacccccatctctactaaaaatacaaaaattagctgggattggtggtgcacgcctgtaatcccagctactgaggaggctgaggcaggagaatcgcttgaaccagggaggcagaagttgcagggagccgagatcgtgccactgcactccagcctgggcaacagagcaagactgtctcaaaaaaaaacagcaaaaactgtttctaaccaaaaataatgtctatccttccattatttttggtgaaatcactttgtgttgtatcagctctttgagtgacaaggttataacactgaatgtgcacaatatgtttcaaggactgaaatatatagagaaaaagattgctactaaactctgggaaaaaaatgtatgcctaaaaaaagatataaaattttgatataaagcccgttgtttcaaaaagcaaggatgcaataacatttgtgtatgtggaggaaaataacttttattcaatcaaatatttattaaaatagtgtcttttcaggcagataatttaatttagaatgatctcatttgttaagcattgaaaacttttttttccccaaaggaaaattcattatcttattgaaatgtaatagtaaaatagccaaaggtaataataaaataactgacttacagctccttttggtatgtgttcccttgaaatattaagaagtaacaaaaattctcttcaattaaaattgtatgcctggtatctgttttctatgaaagaagctttttatgtttcacatcaaattgatcaaagcatattacttgccttttgcaatgcaaacacatctttttgagaaggctgattttctcatcccttagaaagtttataaattattttacacaatgtacagtaatttatattagacatgttaaagtagaagcctatagtgaaatatttatgattaaaataatgatatgtttcaactcagtgatactagtccaggaaactaaagcaatgtgacagaatttgtccgtaatttaatttagcacttatcagagcccttttttttttttaataaattttgactttcgtaaaggttacggtcgtcagggtcacataatatgttttgtttcccccaagctagcatgaggttcatattaggccctcaatacaactttatgatggcgatagtagcactcaaatttgtggaagataatttacgtttgatagttatctgagaacaactaaacccagctacataaacaccagtaatggagtttttggtaaagaataaagagattcttgcagagccgatcacaatttacttacaacaaaaaattgagatatttcttcccattttaaactttctacctcttagctcatccttactttctattaatttaaaaaatattattataaatcattttgtattatttggggtcctctgcattagtcatagttttactaaaaacagtgtattttgggttgttttattttgtttttacatcattatatgtggagaaattaatgaatatatctcctttttgttcctgaacttttactttctattcttcctaacactgctaagctttaaagtcttttcataaatcttattctctgagtaaatgcccgtctgggaacatggcatttccacattttttttgagcggtccatagggtaatttataacacaaacattttaattaataatgttgatgtttttattattcctaaataggtaatctgggttttgttttgttttgttttgtaagcacgtaagaccttgaatttcttagagtacagatttcccttagaattacatgggggcattaccgagataatttctgcttgtcaatgcttacccagaatattctaaagaaagacagcagcatgtcatagaagggaggtgagtattaaccacctactaagtgtgaggcactgtgctgggataaagcaatcaacaagatctacacaatctcagcccacatgaaagttatattttttagggaaaaacaggtaatacacaaattcatatatgttctgatttctgatattggtaagtgtgctgaagaaaattggagtagatgtggtgattgggaataatagaaactgctatttttaatagagtgttcagggaagcctactccaatgaaatgacatttaggcagaggcttgcatgaagttaaaagaagagagacagcaaagagtacaggctctgaagcaggaggactcttggtgtctttcaggaaggtaggtttgccttgagttcagtgactgggggtgagtgacaagatatgaggaaggatatagggcctggtgaacaggagtgagttccattttctgggcaatgggaagccaaaagaggatttaagcagttagaatgtgacttgtgttttaacaggatcactctggctgcaatttgggacatagattagaggggtcaagaatggaaggtggaccttgtgtctagggagagatgatggtgacttgggcaagcagatgaatatttagagtagtagaagaaagtagatcaaatgtattttgagtggagaattttgttgagggactgcatatggaggtgattcaagaatttcgatatgaggaactgggtgaatggtgcatgccatatacatggatatggagttttaatttgctactttttgacagtacacttcgacatccactacgaacagatatattcgtataacaattattttatttctaatatttttgtgcagctaagtgacaatctgtgaccattccagaaagaatatcttgattgttgtttccattttgccccatttcagtgactgagaagaaatatgccatcatttttacctgtaaaactatgtttaaaagtcctactcattatttagaatcatttctactgcattgtctcaggtgaattcagaggtataaaggtaagtttgcattaagggcaaggcctgggagacccgggcgtaaaatgcggctcataagtgttgcaaatcatttgattatgttagaagttagagttctccaatttgcttaatgtgattttaattttttttttaagtcagggaactaaggtgttttagattttaggaccttaccttcttggttcctgcccaataaatgatttttttccttagcaaggctttcttttttaatgcactagattctctggcattattaatctgaattaataatgtctgtcaaattagatttaggttgtgggatagggaagacttgctctacttttggggaggcaatagctatttttataggaacctgaatattataagtactccacattcagggtatttgcactagtaagttatattaataggtaacttgataacatttctaagaactgggtcagagggagatattaaattggtgccttacaaggtttctaacagcttggcttattttgcaagcaaagttagagtgcattttcatggagacttttctttatagtttatggcccagttcaggaaaaagcttcttgaaaataaacttttccaaaatctaaaagctgatattttatgttaacttattttggacattttcaaactagttgattattgggtattttaatactttgctaatgtataaagacacagcatccttttatctgctctcagaaggcactgaaatggttctttatttatttagcaatcacttatgggatgctatcattgcttcatctatctttgcccagaaactagggaagcatttgagaagacatcactagcaaaatcaggttttttgtttttgtttttgttttgttttaaaaggtcattcgaagaaagcatcctgcctacttaacatttctttatcacagaaatagcatgtgaatctcagtctctttatgttacctctcatgactttcctcaaacaccaactgctcctacacatttcctactaggcttaagtgtatccttcagctttggtcttggaaaagtatcttgtaataacactcttgcctccccacagtgttgtttttttttttttttttttttttgaggcggagtctcgctctgtcacccaggctggtgtacagtggcccaatctcggctcactgcaagctccgcctcctgggttgacgccattctcttgcctcagcctcctgagcagctgggactacaggcgcccgccactatgcccggctaatttttgtatttttagtagagacggggtttcaccttgttagccaaaatggtctcgatctcctgacctcgtgatccgcccacctcggtcttccaaagtgctgggattacaggccccacagtgttttttgcttgtaacacattttctctaaccatacctttgactctctgcttcttgacccttggacccacgcattggcattggtaaagtgtttaattcccaaggccaattttagccttcagatatggcttcctgagcagccactggggtcagctaatgaagctcagccatgtgggaaagttagttcctctcggcatgagtctagatatatgggaaacaggaacaggaagggataagacagataatttattattatttctcccatcagggaatggcaatggaagtatgttttccctttgcaaaccttccagataatctggtatgcagaagaaaggcatatcacgaacaacacatcctttgcatttcctcacatttttccttgccacaagattgtccatccccttttcttctctcatcttcatttcctgagcttgcacctctcaaagaaaatgtcagtactctaatccttgcttcaggctctggtctttttaaaggattcagactaagataactgttattaatctacgcatttagcaaagattgtgaggaacagaaaggtttttaagatcccctctgcctacactgtctgaattgccattagttgttcacattattctttcgaggatgagtttctaaaaaagcaaaaacaataaaacctcctccttcaaaagacactgaaacttttttgtatcataattccaggactaagaaaatttcttcccagtcaaaacttttaagtaataaatgtattataaattaataaattgaatgattgaaccaaagaatcatgagctattactaataggcattttgatatgtcataggttgtgatatgcaaaaattgttttatgacccagtaggatacgtgacttctgtcattagcttctctttgtctttcaagtcttattaactttggaaagtaagcaatttggaagacaatattgtaagtgatgcttgagatgcttaagaaatatctcacactcttttaaaatcaataagataatgaagattttgatcatttcaacatactctaattatataattagatatcataattacgtgttcaaattgttacacatatgaacactaatttcttaataaaagacaagccagctttgtaaatataccgtaattgactgaagtgacaaaattaagtaaatacttccatcagagaatattagggaaggataaaaatacatttttataatacaatgcctttctatgaactctagcatctgctatttgttggaagtcttatgtgtattgtattcattttgtaatgagagttgctgtgagactgttacctaaaataatgaatgtataaatgtattaggtgaggcaaaaatccttatcatgaagtgccacagtagcgtcttggaatgtatgtcatttcctgtggcctgataagtttaatatgtatttatttcctcttggtgttgtatctttaacatgtactcttgccagagaaattgatatttgaacatatttaatatcccaggacttcttgggaatcaagtatagaagctgcagtggtagatgtgcattcggaatactgagatcctaggtttttatcatttcctttacttaaggaatacagtatgtgaaaattgctatgataaaccaaaatttcagatatgtccaaaccttaattgataattgataaacggtgtctataatttaccttatggtattttgtatactagagggtttgttattatgctagatgacttatgattatggtttcacatatatctacatatatgcatttatataatatataatatgaatatttacatttaatatttataatttaatgatataagtatttatagcatatatgcacacacatatattattaagacaatattaagttactgtgtctggtaattttatttttattgctatgtgattgtcggtcttattatctgaatgtaaaaagtaagttcagtgacaagaaaaataaatatttaaaaaagatattttgctgtttttaatttgaactagccaggtagacgaaaacattttaagggttaccctcaatagttcaggaggcaacaaacaggctgaatagtttcaattgtgtcacctattttcttagaggacctgagtgcaagttgtgaggctaatagagagatccattagtaggggttctaattcataacttttaaaggtttgagttctctctccccagtccttgtggtgggagtgaaatgttctcagaaatgtctaaatgtaggtttgaattgaaacagtctaatatactatcaggtcaatactttgccttttagttaaccacatagcatggtttcttttataaactgtaacaaaatgttgttttcccgccctttgcgtaaaattttctatagtaacatctttttctttgaattttaggaccagtaattcctcatttttattctccctctgccatcttgctttaatgacccaccttactcatactacatatcacatgaagagtattcaaagcaatgagatatccttaagaaaatgacaaccaaggctaaagtacaaatttggatttttaagaaatcaaggacagtacactgatgcaagttgaatatatgttcacataattgctagcttgaaaactaagcgcgtaaggagagacgaccaaatctttatcatacgcattgtaattttgacatagattttaatatatcggttttgtaataagaattttatttatattttacctaacatatagtttagtgttttatatgcagttctctcagttataaggtctaatgattgtaaatattgtgaaatatatcttcatttatgtcaggatgaaactaagtattcatgggtttttgcagatattggttttatctttacatggatagatgaactggtgacatagtttactatcaagcagtaaacttttagttttaaactttataaagttatttattaaagtgtaagtacactgataatttaaatactgagtgtgaaactcttttataatagcagttactttcagttgaaggcacattaaagtctttatgaattacgcagagtagcttctgcatgtttaaaatagtaccaagtaatgttttcatttagcagaacgtaacttctgattgttcacactctgttgatggtgccacttctctctttagttaccaatgccctcctattttccatcattcctctttctgtcattaaaattatagaattgaaaaccatcatttaaactcatgggtttacagataatacttaggcagctaagagtatctgtcaacaaataaatttcactgggcagttagagtctatggtgttgatttatcattttggaataaagctgcggttttcttttataggtaccacaggtaattccctggagggagcatacttttggagagtgggggctgtagaggtggcatagtagtactgactttacacttcactttctttggcctggctttcaaggtgaacctcattgaggttggtggagagtgaagggagaaaaggtttatcagtcagggttcaattgcagacaatagaattcatttagcttgtttaaacacaagtggattactctaggtaattaattccttacaaaacataaagtctgcagagaaatgtcctaaggctatgcctgcaagaataacatacagaataatatcacagcacttgcccaccaagagaactgcttcttctgttagaatccaaagtaactctccctaccaaggtccaagaaaaatgtaccttagttataatcaaaggattaagaagcctgccctaaaactgttggatctgtttcttgactatgtatactgtgatttgcaccaacaaaaactgatgctttacaaagcacatctcttcccacttaatctggttctgaattcttcatgatataacccaaactctgtctgcaagcttagagcaagggagtctggtaaacatagattttagctttctggcccctgaattgaaagaagactttctagtcaaaagtggaatgagatgatgagtgtccaggaaactgtatcctgtggtcatatggggcaatcatatggagaactttcctatccatctacccccataacccatttgatcttaccatctttgtacaaaagtcaaaatatctaatttgctactcaagacatatgtctggaagctgccagtatgttaacaattatatcctatcatttccctgctgtttgtggagaagaacactctgttttcagaagattctcagaccttttttattttaacttttgaattctccatcttctcccttttttttttttccaacacgaaggttcaatttttttttctttttcttattttttccgtaccaggaacattcagttccaagaaacccaggtagtgttattataggataactttgtgttttattcttcattgctatttcaattaggaaaaaaaatctggtagaaatataatatgtataggaaactttacaatggctgagtaaaatttaataatgtgtgctcactttaccaagagttacagcagccttccattttcacttgttcttggagaaaggtttcctgatctacctaaattaaagctactggagtcaatgtctcttaacatcaaagtgagattgagcacaggctctggactcagatggtgtaggacttccatcctagcttgttcatgtactactttgggatctgagaaaatcattttcctttctgatgcatcagattcctcatctgtaaatttaggatctagtacttagttaatgtgactcttaggagggttaaatgagatgcattaataaataatttggccgaataagtctttaataaatatgtgtgactttcagtagaaaaacagtcaatacagatgcttgttggaaccctggaagcactatttactaattgtgcagtagtaggaaagttagttaatatttttgaatctcaatttagtcatctgcaaattgaagactacaatatatttactgctggggtttacatgaagacgattattgaaaaatccccagtagaaaatcgagcacaaaattagtttacatttcttatctttttaagctttattcaaaatccaaagaaggtaaatataaatccttgcaatatttaaccctacattaatctagtgggttgaaatatttcaaatgtgtgtaggaatagtgtactgttaatgctctctgattcattggtcctaaattgggctacttacatgaacatttaaaatggtcctctttaatgtatattgtttcttatgcctcagtttagtttcgcatatcttattgatagctttcaatcacctggatgttgaatggagtttaaattgtaaactgacagatgtaaaggtcatttacatctccaagtgttgcaaggtacccatataatgtgttgttgttcttgttcctatttttctaaaagtcgttcaaatattatagtggcaaaatatgaggtaaaaatttgtccataagattgaaaatgtaccgataggaattggagatgttaattttctctttccagtttcagatgcctggaaaaatgcagaggggcagatgtttcactctataatattccttaagccattttaatttaacttgttttgggggggattttagatgaattattagaaaacactgttagaattgcactgtattatgtatttggtatagtttggctaaatttacctgctagaatacttgaatactgtaattacaaacatctctgtcaaacctatatgccttggaagcatcccatttttctataattgtgctgttgtataattttgttggtgtttaatcccttaaatagcaggagttcatttggttaccttatgaatagatgtaaatatgactgtagtagagcacactggaacagagcaatttatttttattacatttctaatactctgcagtgtttgcaatactgttaatttagattatattctattataaaaaatcattaaaggaatttctgcttcattttcaacaagattgagaataatggtgaaagaaattcccataagaaacttttaaggaaagatggaaatgctcttccacagcaacacttaaaaaaaatcttccatttgtaaaatttgtgataaatcaatattgattattaagtgtaaaagtgccaaatttacatcagggaaaccttttgaagctatgggaaaaacattacagccaactggaatatcctcctgtatttattaactctcattacaaaaaagggcttggaatatatggtatgtcattatagcatctttacctacataaaaatgacatactgatgattcagctgtgatttcctgttttaggccattaaaggcccagtttaattttttttttaatgaatagtttattttttctctcatgagctgctactcaatatttttttttagatttttaaaatatagcatttctaatgaatgcagttttctttatttctttagttacttttagttgtttcttcaagggcattacttttattattttgcatttgattaacagatcttttatttatagggccttcacattttaaaaatgtatttgtgtatttttattaagtaattttttattaaaaattgtttgcctgctaattctgaatttagaaataataactaaagataagcatcaattctgtctcacagaaaaacagtctagtgatagagattattgagatggtatagtggcttcatggtgtcatcagggacccattcttagcacatgacttctctcttgaggtaggcccacaatttaaattggatcctggattcccagctatcacacttgaatttcagagaataaggaagaaaagctagaaagataagctccttttaaggagctttttcagaattcccacatgacacttctgcttatgcggtatactatatatgtgtaaaaaaagaaaatagttaatttagcaagcttgaaaataccatacctgtttgccaggttagcctttggctggcatctctgaatctggacttcaagaaatgtcccaccattctccagctgataagagtggctcactatgtctatttctttctctttttttgcaaacaatatagtttatgctggaaatttgctttaattttgggagactggaattttgatatattgggcagagggtgcctaagtggccagcccccagcaaaaatcttgggcactgagtttctaatgaacttccctgctagacagcatttcacaagagttgtcataattcaacattaaacatatcctgtgtgactccatagggagaggactcaggagcttgtatccttttttcaccaaactttgcccaatgcaccttttccttttactgattgtgctttgccttctttcattataatatgtcatagtcatgaatattactatacatatgcttcttgacttacaatgaggttacattccaataaacccattgtaagcagaaaaaaatgcattaatttacctaacctactgaacatcgtagcttagcttagcctaccttaatgtgctagctaaagatgctcagaacagttacattattatacaactgggcaaaatcatctaacacaaagcctattttataataaagtgttgagtatctactgtaatttattgaaaagatcaaaatttgaagtatagtttctactgaatgtgtattgttttcacaccatcataaagtcaaaaatcaagtagaaaaatcattaagtcaaacaaatcgtaagtgaaacaatcagtcagagactgtataatgagttccacaaagtcctctgtgaatcattgaaccttgatggggtcttggggatccctgacaaacaggaaatttagtaaatgactattttactacttttcaagttatgaaacatgttttaaagtctatcacagatccagtatttttttttataactaagataaatactagtatgttgtgtttttattaacattctcttttcatcaaggtggactgtaaagttttggtttaaataactggaaggatggagttaccagtaatcgagatgggaaagactgggagagttggtttggaggggagatcaagagttcattttggatgtgttatgttggcgatggagagcaggcacttggtggctaaaagtctgggattcaagggaaaggcctgaactacaaatactaatttaggagccatcattacataaatggtatttaaagtactccatgaagtgactgaggaagtgaatgtacaaagaaaatgatgaggctttaaggcagtcaactgttcagaagtcaaggagataagtaaaaaccaccaaaatagactaaactcattctactttgggtgcattgtggagtgagattttgtctaattcataattgtattctcagcagaattatattgccaggaaacaattcaagcaacaatgatttttttttttaatcattactgtgtctcaggctcagttatttgggctggagataccaagtttacgaatagtccttgccttaatgaacttaccattggttaaggcaaaattattatattttaagactgattctttagaaatggagcttgagatgaggattcatgtgcaagtgatttattaaggaaatgcccttagaagaaactgataatggagcaagaaagcaggagaggaaagggaggaagctgagccaggatgtggtttcacgaggttagcgtcagcctgacactgcaaataaattggggtgtaaattatgctgcagaatctatcccatctagaggcacgggagcagggctttcatatcccacaataatcattcatcggctaagagtcacaggggtagggaataaactcccaagatttcccaggctttccctctgagtgcaagtaactctgaatccctagtaccttatttcatgagaaacaaaaagtcctagtgaggtaacatataggaagggtaaagggctctaagggaatcagacagaacacctattatctcctacaacatatacacagctgatttctaaagcatgtgataagaactctcacagagggaatttcagactgccatggaaacaaagggggcaggacataatagagctttatgagagagggaaagctttctaaaaaaatgatatctggaggaccggagggtgttaactagatactaaatgaaggaaaaagggagaactttcaagtcagaaaggatcccagtatataatagcacatagtctcacggtcatggaaggactggagctgtaaaatggggaggaaaatttttcttaccttctaagcttgttgtggcattaaaatcagaggatggaacaataacattttgtaaacttttaaagagaccgaattctgataatggtggttttggggcccaagagtaatgtcttggcagtgcgacaaaatcaaacttctctatgatgattgcattcatttccagcattttatatttataagcatttgcaccaagatgtaccctcctgtcacctctagtgtgaaatagtgccagcaggccctatcgtagtgctccacatgcatataggaagtctgatgctgtttaagagaagtactaagtttatctgttttctccgattgtttattcacagaggtgaataaattcctcaaaggttaaattcaaagaaaagacaaagggaaaaaaggatcggaaaacctattgctatctgctttaaggcccatctagtgttcagaaatattatgtcctcgccccgctattttacctgtttcttacttgtctaccgtgatgagtccctcttcatcattctgttttccgcatagtgagtagacctactttgtgaatcccttgttcttcagactcctcccatttatttatttatttatttatttatttatttatttatttatttatggtgagacagtgtctcactctgttgcccaggctggagtggtgccatcataactcactgcagctaggaaatttttttatttttattttttgtagagataggggtctccctatgttgcccagactggtctcaaactcctggcttcaatccatccttctgcctcggcctccccaagggctggagttaacaggcgtgagccactgctcccggccaggctccctttttctattactgccatgagcttcttatctgcatatatcttgcagaaatattttaaattgcatcttagtagtagtagtggtggtggtaatagtaatagtaatcatggtccctaatattctggatatactagaaaaatgggttcttatgcattgagtagagaaatggtttttttttatttattattattacactttaagttttagggtacatgtgcacaatgtgctggttagttacatatgtatacatgtgccatgctggtgcgctgcacccattaactcgtcatttagcattaggtatatctcctaatgctatccctccccactccccccaccccacaacagtccccagagtgtgatgttccccttcctgtgtccacgtgttctcattgttcaattcccacctatgagtgagaacatgcggtgtttggttttttgtccttggcgatagtttactgagaatgatgatttccaatttcatccatgtccctacaaaggacatgaactcatccttttttatggctgcatagtattccgtggtgtctatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtagtgggatggctgggtcaaatggtatttctagttctagatccctgaggatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcagagaaatgttaaggttaaaattttgttgctttgttagaaaattgtggttctttttttataaaaacagattcagaaataagtgtgacatattgctataattattgtagactgatacaatttattaaaaattgaacctgtatgctctagagttctgtgccattcagaattccacttattctaataagtaattcaaagagaacctatttcctctgtaattttccctgatatcagtgcaggacaaaaggataatttttattttgaaaactctaataaactctgcctattaataattacgtaccattgatagttcttaatattcttgcaggctggcactctgtaacctttttaggtttagttcccaaggctctggtggcagatcatcccaataattatagcagatcaggtgatgtttatgtaatttttttctcaaggattcttttaatgctaaaggatcttccttcagagtacaaataatgctgggacaatgctcacattgacatgagtacatctggctgaactccttggcaaacaatagaaaggagcttcagtgtacaaatcctcattcactagacattaattaaatggggcaacctagaagtctcaggtcaaagtatttattgagtttgttgcatctacacaatatactttttggattcagccaagtctatctatgcttcaggtttttaatattttcctaagattatctcagtcaatacagatttaatttaaggctatgtaaaagcaatgatgtttcaggaaatatctatatctatatctatatctatatctatatctatatctatatcagactctattgggaattgaataggcctgaaataagagaatctccatgttgtttcttcagattaggaagagagttaccaagaaaagtatttcctaaactctagtatcattctttttctgttaatgttatttttacagaaatgagtttaatgttaaattgtaagaggatttaaacacaaatgtaataatatagctgatatggtttgtctgtgtccccactcaaatctcatcttgaattgtagctcccacaatccccgtgtgtggtagaagggatccagtgagagataattgaatcatgggggtggttacccccatgctgttctcatgatagtgaatcctcataagatctgattgttttttaaggggcttttccagctttgcttggcacttctctctcctgccgccatgtgaaaaaggatgtttttgcttccccttcccccatgattgtaattttcttgaggcttcctcagccatgtagaactgtgagtcagttaaacctgtttcctttataaattacctagtcttgggtatttcttcatagcagcatgagaacggactaatacaatagcatatctgaaatctggatgtattttattcacattgtgaaaccaggggttgtccgaaacatccactcttctgtttttccagagttaagtaactatcaaattttagctgggggataggaagaaggtgctattcagagtaaagagtatatttcctagcctttcttgtaactaaggaagaataaccatatcatataagcagtgtcatgaggcagcttctagaaccttctgtaaaaaacaagtagcagctgctttttgcctgttcctctctcctaaacaatcttaagcagtagtttacgatacagcccaaaccaacattaaattaaaataaatgctgatgagtactgaattaagttaaaataaattcagatgagttttttattcattcattcattcattccttaatatgtagagggtacttaaggtttatattttcctgtgtgtattcttttcactgttgatatggtttggttgtgttcccacccaccttaacttgaattttatctaccggaattcccacatgttctaggagggacccaggggaaggtaatttaaacatgggatccgatctttcccatgttattcttgtggtagtgaataagtctcacaagatctgacgggtttatcaggtgtttccgcttttgcttctttctcattttctcttgccaccaccatgtaagaagtgccttttacctcctgccatgattctgaggccttgccagccatttggaacagtaagtccaattaaaactctttttcttcccagtctcaggtatgtctttacaggcagcgtgaaaacagactcgtacaactgtattcatggattttagtatgaaatggttttctattcatcggcttctggatacttagcaattttccttttaattttctctttgaacaataacaatgtgaataaaggtttccatgtattagtcatcttttgataatttatttatagctgtattgaactaagtttcaatagcatgcctgtcctacctctaatttttgattagtgaaggtttactttgctatcaactacatgatcaatttttgtaaatatttaatggacataagaaaaaaattaccttgtggatagatgactttctgtatatttattagtcttatatgtttattgtatttttttagtttgtcctgtatttcctcttaacttaaaaagttgcactatcaagaactgcctgaatctcagaaagctgtattgtaactttctactgcaattgcgtgtttgtcaaattcttccctttttaattttgtttgctttttgtctttagtggctctgtactttactgaataccaatcacaagtaatatatttatgcttttgacttttaatattacaaaaagtgatgtctttctctccctgttagtttttaactgcaaatttattattaatttaatcttattatatataaatattatcactcctaattggttgattgattttagtttacataattccattacaactttatccatgccttcttttcccatcttggcttccaattttctattgttccaatcatttatttttattagatgttaactgtacgcaagcttgttttaacttttaaattcagtctagtaggctcttttagtggataaattcaatctattcacatctagtctatgactgatataagtgttgtatcttactgtatagtggtctattgcatagaatggtgactctagttaataataatgtactgttaactggtttcaaaattaataaaagagtaggttttaaatgtttcaccacaaaaaaaattcgaggagatgaaattgtcaatgggcttgatttaatcattccacaatgtaaacttatattaaaacatcacatcgtaccccaaatatatatacacacatatatatatttgccaattaaaaataaaataaaaattaaatgtatatttattttaaattatacatttttcttttacctttgccctatttttctcatcattttaccaagtttctattttttccactcacttcccgtaatctcttttttttttttttttgagatagagtctcgctctgtcaccccgcctggagtgcagtggtgcaaactctgctcactgcaagctctgcctcctgggttcacgccattctcctgtctcagcctcccaaatagctgggactataggcgcctgccaccactcccggctaattttttgtatttttagtagagacagggtttcaccatgttagccaggatggtctcgatctcctgacctcgtgatccgcctgcctcggcctcccaaagtgccgggattacaggcgtgagccaccgtgcccggccctctttatctcatttttccttccattaatgaaactgatttttttgtgatactttaattgacatttatgctttttaaaatgtataaacaagatctgtttcacccacagggacacattttcccctttcaactatcccaaggtttaagattccagagtaacttttttctctcctttcctttccttccatccctacaatgttacctctgctttgcattacattcccacccaaacttctaggttttgctaggttattacaaatcttcttattctatgtccttttggttttaaaaaactttatttagtatttaaattgtatactaacccaaggaaatcctccttattcattaaatgaatatctattaactgcccaccacaatatgcttttctatatcttctcacaatcccagacctcagatacaattcgttagttgggagttagagtattatttcaaatattttcatcatggggggctatttgaaccctgaggttaatgaatgtttgcatatcactgaatatttttatttcacacaaatgagctcttgaatggatatgggatattgggagatagccctttccctcacctttttcagtaaatgtggatgttattccactgtttttgagctttccgtgttggagatgagaatgctgaagacaaactgacctccataccactccaggaaaatcaattagaattgagtttggctatcagtcacagaaaaatctgaataacaagtaaacaaaaattttatttttccccatatagaagtccagggctataaatagtttaggttaggtaggtataactccatggtgtcaggatttcagatttcttctattttactacttctctgtgcttgatttttgtttcaaatcggcccactgttcaaatggaagctaccaaaactgtgcaaaacatgaagtgctgcttccctgtaaggacatttctgcttgaaacagcaagaatgtggctaaatggatggctgggaaatgtctttatcctgggcagccatgtggcgattaataatttggggtttaagaagaaggaaagacaacattagggagtgactgggctctgtgacattacaagtttgtccctttttcctggaagcctgaacaattttctttgtagactttgaggtcacaacttttatcggagtatgtatggaggtttcttttctcatcagttaggcatgtgacttggtaaactcttccaatgtgtaaatttatgtctttctaccactcagaaatattttatttcagtatttatttcttaaaagtagagaataaaaagggaggaaaaattttctaagtgattatttgcatttctttctacttctattttctacttttctatttcctatgtttcatttgagaattgtttcatttttaaaacttctttacaataaacaatatttgcttctggtaaagtaaattaagtataaataagaatttaaaataaaacttaagaaaataacatatttcactatcctctttttactcccagtcccatttacagagttttgtatgtttccttgtgtaattttaataaacatttagtaatatgtacacacatgaatacacacatatgctatttttacacagacgagactattctcttgtttcttgctttttgtcttttttaacttaataatacattttgtattttattttttctaatgactgtattcagttcaattttagagtcaatttataaccacctatcgtttagcatttatatcatttccaatgttacagttttatacatacagtaggctaatttctatgcattattttgcaaatatgttagtaaggtaaattttaaccagataattgctaagtgaaagtgttagtatgcttccatttttgacataatttacaaatttctccttttcttcttatgggtatgtcagtaatacatttataaactactggaaatcagaaattatgccatttgcatctttgtgtattccatatatatagaagatttggaataaatattgatatttctttttgtgatttacagatttttaaaattcatctcttaataacatttttattccattcacaattaagggcaaacgtggttatatttatagatattttaattatgtggataacttttaaagatactttttatgccattagctcatacattttaattaacttcatatgaaaataggtatatataatggcaatattataggatttctgttttgatgattcagtatttagtttcattttccatgtcacagcatatgtgtttgaacagaggatttctatcagctgtttctcaaccttaaaaacaaactaaaatatatagcagggcacaaagggaaataaaatcaaattatttttactttctattttgtatcactttacagtatgagtatgtggcttttattcaggttttatacactaaaatacacaaaagttgagttgaataccagtcattattgccagcaaaaacgaagtctgttgtagacagctgtgtttaaaataatggtattgtttataatgaaatgttttagatattcaaaatgttttggcagtttagtagaaatgttctccttgaaaagtttacattattttttaaaataattattgatgtaaagtgaatactgatgatcaaaatagacaaatcatttgtgggcttattaagcaaagccatcaaaggaaaacaaactcttaaacaaccaggtgtttaaaattatacataatctcaataagccattatggtattatgtctaaactattcaaatcaaatagaaaatttcaaataaaagaatgaggcatgtccaaaaataaaatgagaacctacttggacaaaataagtaaaattatctcacaaggtttggaaaatatgaaaaacagatataaatgtccaacaaaaagaaaagttaatctatattttcaatgtactactgatatttaactccctttatgttatagtttatattgccctccacactgactaggcaattgatgaattctatgcaattgaattcaaattacacacactgtacaatgatgacattacattaaaaattttttaattcaatcgtgtctgtaaacattaattttttcttcaataatttgatgggagaggcaatgtagcagctctaaatgcaaactcttcaaatgagtgattgctatttgatttctctgtgggaaaaccaacctaaagtaacaatctttgttgatgcttgctcagatcaggtggaccaaaacagcaggaagtgcctctgacagattccaagactcaagtgtcttcaatgagactttgaggattacaaatattcagcgacaccaaggaggccggtattactgtaaagcagagaatggcttggggtctccagcgataaagtcaatcagagtggatgtatactgtaagtaaattttccagaaaactataattaagcctattatggatttcttttgtcttacaagtctatggttttctgaaaaaccatagcgttctgtttagctgagaatgaaaactgtgtaaaataatgatagctcccttaaaacgttcctgaagaaaggaatcttcactagaaactttcataacttctatgatataatacatattcattatggaacacttaggaacaatattaacaagaagacagtaaccattggtaatcccactaataactagggttttaatgcacacattttttatctttatatataaagatatacatgcatttttatatttttattaaaataggatcatgctgtatattctttaacttatgtttattttttttacctacatgtgaatacagctattcttgtttatttttaaatgtacatcatacaaacagagcattatgaattggcctgtaaatgaccaaaaatctctacgtatagtctgcttttggtccaattctgttaaaagtaatcagcaccaaccctggacaatgctgtgccacctgaaaagtgtttgttgatttatttttgttcttagtctcattttcctacattttgctcttgatgataatattttaaatctttttggtctccttacttaattccccaccgaaacaaagcaagggcctacatttaatttggtcttttgcccaggtttttctatcacttcattatgtttttacaagaatttgcattttaatttttaggtctctgatgtaagataattatttttcttttcttaaagtaatttagacataagcaacaactgagagatgttgtttttctgcctatcttcctttctttcccctttcttttctttcattgcaggataggatgttacctagttagcaaggggcttgaaattatacatggtctacttgtcagatgctctgctgaatctcatttagttatttagatgactgagaagtgggtgataaagcagcacttgtaatttgctttccacactcagatacctgctttccttctggaaaggatgggggagaaatccttgtttcatcctctccagtatcttctatttcctgaggccccctgcccctcatcccttagcataattcagaaacattcatcccctgtaccaccctttccttattattatgggtgcacaggttgaccacacctgtatacttcccaaaataatatagcccctggcttccattttcctgactaaatattttcagtatttttgttcatatacaattttaaattaggttaagtttaatttacatgaattgaatactttttgtaatataatagtgtagagtacatccttctgctgttttagttattgtagtttaggtcatgaaattttaaaatacacctcttcaataccttaaacacaattgtaaaatctaaaaacttctgaaaatcagtgggtatgttttgtttgtaacttttataagcaaaacttgatgttaactagtgtggtgtcaaaatttgacctgaaatgacttgaatagaaaaatagaaaaaagctttacactctttatttaccagactttgaataatcacgttttgcccaggaaatgtgtttgattatacaatatagccaaatatccagctaagtttgttatgtaatagatggcatgtatactatataacctttctaaaatctgaaaatttctgaaacacatactccaaaggttttgaatatggaatttttgacttgcatttctgcaacaataggtctgataatttaaaaatcttattgctgggttaacaagttaaatataaagcgggaaattcacatttttagagacttaaaaaatatttttctcttttccttttactagaaagcctttttcattgctagtctgcagtatcccttctcctttctacctgctcatatctcttgctgtgcagactgggttgtgcctgagtatctcattcatatcacacaccttactggaaataatagcactgttatctccagatttcccaaaccctgctagccttctaaagtttgactcctcttccattcaaccacgcctgaagacatttattttgttacctttctcttctttgacttcctttggggttttctcatgcaacctcgacttgacaagcatctcgttctatgttatttcaatgaaacatcactgtgatgcataccatgttgaagtactattttcagtacttgtttggtggctaggctttattaacaagctgtctacaattataccatttgagaaaataacatgatgttaagttctatactctataaataaacatgacatctctctaatataaatttcccagagaatgccttacctttagcaccaatgatctttctactatgcggatgtaaacatatatttaaagtagttattcctatttttgatggcttgaataaattaattccttcagatagtaaattttcaaacatcctttgagtgataagaacacttaacaatagagaccactagacctatctaaggagtccatgtgctccaaatacaaccttgattgaagaccagagtttttaggttcaagtacattttctctacctgagtttctataatttaaaacatgctttatcattgttgataaagacatgactagtgtattcatgttatgtttaaatatggcaatgctggtgtctaaaattgaattataatccttaagatttatttgtgctctaattttgattgaatgttggacagcttagttgaatagatattcatttatataaactataagcaagtgaatgagttaatttatttcaggtacttttgctttaactattttaggaaatgctaaaaaaaaaggactgtttttatctgaaatcatgcctttaaaatcatccactgcattgtaggtttctgtttctttttctaaactgatttcacatgtggaactttcatcaatatcagtacaacttggaagcaggatatgcataaaaacaaaatacactcatgcaaaatcagcagtaaaaactatttttacaacaccaagctgaggcagactatgacttggtttaacaaaaagaataattaatgatgttagaatttattcttgaatcccttgtaaaagattgtctctaaaatctgccccataatctattgatgtataataacacataatgtatatattaatgtaatgcatcagtagtcttagagagcttttataatagtgaaaatgggtacctctcagcaaatcccacgttctacaagtttctacctttagagctaaaaccttcctaaaataaaattatgtgctaacattattttgatgaggaaatgtagtttcacgaaaggaatttgacacaatggtgaataatgtaagatgagatgactttctttagatattttgaaatctttgtaatatctatattaacattttgatcactttgagaaagtttatgtatctttattggcgactttttcccacataattttctaaaatttagtagaaaatattaaggtatatagattttataaaggaactaccacatgcatttttttactatgttaatcaagaatacagtttgaaaaattattataatcatgttcctcaatttataggacctataattttatcatttaagaattgtaaaagcattccaagagttttaggaaacataatttattgataaaatatgtttataggctggtagattttataaccacacagtgacttgaatttcccgaatctgatttggttatttatgcaaatatttctgatcaaaagctaaccaattacaatttttgttgttgttgttgttggggtaaatcgcttctgagtgtcttctgagtggctgaacatagtttcccccatgcccacacaaatctcatctcgaattataatcaccataatctccacgtgtcaagggagagaccaggtggaggtaattgaatcatgcaggtggtctcttccatgcagttctcgtgatagtgagtttttatgagatctgatggttttatgagggactctttacccccctcttcgctcggtacttttccttgtgaagaagctggctactactcgccaaaaaggtactctttccattctgtgctcagcacggccgacttgcgaagaaggtgccttgctttctctttgccttccgctgtgattgtaagtttactgaggtcgccccaaccatgctgaactgtgagtcaattaaacctctttctttcatgaattacccagtcttgggcagttatagtggtatgaaaatggactaatagtattctcagaaaaaaaaggaaaatactgtattcatgaaacaagaacaggaaaacacaaacaagggactttcagagaatataaaatagctcttacatattaaaagtgataacataaaaatcagcagaagggctggaaaacagtaaaacaaaattttacaatcaagtagatactacgtaagaagataagaaaattagagtatttatctagcagatcaaacatttgaataataagagttccaaacagtcaaaatgacgttttttttaaattaagaatttcctatcatagttggacatgtgttcttaattataaagctaccactggatccttaacacaatgaaataaatcttcaatgcacatatcagcatgcaacttcaaaacattaggaaaaaaacgaagctctttaaaatgtccaaacagtttttattttttccaaaatgctcacatgtaaaaaattaggaatcaaaatggcacaggtccgcacaatggaaatctggggctagaaggcaactgagtaaagcttttgaaattctgaaggaaaattatttcaactagaatcttctgtatggccaggctattttttcaaatatcaaagaagaagaaagacatttttagacctataagatttcagttttttttggctaatgcacccttgctgaggatactacttttatctattttcctccaaaactaagaagtaaacaaaaaaggaagaaatatcatccccaaaataagaggctatgtataggaagatattgaagttaatctcagaatgataaggaaacagggcagcacgacaatagaagcttgtcatacattgagcttcagaagcaaccgggacagattgaagctggaataatggatgcttacctgatattttagagacaaattctcatggaaatcttaataatatggtaatgataggtggatacaaaattgagtatacaaaatacgtgagttattaagggaatgtaaaaagctatatgaaatgaaatgtaatccaaatacactacaaggttccgcggtaaagatcgcttgcatagtcataatagcaacacttgatttaaccaaaagcacgctataaatatatagtggatgagaggaggttagtataagagttaaatgcttcctttctgtaagaagaaatcagtaagacaatgtgaaaatgaaaaataagtctataaacagaagttgaacacttaaaaatatgaaggcaaaagcatttataaatagttaagaggagatgcattagaaaaggttgcctctgggtattggaaatacctagggttgtttgatgtatcattatttggcttttaaaactgcacttgcatagtttgatttttaaaaaattaataaagtacagatgtgaagatttttaccttggaggttcttgttactaagctccatgaagtcaaaaccaatttcattccaaattttagcagatcattattaattcagaaacttaaaactaggtttatactcacactttatttattcataagaattggcattcctttatattcgacaccaaataaagttgactaaaaacatattatctcctatataaaagataggcaaatagcataaggaatgttggtactacattctgataactaatttttcttctaaactttttagaataaaactctttaggttaatttccactacaattttcttacatgttgtttagaataaaatattttaaaaaataactttgacttttacgtcattcattgagtgtctattcaaaatatagctccactgaattttgtgggctaaaaaggaacttattaaataatttataccttcaatgggtttaaactacttaagaagacaaagtgacaatttaattcatttaaatggtttacaaatgttaagtaataaggttaataacataaattatgccacacaacagtgaatgatatgctaatgaccctgaaaatatagtgctggaagtaaaagtttattgtggcctcttatgaaagaagtaggatttacattgcaattttaaggatgggttttgaaagaattctccctggcagttctacactttttttggcagcttgggttcggaactccttttttcaagagtgtttgtgtaacaaacagccttggacaatagagatagtgtctgcctttagggaagagggcagatttgtttcctgaccaggatagtaaagataatatctacctcaggggcaaagattaatcaggctttcttgcaggacctttataagatggggagcttcctgagctcagggtctcttagctgtgtcaaaaaccaatggtgtgcctggcattcacctgggctgcccaacacattgttcctatgaaaattaaggcgggaaaacctatgaagacaggaagcacatacttttgaggcttcagtaatgaggtcttttctctcagacccaggagtcttgtgtttttggttagcatccatgaaactgtggcagactaacatattagcaagtagggaaaatatcagacccctcaccattcttaacagagtagtagggaaggccaaaggtatcttttaatgggtgagaaatttgattaaaggcacgaaataagggagaataatcccacagagtttagggactagtggttacgatggtgggtttgggggagaaatgagagcttaaattgaaagatagactgttaattatgtcataattatgttgaacttttactgccaatgtttttaccatatgaatgatgatctgccatttatgtaagatgcaaaataaataaattgtaactttctttttttatgttttattttttttagagacagggtttgctgtgttacctaggctccagtgcagcagtacaatcatagctcactgtaaccttggactcctgggctcaagggatcctccccctcaggctcctgaatagctaggactacaggcatgcatagtggggtcttgctttgttgctcaagctggtctcaaatgcctggcctcaagcagtcctctagcctcagcctcccaaagtgttgggattacaggcgtgagccacttgtgcccagcccctgcaattgtaattttataactgcagaactactgatgagggtcagcattctaataccgatactgtttcatttgtcctaagaagcaatggccacttattgagaaccctaaaatctatctttggaggaagaaagagtatatcctaggtaggaaaaaaaacggtttcatagaattttgatgtgcttattcccaaatatatttgttaccttaagattcttgaggacatttaaacaattttctaagagtgtgttcatctaattttttcacttattcttagccatgactgtgtggttcatagggtaatagaggccatatgactttaaaggttagggtttgattaaaacttgtttttaattcaaaaagaaattagactgagaggcattagcttaataagtttttatgtgtacagacactgttcacacatgagacaaatcttttccaatatccattaaacatgttgtaagcattcttatttctgaagcttatcccctactttcatgtcacttaggtagattgctgcatttcattatgttcagaacaagcagtgatatttttggtccttgtctgatagatttattacattttcaactgggagattagtataacatattatcagtttattttacaagtacaatttacctgtgttagaaagaattataaaccaaacagcaaaatattattgacaatgagtttatttttattggaaccatcaacttgatttttagacagaaaagtttaggaaaagggctagaatgactaatgggaattctggaaacgtgacaaaccctggaaagaaaacaatcctttatgtaaatcctattaagcaaaattttctcacccaccacccatcctcccaaaacatcagccttgggtttggaaggtcttaataatgtttgatgtggcaattacaatgcttattaaaatgagttgctgtcatgcaaattgccctattaataaaatttgagacaggattttgcaattttctgaattataccgatgaagagtacttgcttatcagtgttatttacaagtgggacatacaaccaatctaatttccaaatagtattagagttcctaataaaagagctttgtcaaaaatcctattacatacctgtttactgattcgtgttcagaagacattagagaagaattacttttaaatcagtttagtcctatctcaattattatccattcagtactggtcaaatgcaccctcttaagatgcattcacagagcacctactggagtcttccagaatctcacaaatacatcatcagaatggcaactgtcagctttccctcagttgctctgcacctgttcctactgcctttaggtccctcattcaacctgattctgaaaatctcaggcattctataagccttctgagctggagggctgggaaggccacttcaattagtctgtcagtttgcaatgttaactgatgacctacaatatgaaaaccactctactcgaactactggtgagagataaaacaaaaatacaaggcttttgccctgtagaaccttataattggagacatgaaaaatagacctaaaagtattttggttaaaaattagatgagtaaatctaaaaaatttgtttacatatcaaaagtactaagggaaaagtgatgcatgacattcattagccctctcactaaatatgttaaggaatttaaaaaaaaaggatataatcattacatcagtgtgcatttaatttctaggttgttactcttataaaaactatccattcccgagcaaacgtattctcaggaatacatttgtaatgaaagcttgtagtgtttttcataaagatagaaggctattcgaatgtgtgcctgtgtttatacttttgctcttattgttaccaagagatcttttaaaatgttcacatctaaatttcataaagattctctttcatctaaaaattatttataaatttggtcatttaaaagaagtaaatctatggttaaactgaataaaaggcccttaagaacacagtccattgtctaggtgggattccctagccaaaggttatgtggcaggcagatgctcctgctgagtcagccagagaatggacattggcatccagggttctgatttccaggcggttcatggagccctctgaatctagctttctccctgagggcaaagtctgctaccgtcaactctgtattgcacagacatttcataaaaaaaaaaaaaaagagtttagagaaggaatataatttgtacaagtaaagtgagctaataaaatggtttgaatataaaaaagggaggatgtttaatgtgtttttttcccacgtattttaaagtccagcaaattctgagtcacacagaaggtaaagtaaaagtttgaaaggtaaattattgcttacttaattatttagcacttgaggccatactttctctgaatgtattcagaatacattatactatcaaatttaaatttataacagtttcaaggaaacctggctacctttgcttttgctgtttggtctataccgtgagtaaggtcaagtactttaaatatccattgttgactggcattataggataaggtggacggattctcagagagagtaaaaaagccatgagattcatacaaaataagaagctctttaaaattaaaatgatttctacctccaactttaagacaagagtttattttattttttccctttgacaattgaaggaaatgattcttgagaagggtgtcagagagtacatctgaccttgcttcaatacttgatattttcaaaaacttagctgttctctcttgatagagggaaaaatttaatacgtcttagcttctgaaacatactggtgtgattgatccatgaaatactgaagtatctgaaaagcagcctactttcaatctcttaaactgaaagtgaagtgaaaatttctgcaccctgctagagggcactgcagtgtttttattcatgatctcttgagtttgtcaccaggcttagaatataaaaatccctgtttcatgaggtaatgctgaggcagatatgcaatcaagacatccagatggctgtgaatgaagtaaatgaaagggtttgtttcaaacgttttcaggtgtccctccctaagcgctgtattctaaatgtagaagggaatatgtgaaaaaaagcttttagaaatattttccagttttcagaatgagctaaaatagagaaaggggaacaaattccattttttaatcccacttccactatcttattccagtctctcatcacttcacacctggttcctgcaaaaggcctcccagcagacctctccctcaataatagttctctccttaaatatattctgcagattattgccagatcaatcttccttaaattcaatgcttatcacagtacttgccgctaaaaatttacattctttctatgtttttgattactacaaatccaagcccctctgcttattttttctcctattctgttgaaattaaattcctcatcctcctaaagcaacatccttcgacctcacctccctgctccccatcctctatcatgcttcttgacccccatattcatagctatacattttgttctcccaaaggtcttgtaaactcctacagagtagaggtcaccttatgtcattatttactgtaactatgtccaaatgaacaactcagtgacaaacttagggtatgagaaacacgtgttgcttaattactcaagggcactggagacaaaatcaaagtgatgttatctcttttaaaatgtgcatttgaatttttatcttcatccttctttagacttgtggactttcatgatctctgacttctaagaaatggtctgtcagtcatctatctatcatctctccattttttaggacaaggtctcactctgttgcccaggctggagtacagtggtgcaataatagctctcactgcatcctcgaacttctgggctcaagtgatcctctcacctcagcctcctgagtagctaggactccaggtgcacactgccatggctggctaatttactagctttttgtagagactgagtcttgcatgttgcccagtttggtcttgaactcctggcctcaagcaatcctccagcttccacgtcctaatgtgctgggattacaggtgtgagccaccgcacccagccctacctatatacttattttattttatttttatatttgagacagagccagagtgcagtggagtgatcctaacttactgcaacctttaactcctgggctcaagcaatcttcccaccccagcctcttgagtagctgggactacaggcaggtgccaacatgccaggctatttttttttctttctgtacagacgaggtctcactctgttaaccaggctaatctcaaactcctggactcaagagattctgctgcctcagcctcccaaagtgctgggatcacaggcatgagccaccaggcctggcctctctatatgttttaaattaaagtctgtgataactcattctcaatgataacttactgcttaaacattgtgttcttataaatttcctcaaagcaagcattcaggcaaagacatgatggcatttgtccatatgtatattatgaaaaagagagcaagtaactaataatcttaatggcagttctctgaggggtcagtatgttttggttggaaaacccagtgttacaaattagctatcttctttcttttttctatgaacagcagtattttcaatgtgagactgagatctgcaaaacaatgtttttgaatagtgccctttgtgggagtaaaattctacttcatatggtacagtatatagtgaagcattcagtattcattcaacaaaccattatcaaatgacttctgtgtcgcagattttgtgtgactcagtgctgggaacacagtggtaaacagagacagcatggttatatcatcagggagagtagaatccagcatagcagagttaagataattgttgtagtagctgaaatgctaagctaagattagaagatcacggttccatttctccttgtgttagctctcagacttgcaaaattgtgaatttaacaaagagacttacttttctacatctaagcttgttttttcctttctaaatgaaaaaattggatgaaacatccttaatcatctgcaaaagttttagattatttatgaactttttttctattgaaaggatatttcacattaagcagaaatcatctagaatgaagatttttgagtgttttttgtagtatagaaggaaaaatagacctctaataaacatatatttactttctttttctaagaacagttctgaataattttaataatgtaccaataaacattttctgaatacccattaggcttggagatattaaaatgtataaagcatattatctacccaataataaattatagactctttgagaagtaagaatagacataagatcataagcacaaggaagagatgttacagaagctgaggggaataaatagtcgctaaagaccatcatgatcaaaggaagtgttgaagttgtcaagaaagagttgacttagcaagtctaggtgagagggagatatttttctgacagggagaatggggctacatatatatgcatacatatgcacatatatatacacatatgcacatatatatacacacaaacacacatatacacgtacagacagaaacgaactatatatgtatgttatgtatctgtatatatcatttgtcatttgaaaaaatttgctagtatatgtgtgaatgatgaaggggctgagagagagaaagcaatcaatagaagccctcttgtctacatttgtgacttaggccactccaatttaagtagattgttcaaatcttcatagcatgttgttggcaaaaataggaattagaaattaagtcttgtaactgtgtacccacaattggtacatagtaaaattgttttagaatatataatgttggtagtagaagaactcaacattagaaatagaaaactagcacattttcctttttagcatgtcatttagcaaataacatgttttattaataacatagtgaataacaagttcactatgagtctgaactgttgtaaactattgtcaacaagctaattcattcagtgagcacacctttttgaagttccactgttaacagaataatactaggaatgaagaaggtgttgcaaccgatgggaattagaggaatgagataatgtatttttaaaaacccatgaatatagtttctgtactctagcttagaagagaatgcaaagtatacctaaaatgaagtaactgattattatatactttttcagtaagtgcattaaccttttgacagagaagattttagtttttcacttctatttcaggatttcctttcccattgaatttgtgttttattttacttgaaagacatatatgcataaatcaacacattttctgcataactttataataaaatcattttactaaattgttgctgcttaattttctctccatggtaagtccatttccattcagctttgtctaccatatatcttctcttgtaagttaaacatgtagtgttgttctaagacaagaatggtaatattggtaatattgactgtaactgctggataaaacaaagtggaatgactccagtcttagtatgcataaaaaattaattagcaagcctttcaattaagattgtatagtcctttcaaaatgttcactgtgtatatgctcatttctaattctgtttgaatttttcatctttgtacttttctaaatattattatgtgccaactcaaatttttcttattgacacctgtcagatctcaccacctcttttaccttgcctaaagaccccaaagacatttatctgctctgttgcaattagagtgtatcctcaggaagtatttttagataagtttccttctcatagctctgaaaccatattgcgggttttaactctggttatatatcctaatctcttgtgatttaaaacatttgaagactcttggtctaagcccagatctcttgaatcaaaactaggtgtgtcattttaacactctgtcaaaagtcttcccctagggtttctgaaaattaccctggttcacaaagccttctgcctcctgagcttctacttctctttctctgtcactgtgcaatcttgcttgggccaatcataaagcatggtgccatttgttttcacaccaaaactccactaccaccaagcctccatgagcccagaagacttaactgaaaattgtccagatatgattgaggctcctagcaatacctaaagctctacctggacctgatggaatcattgatcctagtttcttgtgttccctcagtgtattcaaacattctctgtcttcctggcaccattcatccctgcatgcttctctttccttcttcctttcaggaccacaaaacaaatctctttccccatctgtcatcaactcccatgtcatgacaaatagcatcccccttctctaagccccgataggccctccctcctgaactcccagctttaccttcaccctgaacacctataaatgtatttttaaagagtgatctctttggggaaactagtgccaaatattagattaatgaaatgcttctaccttgttatagccaaataagaaatacctggattcctgttactgcagagtgcccaggtggtgttcgtgataggatctgtaattgcttttactcttcttctccttttttaatgtctaggtatatgttaagaccataaacacaaatcctttagcttcaaattgaacatgagaattggaaactctttttaggtatttaaaacaccaaactggagagaaaagttattttccagtatttcaaagatcttccttaacattgcatttagctatgtgttatataagttctatagcattaacatttgtcccacaagtatgtattcagtattatgtgctactaacttgggcattaaggtcattagagcaccattgtgagtacaaacatgagccaagctgctggcttctcatcctggatttacactgtcacttgtataaatttttataattcagatattttcactgtctgaacctcatgcacctaaatgctgctcatttgtaaaatggagacaataataacaattcctcccttataggattgctgtaaggataaaattagtcagggcctgtatagttattggttcaatggctgacacaaagtcagagctcaggaaggtcagctcttaattcctatcgacaaatggcatgctaggttataggagacaaaagctccaagaaggattgttgtctttgacagccattgtgaccttcacatgggttggtgcctgataaagggccctttttaaaaaaaaatcaggaagttaatggaaagcttccaagggtaggtattgttaagcaaatgtgttaatgagttaatctaattgcaagcatgcatctccaccttttactaggtttatagccttggacaatttccctggctctttatcaaaggcccatgatgatatctatacagttgtttttattatctaatcatcacaactacttttactaacattaatcaagtacttgctatttgcccccaaaagtgttaagcccattataaggattttaagttttacaactatagaaaggtttaaaatgatgaatgacatggtaagaactcaataaaggatgctaagaagaaaaagagtaagagtgaaaggaagaggcagtgggatatgtcatatttaatttgtttatatttaggtgtaaaagacttcatgtatattaaaattatatcactattaatactactggtactctactaacaataataaaataacatctcatagcatttaatatgtactgtacatgtgtcaagtgctttacatataggatttcacctaatacattaaataggtacaagtcccattttacagatgatgagtgggaagaaagataaatgatgtaaagcagagaggatatttgatggaattgagaatctggagggactggaataaaaactcagataactttaggaaaaactgtctttgtaatacaaaggtagacaagaaggaaatagaaaaacagataaagtaggctggcagtggctaggaagttgaaagagttcgtatgtgttgtccattttgagacactaaaatagaaagttattttggtgagaatgtgagcaacagttgggttagaggtctgaagagaattctacatatttgagacaagtattgtgaaacataggacatgccatttacttggaggagagaggcttgtgaaacagcactaaggtttcagtcaggttgatgagtaggtgcaccaggcaagacagagaaagaacaggagatgggaggccaaggtaaaagggagaacaatctgggtttataatttcagagctaggatgtctttgtgtgatcctaaggtctagataatacttttgtgagagtgttgccgaagtgaaatggaagtgactgtcctttcagtagagggtattagggaatatggagttagtgaggatggattgatgcggatattgaaatcacagcatttggtagcaggaatcatgtaagagagaggggttataaaccacgtgaaaaatgttcctcaagaagttgatggagcaggtaaactagcagctaatgcaataaaaatagaaaaagggctttcccaagctgctgccgaagatggcggaggtgcaggtcttggtgcttgatggtcgaggccatctcctgggccgcctggcggccattgtggctaaacaggtactgctgggcaggaaagtggtggtcgtatgctgcgaaggcatcaacatttctggcaatttctacagaaacaagttgaagttcggaccgagcgaggcttgctgccccacaagaccaagcgaggccaggccgctctggactgccttaaggtgtttgacggcatcccaccgccctatgacaagaaaaaatggatggtggctcctgctgccctgaaggtcgtgcgtttgaagcctgcaagaaagtttgcctaactggggcgcctggctcacgaggttggctggaagtagcaggcagtgacagccaccctgcaggagaagaggaaggagaaggccaagatccagtactggaagaagaaacagctcttgaggctacggaaacaggccgagaagaacgtggagaagaaaattgacaaatatacagaggtcttcaagactcacggactcctggtctgagcccaataaagactgttaactcctcaaaaaaaaaaaaaaagaaaagaaaaagaaaaaagaaaagaaaaatagaaaaagggaagtggttgcatatatgagtaattaaaaactaatgtcatatattgattatggcattaaactcttgattgcctccagtgaaacagatttattctataaaaagaatagttttagaaatatgatattcttttaaattgtttcgttcattctgttctgtcttcaataaatatttctaattattttagctctattgtatttgattacattttacttcagcaaaaaataaattaaaaatgccatatatggtggtgataattggtgatttttttgtgctaaggcttctccactattaggttctttcttcttcctttttcgttctttggtcatccttattactatatagaatatacatatgtaaacacatatatacaacatacaagtaaatatataaatatatataaagcatgtattctgttttctttttccattttttctctattaacagctctctttttgtttcagtctcctaattttctctttcatttacccttattcattgcatttggtttacatattatttctgggttcttatgtcatctgtattttatgttactgagatccatattatggttttatacttttaaatttacttaaggatgctttttactattggtcagccatttaagccaaaacttgcaatgaagtagaaatgtcatacattatgttgttctaaaacttctgactatcaaatccatctttatattctttgcaaattgatctgaattactattctgtaagctgaaaaaatagtggaggaagaaactgtccttgtttttcctgttcttcaattatgtaacaaatacctgtctgtttattattaatatttattccacataatgtatgattgtttttctttgagtatgatatcaatgtagtatcttattagtagacttcatcctgttatgttatttgtatgacctcagagcaacaatcactttgaaatgagtgagttggaagatgtttttctcaggtacactctagcactgacattttactacaatcttcatttctgataaaagtttatggttttgaagcaacaaattagtgaaaccaaaaaattagtagaaagtgaatattttaaaagctaattttattattctttcagagatgcttactttgtcataatgatttgttgaattaaagaaagtgtttctaggataaatagtcaaaattgttggaatgttgaattggaagatgggaagttacctagacatcaagttttatgtgtctttatttaaaaaatcagatgtgaaaatactatttcaaattatatatatgacatatatatgtatagagagagagagggagagggacagaggaggagatttattttaagaaattggctcccacaattgtgggagctgacaagtctgaaatttgtaaggcaggtcagtaggatggaaatttaggtaagaattaatgtttcagtcttgaatcctaacttcacaaagcagcaggatggaaacttaggcagagtttttatattgcaatcttggagagaattccttcttttctggaaacctcagtctctgttcttaaagttttcaactttaagcttgttcacattataaagaataatatgttttattcagcgtttattgattaagatattagtcacatctaaacaataacttccaagtactaatgtttgactaggcaaatgggcaccataacctaggcaagttgacacataaaattactcatcacatctctttcaattatttgagagtttattcttcatccaaatgtctaatcaattctcttttaaaataaaagacttataaaataaaagtctgaaaacattgctaaatgagtctggttgaaagctttaacagaatattcatagcatcattgcaatgttttcatcataattgtattcatttatagctagtactcatcctatcattttatcaatttttttttttgagacggagtctcgctctgtcgcccaggctggaatgcagtggcacaatccccgctcactgcaaactccacctcccgggttcacgccattctcctgcctcagcctcccgagtagctgggactacaggtgcctgccaccaagcccggttaattttttgtatttttagtagagacggggtttcactgtattagccatcatggtctcgatctcctgacctcgtgatctgcccgcctcagcctcccaaagtgctgggattacaggcgtgagccaccatgtccagccctcaatcattttttaaacaagttaaagtagatatcactagccaaagtttaagaagtaaagactaaccatttaatctattttaaacaaattgctgttttgaccagtttgttttgactaggtcacacaaaagtaattcaatgcaaatgtatgaagacaatacacttattgctcatatgcacagatctgtagctagagatataattacatggctatgaatattttttaagtaaaaaaaatacattttttacttaaacaggattgctgcaaaagtgcatatgaatggtatcattttgcaggaaatcaaggactgaatatgttaccataactccatagtgctaaaataatataagctttcttggctgttatggtcctttctgtttttgagacagagtctagctctgtcgcccaggcaggagtgcagtggtgcaatctcggctcactgcaacctctgcatcccaggttcacatgattctcctgcctcagcctcctgagtagctgggattgcaggtgcacaccaccatgcccagctaatttttgtatttttagtagagacggggtttcaccatgttcgtcaggctggtttcgaacccctgacctcgtgatccaccctccttggcctctcaaagtgctgagattacaggcgtaaaccaccaggcccagcctacagtacttttttctaatcttgttgtttcagattcaccaacaagaacatttctgacaaacatgcctgagggcagttgtcttagtcaatcaagttaccaaacaataccatagatgactgggcagcgtaaatatcaaacatttatttcgtgcagttctggagtctgggaaatccagatcagggtgctggaagatatggtatctagtgagccacggagcactttctgctttgcagatggctgtcttcttgctttgtcttcacatggtggagaacagagagtgacagcaagggtctatctcttaaaaggatgctaatccccttcatgaggcttccaccctcattacctaattgttgaccaagggctccacctccaggtaccatatcattcggggttgagatttcaacatataaattttgagggaacataaacattcagtcaatagcagcaatgaacctttataaatatgtattacgtattataaaaatagacacatgcacttttgtgttcatcatggaactattcacaatatcaaagacagggaatcaacctagatacccatcaatggtggactggataaggaaaatgtggtacatatacagcatggaatactatgcagtcatacaaaataatgaaatcatgtcctttggatcaacatgaatgcagctggaggccattatctgaagtgaactaacacaggaacagaaaaccaaatactgcatattttcccttataagtggcagctaaccactgaatacacatggacacaaagaagggaacaatagactggggactgcttgagggtagagagtggggaagagggtgtgcattgaaaggctacctattaggtattatgctcactaccttggtgataggcttattcgtataccaagcctcagcaacacataatttacccatgtaacaaacttacacatattcctttgaacctaaaattaataatgcctatgttgtaaatgatgatacatgaatcctaaattgagaatatacttttaaataatgaaaataatttttaacttcttaaaatgtgaagctcttataaagtagctttttagggttatgccactattcatctgtttatattataatgtagcttgtaagacctgatgttatataaagttagtgggcggtgttaaatcactgcaaaaagtatacgcttaggaagcagctagtacttaaaattctggctccaatgcttagaagttgtttaatcttacagtatttaaaacctctgcatctttctcttaaataataaatggaaataatgatttcttcatcccaggattcttgtcactgagaacctctttactattactactacagctacttatactctcctataatatgtttaatgtgaaccaattatttcacacaatgtgtttggtgctttacataaattttaccactcaagggaaaattatttagcttattttaaggtattctagttccattttccctgaaaacaagtaactaaaagcagaaaacactttttaaaaatgactgcaatattcttagaaattaagtagattacaaagtcattacataaatgtctctttgttttgaaaactcttccttataagtttactatttaactagtgatatatatatatgtatatatgactaaatgcctggactaagtgccaaaataggatatatttaaaatgtaaatcaaattaaaattagctaatactagaatgctcaaaaatcataatttgctgcattttctctttgtgtcagttttaactttatttcagacgtggcttttaattttctttattaggcatggttttcagatgactttctataaatgcacttctcaggcacttaagatgttatccacagattgaagggaatatgtaatctatttataaattcctcagctgcctttctttcaattgtcagttacagacttaagcaagttttaaatctctgttgcaatagcattttaaatttctatttaagatacacaacaaaagtcaatgaactgcttgaacttatctctttttatatgattttcagttttgcaaatcaccaggttatttcttgatttgaatatcaaaagaaaccttaatatgaagataattaaactttgtagatataagcctatattaattatttatcattttcccatggcccaataaaaccagttcatcaaacacatccaatacaccctgcattgagatgtagtagctggtgagccttaatgtctttgcattttaataaaaggtattttcaaattttaaataagggcttaaaagtgctccttggagatttgagaatattttctctattttcgagtagattagcaatattattaataattttgttgaaagaggatgcttttcatgctagttaaataaatctaaaaactattgctaaccttgatggaaactaaaaacaaaatacaatcattgaaacttgaaatataagtaaagtgcacatgaaaataatataatttgaagttgaatgaagaaaaatttttatgccactggttttaaatagaatatgtactatcattatttaacagatacactgaattttatgccaaaatatgagaattgtaccttattgcaccagagaaaaaaagtgagaacttgtgtttaaatcaaacacattcatattacagtcattccagaatatataaaataagtaagaaaatgatacattgcaacagaaaacacaaacaatgcatttggtcctgtctctatattttatagctaaatggctatgggaaaggcatgaagtgtctttaaactcagatttcctattttaaaaaactagtgtaatagtaataatcttgcaaagttgtgatgggggaagagagagaaagagagagtgagagagaaagagagagtgagagagagagagtgagattcacctaacttcctaattgtaattctaggataacttaaagcatcatatctctgtgacattcctttatgtgaatcttcagttcaatactgtagttttattattggttcctggtttattattagctggttgctttattttgtcagatccaagtgcttatcttgaaactgtgcttcctagagagggcccaagggtccagttaacctagtggaatgagaattatttactattcctcttatgcaaagggataatccctatttttaaaaggctcaacaactttgaagtgtggatactgtaaaaaaatatatatatatcaaaatgggtgaatttactacaattcttcactgaaaacgtgctgatgattaaatttgtctatgctatatatgcatcagaatgaagctactttgaaaatagtttttgagaaaagcctttattattggtgagtcagcagaagaaaaatgggaaatgaatgactcacattcttctggatgaacttaagcctgaaccttctgaatctgttattatttaattaaatcagtcttgtctctcaaagtatttaagagcattgttgctgtgtctagaaaatctctttcagttaaatttcaacactattattagaatgtgattttgctatttaggatacagtatagtaaaatagaaatataattatgggaaatacatggaaacatttcttaaacacctctttgagttatagtgctgcagaagtgatttttgagttacttgtgctaaagggacttcagaaaatttattctgcttttgatcttagtagctaaagaggtaagtctgaccatttaataactataccatacgactaaagtaattgaagaccactataggaaatctttttcctactgtcctttattgttatagcatgtttaatgtaattttataataaatgacaagtgacaaatggcattttcagcagctgtctgaaggacgcctctgaaaagcacccgaagaaaggagcacaattttatcattctctgagctctaggtgtgctgtgaatccaggctaggacacctcaaataatgccataattcactgactttgcagacactaattagtagctttctgtctgctaatatgagaaagctagtgtgctaagccctttatgtgcatttttctatttttgtgcattttctatcatgagaaccatgacttccccatcttaacttatatacattgagagatcaaagataaacaggatggcatattctacatcttcagaaagttcataggctactgcaaaaaaattcagaataataaggaagtattacatagtcacatggttaagatccaagactctgggacagatgggtctgattcctaatctactctatctatgagacaataggtaagattccagatattaaagtagttaatagtggtatggtacctaccatacaatgtgatgacaagtattaaacaatataataaggtaagatgctacattcagtggcaaactattagttgctgtttctgctgttactgttgctattatgacagatcctgcctggaatctagttattacggaggataaataaagttgcattcgattactgaaatcttactttttcgagaggactgagaaagttttccaagaaagataatacttaagataagtcttaaagtatgattaggaatgtcaccaaataacttaagaataaaaaggtttcctgaacttgggatttttaaaaaatacaatgatattctttcaatgagattcagatagctctaacaggaggtttacatgaaaactgtgctgttagcacctgcctttgaacacaagactgcaccactggtgagttttggggaaggagttttatagcagtgaatatcaatctgtttttatacatgactggttagaagacacccttgctaaagttaacaagcatatgtggttggcctatttagctaacacatttaggagctaactgagaatgactgaacacattctataaagtaataattttgtataacttgtttttatagctaaattcaacagagttttgtacagtaaactctgaacaatatattctgaagatgtactatttttccatatcttgtttatttatttatttttatttatttattttatttttgagacagggtctccctgtgtcacccaggctggagtgcaatggggtgatctcagctcacctcccaggttctctgcctcccaggttcaagcaatttccatgcctcagcctcccaagtagctgggactacagctacgtgccaccacaccaggctaatttttgtattttttgtagagatggggttttgccatgttgcccaggctggtctccaactcctgagctcaagcgatccacccacctcggcctcccaagttctgggctgacaggcatgagtcacctcgttcggccccatacctcctttcaaagtattagaaaagcaattgtttttcttctggtctgtcccaaatttctcttagtccatctcacactttctgggcttacaggcatgagccacctcgttcggtcccatacctcttttcaaagaattagaaaagcaattgtttctcttcttgtctgtcacaaatttctcttagtccatctcacacttatctccactgcaattgtcgttgccttgcctttattatcaactactaattgcagaaagttcttattgtctgcacttgagcacagtttagattttaaatgcaggggcttcattaattgcttggctggggtggttgttttctccagtatgctcactaaggtgcaagcagtcagttactcattctctgggatggtttttctcatttacatgagctgtagtagtctgcacttgattagcatccagttttttctgccttggtattccctccctatgtgctcatcatgggtgggttcattttactctgttctgactctgagaagaaaagctaaacagtagatatgcaatattactcttttctgactgcggtacatcaggagatttattatttaactatgatgtgtccattaattgcaaagattggccagccgatgaaaaaatgggtagaaaagtagcaactcattattagtgggaaaatttatattattcttactttggtaatcttgttttcatggacatagggtcatttttctactaaacaattttgtttgaaaaagtagttaatcaacaccttaatcaaatcaagatgttaaaacaactgatgtgacaactgaaactttttgagaatataaagataaccgtaagatggccttttctaataatggatactataaaaattggtgataatatttctagaattttcatatatatatatatatatgtaaatatatatgagatatatttcctaaatgtatacattcagaagctaatgtattttgtagaaagaaatttttgctttcttaaaatgaaagaaaagatactggttaattttattgagtctttaaaaatatagatatataaaagaagaatatgtaagaacattatggtaggtttctagggtctccatattgttttcaaatatttgaagtgctaatatgcatgagattgtagtcctaagggggaaaatagacacatacttgtgtactcacacacacacacagatatgtatatatatgttagagtggctaaattcagatgctacaagtactttttgaacttaaaaaaatttaacattcagttgaaaaactatccttccctaaatctaatataagaaccatagggcaagtctcaacttgatattttcaaatagttgaatgaatgaatgtctcccgaaaaagtgagcttatatagagaaaaaaactgcactaactgacctctaactatgttgtttcaaacaaggtagtgtaataagattgaaaatccagtgcacatacaagtctccatattggattttccactatgttaccccagccagttatagctgtattcaactatgaatatgaaatgaaaattgatttaggtagttccatagtgagctactttctcttttttcccctcctggaaatatttctgtttataaaactcattttattaagagaggaaagaaaaataccgaataatttatatgggatcatgattttctgaacattatgagactaaatgttacatgttgtacaggtatggcaaccttgtagagatgcacttttgcttttattttgttgttgttgttatttttacgtagccaaagataatgttttaaggtctatttctgggaactttgaccttacattcaagtcaatctgtgaagtaacttaattgaatttgctgtttttatatttcctccggagattataagaaaaattccaaaggacacataccttgaaggtcaatgtgtttatataatacagcatgtcctgactttctaatatttcagcccaaaggacagaaaggcccttcgacccaagtcattgattttaatctggcttgctgtcctgggaggctgtgtatattgctgtcagtgagactggttacacattcatgctattttaccacagcagcgttgcaaagggtaattaggttccaactcttaaatcagcaaagtggccatgtccaggaactatacggaaacaaaaggaagatctggcatgtttcaatttgcacaagtaaattaactctagcctcattttgggtgtagtgacagatttgaatttatcgtggactgtttagtaaatagccaggaacctgagcacttctgtaagatgctaccactaccctacagctaaaatgacagataaatgagacaaatgatgggatttggcagacaaattctggagaagtaatcaaaagagtgacattttactagggcattgtaacacagcctcattatttctttttattgctacatgaaggtgtcttttaggtgttaattgtcaccatctcagtgagaaagaccaccaaaaatgattttagatatattaagtccatctcctacctgacaaagtgattaaatacctctttaattctgtactcttcaaaaatcatgtatctaagttctgtctgtcacattaataatttaaatatacactgaaatttaagatttgtttttatgatttaggaaacaattatgggattaaacttttaaatgatgattgtctaacagcaaaagcatgctttcaatcatcatgaaactgcaaatcaatgacagcatttttgtttaaaaggtgatggggaggaggaaaagtaaatggattcagaatacctcaatttttttttaaggaggaatagaaatgacacctgactcgatatcagcagctgtggttgccataaataatatttttcacctttatcttatgattcttaagcagaggtacttaaacctactatattccgtggctgtggggaaataatctctatggtttcttgtcaagtcactctgggaggaatcttttcacaaaagagcaacatgatggctctaaattgtccctgtatcatgtgggattgcagtagcagcaccgataaaattgttcatatagtttagcgtgtgtttgtggctgagcatgtatgggtatttctatatatggatgggggagggaggggatggtagggtgagaaagaggtaaggggaagagagagaatgtgtgccacaggatagagtgagatcaaggttgcaatctcaggataccagagctgttggctcttctgtcttcttgtttttaactgaaaaatacctcaaattaagtgagctgtcaccaacaacaacagcaaagcttcttgtttctaaggactgcttagagtattatacagacagaacctggttggggtagaggagtagccacaagcataaacaccacacattttcatccttttacttgaagttcagtaaatattgggaataagtgttcacaaaacagtttgttgtatgttcacagtcattctccagcatgttggaatgttggttttcttttggggagagtatttgaggatttttttgatctctttgctctgacgtgctagaaatgaatctcctccaatcatctttttgaatatgtcaagactgtttcatttttgttctttgtaattttaactgctacaaacattttttacatttcatagcctagtttatagtattttcctaagaagagaatcttatttattactgtggaataaattaccccaaaattttatggcttaaaataaccaacatttattatctcacagcttatgtgcatccggactcccttcatggcttagctaggtctcctccttagagtctcacgtaaggctgtcatcagtgtgtcatctaggagaagtttgactcggggcagattcactttcaagcttactcacgtgattgttggtgggcttcaactgctgttccctcacagcctgtttgccagaaatatcagttccttgccatgtggcagcacacaacatagtaaccaccttctcttagagcaagcaagcaagagagcaatagtggacacccaagaaggaagccacactgcttttgtaacatacgttttgaggtgaaattctatcacttctgctgtattctgtttgttagaagtcagtcaataggtccagcccacattcaaagggaaaagcttatacaaagacatgactatcagatagaggcaatcattgggtttttgttttaggagctacttttcacaaatagtgacatgcaaccaacgatgttaccaaacaagcaaacaaaaagagacagtttccggagtcatttttataaaatctctaatgggaaaatatcttttcctttagactatttttacattcatatttttactacactttttgtaatttgatggagtatttggaacataaaaaatgtagagcaataagacacacacacacacacacacacaacctactttaataataaaacatgaacaatgtagttaaaatccccgatgtacccttcctttcctagggatgactgacatcctgactttgattttccttccgatatatttacttgtaattttgctagatatatgcactattaacaatgtgttattattttgttgttttaaaactttaatggtatctttatgtgttcccatgaataaatgttaaagattgttggaaagtgcattgttcataacagccaaaaaatccaaaacttttaaagaggaaacaatcaacatatctattaatagcagaatggatatataaattttggtgtattcataaagttgaatattatgcacagtgaaaatgaatgaactagagtcacatattaacatggattcatctcacaagcattaaattgaagaaaatatgtttaatacttaatacttaaaaatttcaatgaatttttaagtggttcaaagttacttgctaaaaatgcatgtaagtcacctttcctgaaactgaagaaattatatcttgcactttgtttttttggtttgccaattgtttatatggggaaattaaacagaatatttctgaaaactcttataaaagtttaaacttttaaattactaattccaagcctatcttatgattatgcttattgtatatattaagtgttgctgggatttacataggtttattcaattcaaagtttagtgtcctggaagcaaattattatttctcgtttttttttctttcatattttattctgaatgcctagagaattgatagatgtagttgtgcccccatttccccacctaatttctctttcttacaattgggaaaattgcagcagctgtggctaactatttacattttaaataataacatgtgtaaatagcatctttctaactcttcattattggcagcagaaataaatgggaatattggcccaggctcattgtagaaacagagccacattcagaatgagataaaacaaatgattataaactcatagcaaaacaagagaacagattgtcaaaagagggtggtaataatgataatcaacaatacataataatcctagaaaatcgaagaaatgcagcagatatatttcttcagagaggattagattccatctgttgatttacaaatgtcgagtaatttgagaaggattaaattactagaggtttcaatgacagttaaaagtcaactggtgtttaaggcacattggttaatagcatgagctagactgtctggatttgaaaatcagctcaattacttaatagctatggaatcttgacaatttcctaaacactccagttctgtttccttacttgtaatcctcatatgcttcataggatttctctgaatattgagttaattttcacaaagcatgtagaaaaataattaggctatagtaagcaccctataaatgttagattttacaagtgaagcatgttatgtgtgcatttgtgattatttgaaaataatttagtactataggtttataagaaatttgatatttaatagggcaagcccttctactcttttttcaagtttgtcttattttggcaatttattctttcatatgaattttaaaattaataaattaaaattaataagccaaattccataaaataatctttatgtaatcattgcattacatttataaattgatatggggtgggagttgttgctttacaatagtgaatatttttatctgtgaccatatgaattgtttcaattatttagatatttttctcaagaacttcaataaaataattctattttttcttaatagttttgaatttattttgtttaatttggccccgaattttttatggaatcttgttttatgaatggattttcttcttcttttttatctaaatgagtattgatggtatgaacatatgtacacatattactgatttttatgtattaagcttgcatatagcaagccttccatcctaattataaataggtattgaaatgtttgaatgttattttctgtctgcattgatttgtcatctatatttgtgggttttttgtatcttttatcttaatgcgactaaatatagtactcaatttccaaacatcaaattttaccagtatttctgtgataaatacaattaagaatgatgcttgctaatatttaagatttttgaatatgtttataaataagatttatactcataaattagattagctaaaagtcctttctcctttggtgttaaccagttttatggttaagattatgttagccgcatgaaacagattttttctttcctaggtaatttggtaaacattctctgtaaattgtctacatgtttctttttacagttttgactctcatttaattttattgagttataattctattcatgtcttctgttccctctcgagtcaattttgatactgtgtacaaatgtttatagtatatatattgccatcacataataatgtgtaataataggcaaattgcttaaactttctgacctttagcttcattaactacaaaatgggaatattaatagtacctaaagcataggggtgcttttaggattaattaagataatacatgttaagtgattaaagaacaccacctggcatatagtttttcattttttccagaataattattctgtattataaagtaatgacacactttataactattgccttatttttctacattaatagtgcttccataatattattctggttaatattttccttttcctattcatcttttttatttaaaattctattcatctttttaattcaaaaactttataaaattattttaacatattttatgtatgtctcttgtaaaagataattagacattttgaaaagcaaatgtttatcttttattatcaagttaaacatatttgacatagttctagcatattactcatttatttctattttatatggtttatttgcttcattttctttctttcattccatttatttgttttcgttttatttattcttttaatgggttttaaattcacacattctatttttatattttaacaactaaaattttagcatgcatattcaaccttatatgttaaacattaatcagtgtctcagttcccttcatgatatatatgttttaaacatctttattcacctcagtcctctatgtgctacaagtctattagtataattaaaaatttttaatatggtattgttactactaaaaattaaagacagaatattatgctctacttttgtaaaacaattatttcaccttaagtgtcatctaattagtggtatttttaaagaagtgtcatagaatatttgttctatatagccatattggtatcaaatagcaaaacttcctctgaaaaatgcaaatgttgctagtcttataggtgatgaaatagcgtaagaacttgggaagagaaagaaagaacatagaaatgaatctgggctacatgggtatttaataatataacccaaagttataccagtatcaatttataaaatctgtcattatctgggttgatttccggttaactacatggacaaaaaaatgttctaaaatatcccaatagagttctaatttgcagctggttgattgttttaccctactattatctacaaagcaatcattcatgaataaatacatcttgactagctttcaaggaaatattgaccactaatacattttaattaaggaatatcgaagcaaaagagtttaaatcaataagacaatatgaaaacagcatgaagtttaagcagtaaacaattataaaacttaagaaaataaatgtttttgttccacattcatacatacacacatatacacatacacacacatagattttaaaatttatttattatatatagtgaatgtgtaatagaggaaatacagtctttcctctaaattgcatgggaagaggatttaagtcagtatttgttaacaggaggaattatcatggaagacatattcctggaattgatgtctaagttgagacctcaagaactatgtcagagttatggatgcaaaaagggaggtggagatttctatgtagaggaaagtataatatataaggcacagaagcaagagagcccaggggattttcatgtcaggaagacctggatttgaattctggtgctgaactatttcgtggaggtcattttatttcaaatactggtatagtctctaacaataataacaatctcgaatttatgttttagagatttgctatgcatatgtatgtgtttgtgtgtatgttttgcgcaattcctagcccaaagtaagtgatcaataaatatgctattataattattgttgcagtgtttgctataattattactgttgcttatttaagatgctataattatttcaacataatttgagcacactaaaatgaaagagtagtaagaattaaagtaggaggaaaaggtaaactatggcagatcatgaaccatcttatcaacctcattaaaacatatgaacattgtggcagtagggatctattgaaatgtcaaaattggaatatagaaagctctttctcgctataatgtgatgaatgaatgtaggggcaggtggaatgaaaccgaaaggagaaatgcttgtaatgtaagagatgatgggcctaaattgtggtagatgaagtagagagtgataaaattggagagatacttagaggttcaactgtgctgggcttagttattagatccagcggttgaaccagaatacatcaaggctgatgtagatgtctcaaatgtagtaaattagatagatgatgatacagttccctggaaaaacagggatgagcccatatgcagaggaagataatgagtctaattttgaacatgtatacatataaatgttcagaaaacaaccaaatgtatgtgtctaagcaagcagttttttgagctggatttcagtttaggagatatgtcagctaaaaataattagacattatcatcaacatttagattaaagctaaaatcatgtagtgaattaaattgaattgagtttctgtaaagagtgagaacacacctgagaaacacccagccatatttaaatatcaaatggaataaaaagtttcccaaaaaaacccaaaaaagcagtctaatttgtttgagagcagatttgtatatgaatttcattaggaaagcagaaaatataaaactgtatcagttatagttcttgtaattgttggtgttattttcaactaattcaaaatgtcaactacaaagaccaattttaccttaaagtatgcatctttggttactgtcttagtctgctcagtctgctatacaatactgcagactgggtataaacaatagaaatgtgtcatctcccagttctagagatgggaagttcaaggttaaagtgtctgccctgtaggtttccagtgaacctctcttcctggtttgcagatggctggcttctttctgtgtcctcttctgctggcctttccactgtgtgcacacactcctagtgtctcttcctcttcttatgaggatcccagtcctattggattaagaccccacctttatgaccttatttaactttaattacatccttaaagaccctatttccaaataaagccacattgggggttagggcttcaacatattaatttgggtgtggggtacataacttagtctataagagttacaatatcaaaatgagttgaaaattctaatctgcaataggattaaaactgcctcaatgaaatgattattacaagaaaaaaaatctacccctttagagtattctatataaagagataagaataattatcctgatatcatagatatatagaagaatcaaatattaagggtgccttctcccacacatacttggaacaactcctagcatagattaacgtgttaaactattaagttttgaatgaacactaagtgaaaaagttactatttgattagttcatcagcaactaaatgtaggcaattagaagtttatatataggaacaaagaaataattcagtttcaactttttaatataaatatgaataaaattacagatcagtctaaatactttacaaatgtcacataagttagttaatggaaaaattgtgtttaggacatagcctttttaatttttatttcacccacactagctcatgatgtatattggtttgcaggaaaaacagtataatgtgacttgcaaagcaaaatatgaaaatagaaatcaggagagaaaaaagatcaaaagatgtgatgttcacttatttagtaggaaaaaaaataattgagaagataaaactaaatttcaactaaaatgaactttcatctatgaatctgaagtgagaagtagtaaacccttgtttctaaaaaatcacaagctaaggttatattaatgtatttgtgattaagtaaaagcatagtgatataaatgaaaggattcaataacagaataatttgctgacgatgatggcttccagcctcatccatgtccctgcaaaggacatgatctcatttgtttttatgactgcatagtattccatggtgtatatgtaccacattttctttatccagtctatcattgatggacatttaggttggttccaatgctgcaataaaacacaacagaaaaccaaacaccacatgttctcactcataaataggagtggaacaatgagaacacatggacacagggaggggaacatcacacaccagggtctattgggaggtgggggacaaggagagggagagcaataggacaaacacctaatgcatgcaggacttaaaacctatatgactaggtgcagcgaaccacgatggctcatgtatacctatgtaacaaacctgcacattctgcacatatatcctggaatttaaagtaaaataaatattttaaataaatagaataagaggaataactacactgtcttccacaatggttgaacttacttacactactaccaagtatataaatgatcgttttcctctgcaacctcaccagcatctgtgtttttgtttttgtttgttttatttttttgtttgtttgttttgagtggaagtctcgctctgtcgcccaagctggagtgcagtggcacgatctcagctcactgcaacctttttctcccgggttcaagcgattctcctacctcatcctccctagttgctgggactacaggcgcgtgccatcatgaccggctaatttttgtatttttagtagagacggggtttcactatgttgcccagggtggtctcgaattcttgacctcatgatccactggcctcccaaagggctggattataggcgtgactttaataatagccattctgactgctgtgagatggtatttcattgtaattttgatttgcatttctctagtgatcagtgatgttgagctttttttcgtgtgctttctggctgcatgtatgtcttcttttgaaaactttgtccactttttatggggtttttccttgcaaatttgtttaggttccttatagatgctagatagtacacctttgtcagacgcatagtttgcaaaaaatttctctcatctcataggttgtctgtttcctctattgatagtttcttttgctgtgcagaagctccttagtttaatgaaatcccatttgtcaatttttgcttttgatgcagttgcttttggtgtctctgtcatgaaatctttgcctgtgcctatctccttttacttaaaagtgggagctaaatgatgagaacacatggatgcttagaggggaacaacatacattggggcctaacagaggccagagggtgggaggaaggagaggatcaagaaaaataactaatgggtactaggctcaatatacctggatgatgcaataatctgtacaacaaacccccatgacgcaattttacctatgtgacaaacctgcatctttactcctgaactcaaaataaaagtttaaaataaaagttaaagaatagaataagaataaaataatgagtaaataagtcaaatttattagaacacattaagatatattaacataactaataaaagtatgtctaacaatcccaaaacagtcactaagaagatattggcaaattagggaaatatccaaatttagttctaaaaaagataatctggttaagatagaataaaaaatagaataattcagtatcatgaatctgtgagtaactactccaatagaatattttggtgagaagaaatatttgaatttgaaatatttcaatttgataattaattttttataattgttagtttaacattcttcacctacctctgtgaaccatagaaccttataattctgtgctttaaatacttttatgtgatgtgtatataattaaatctccaatatcacagtagcctattaaaatatataataaaaaaatgattttacaaagaaaaccccaaacctttaattatgtgtaaatgagactcgaattaatacagggatgtgttgtgaacatgattttaggagttgaatagtatggatatatcaggtcttcacaaatatataatagtttacttgcaataatacaaatatttaaaagtcaaagagttatgaaaaaaatgaggatgtttgaccttaaatattaagctacagtagaacgaactatgtagtgtaaatataaatagaagaaaaatagtaaaagtctcaagtaatgattctatcaaaagtagaaaacataagtataaatatttttattacatatgaaaactttattatgagtgctgttgattcggctccccatataatattgtacacatgtaattattatttaattattattatttgtttaatatttgtcttccccatgaggacaatcactgagttttggtcacagtcagttgtttgtcttctaacaaaaggctaggcacagtaggttgtcaactaaaattgtttaccaaacaagttaacattctaatgatatatagaccggttatctaccaaagtccctggtggatcttcattgcttttaagaccagtactcccatatgtctctctaatggatagctctttgcagtttcctgaatataccttgttctcttatacctacaagtataaggtacttgtatactgtatacaacagtatactgttccctctacctggaacagtgctcactttctaaactcaggtaaagtatccttctctacattccttcaggcagaatttgttgctatttctgactgagtttctatatacatttgaatagcttgtgtagttaatcacatttctataacataattgtttctgatagttcccatagcaccacgacacaagatgatgatggcttatatttctgtttctttctgcctcattgaattgtgagttattccaaagtagaaatgttcttttatttatttattcttatacctaggtcagtgcctggtacataaatggtaaacatgaaacatttttatataataagtgaattaactgaacaatgcattttgtaaaactcttaaagaaaatagactggaaaaaaggtattttgtatctccaagagcccaaagttagaaacaaataaaaggcaatatagtcaaaggtttccaggcataccaggcatagtcccagctttaaatatctattatgaatagggaaaaaacactgatgtcagccttgtggccctcgaccgagtagagatgctcttgaatgctttttagatatggaaagaaacaatggccctagaaaagtcctgggagtttaatgagttgccaaatgtgcatttcttgttttaaaccagaaaatgacagtgccatgtcagttactttaaaacaccatggtccttttcaaatgaattttaatattacttaatgcctttaactttttttttatcaaaatggagctgtccttgactatatttttggattatgaatctacaatacccaaccccctcaatgtgtatattaagtaatatatccctgggatgcactccaaggggaatcttctttgtgacactattagccatggaacagaattgattatgatgaaatattactatatatatttgcagttaatcctctaagcatttttattaacctttgttcctcaacaattcacaaatgcaaaactagtacagcaggtttaatatattatgtatatacacacacaccacatacatataataaattaacataaaatttcttctttttaatttttattttattttattatactttaagttttagggtacatgtgcacaatgtgcaagttagttacatatgtatacgtgtgccatgctggtgtgctgcacccattaacttgtcacttagcattaggtatatctcctactgctatccctccccactgccctcatgccacaacagtccccagagtgtgatgttccccttcctgtgtccatgtgttctcattgttcaattcccacctatgagtgagaacatgcggtgtttgatttttgtccttgcaatagtttactgagaatgatgatttccaatttcatccatgtccctacaaaggacatgaactcatcattttttatggctgcatagtattccatggtgtctatgtgccacattttcttaatccagtctatcattgttggacatttgggttggttccaagtctttgctattgtgaatagtgccgcagtaaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttatagtcccaccaacagtgtaaaagtgttcctatttctccacatcctctctagcacctgttgtttcctgacttttaatgactgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttataaatttgtttgagttcattgtagattctggacattagccctttgtcagatgagtaggttgcgaaaattttctcccattgtgtaggttgcctgttcactctgatggtagtttcttttgctgtgcagaagctctttagtttaattagatcccatttgtcaattttggcttttgttgccattgcttttggtgttttagacatgaagtctttgcccatgcctgtgtcctgaatggtaatgcctaggttttcttctagggtttttatggttttaggtctaacatttaagtctttaatccatattgaattaatttttgtataaggtgtaaggaagggatccagtttcagctttctacatatggccagtcagttttcccaacaccatttattaaatagggaatcctttctccattgcttgtttttctcaggtttgtcaaagatcagatagttgtagatatgcagtgttatttctgagggctctgttctgttccattgatctatatatctgttttggtaccagtaccatgctgttttggttactgtagccttgtagtatagtttgaggtcaggtagcgtgatgcctccagctttgttcttttggcttaggattgacttggcaatgccggctctgttttggttccatatgaactttaaagtagtttttttcatttctgtgaagaaaggcattggtagcttgatggggatggcattgaatctataaattaccttgggcagtatggccattttcacgatactgattcttcctacccatgagcatggaatgttcttccatttgtttgtatcctcttttatttccttgagcagtggtttgtagttctctttgaagaggtccttcacatcccttataagttggattcctgggtattttattctctttgaagcaattgtgaatgggagttcactcatgatttggctctctgttcatctgttattggtgtataagaatgcttgtgatttttgcacattgattttgtatcctgagactttgctgaagttgcttatcagcttaaggagattttgggctgaggcgatggggttttctagatatacaatcatgtcgtctgcaaacagggacaatttgacttcctcttttcctaattgaataccctttatttccttctcctgcttaattgccctgaccagaacttccaacactatgttgaataggagtggtgagagagggcatccctgtcttgtgccagttttcaaaggaaatgcttccagtttttgcccattcagtatgatattggctgtgggtttgtcatagatagctcttattattttgagatacgtcccatcaatatgtaatttattgagagtttttagcatgaagggtagttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatactggtctaaaattctcttttttggttgtgtctctgcccggctttggtatcaggatgatgctggcctcataaaatgagttagggaggattccctccttttctattgattggaatagtttcacaaggaatggtaccagttcctccttgtacctctggtagaattcggctgtgaatccatctggtcctggactctttttggttggtaagctattgattattgccacaatttcagagcctgttattggtctattcagagattcaacttcttcctggtttagtcttgggtgggtgtatgtgtcgaggaatttatccatttcttctagattttctagtttatttgcgtagaggtgtttgtagtattctctgatggtagtttgtatttctgtgggattggtggtgatatcccctttatcattttttattgcatctatttgattcttctctctttttttctttattagtcttgcaagcagtctatgaattttgttgatcctttcaaaaaacccgctcctggattcattaattttttgaagggttttttgtgtctctatttccttcagttctcctctgattttagttatttcttgccttctgctagcttttgaatgtgtttgctcttgcttttctggctcttttaattgtgatgttagggtgtcaattttgtatctttcctgctttctcttgtgggcgtttactgctataaatttccatctactcactgctttgaatgtgtcccagagattctggtatgttgtgtctttgttcttatttgtttcaaagaacatctttatttctgccttcatttcattatgtacccagtagtcattcaggagcaggttgttcagtttccatgttgttgagcggttttgagtgagtttcttaatcctgagttctagtttgattgcactgtggtctgagagacagtttgttataatttctgttcttttagatttgctggggagatctttacttccaactatgtggtcaattttggaataggtgtggtgtggtgctgaaaaaaatgtatattctgttgatttggggtggagagttctgcagatgtctattaggtccgcttggtgcagagctgagttcaattcctgggtatccttgttaactttctgtctcgttgatctgtctaatgttgacaatggggtgttaaagtctcccattattattgtgtgggagtctaagtctctttgtaggtcactcaggacttgctttatgaatctgggtgctcctgtattgggtgcatatatatttaggatagttacctcttcttgttgaatcgatccctttaccattatgtaatggccttctttgtctcttttgatctttgttggtttaaagtctgttttatcagagactagtattgcaacccatgcctttttttgttttccatttgcttggtagatcttcctccatccttttattttgagcctatgtgtgtctctgcgcatgagctggatttcctgaatacagcacactgatgggtcttgactctatccaatttgccagtccgtgtcttttaattggagcatttagtccatttacatttaaagttaatattgttatgtgtgaatttgatcctgtcattatgatgttagctggttattttgctcgttagttgatgcagtttcttcctagtcttgatggtctttacattttggcatgattttgcagtggctggtaccggttgtgcctttccatgtttagtgcttccttcaggagctcttttagggcaggcctggtggtgacaaaatctgtcagcatttgcttgtctgtaaagtattttatttctccttcacttatgaagcttagtgtggctggatatgaaattctgggttgaaaattcttttctttaagaatgttgaatattggcctccactctcttctggcttgtagaatttctgccgagagatccgctgttagtctgatgtgcttccctttgtgggtaacccaacctttctctctggctgcccttaatattttttccttcatttcaactttggtgaatctgacaattatgtgtcttggagttgctcttcttgaggagtatctttgtggcgttctctgtatttcctgaatctgaacgttggcctgccttgctagattggggaagttctcctggataatatcctgcagagtgttttccaacttggttccattctccccgtcactttcacgtacaccaatcagacgtagatttggtcttttcgtatagtcccatatgtcttggaggctttgtttgtttctttttattcttttttctctaaacttcccttctcgcttcatttcattcatttcatcttccatcactgataccctttcttccagttgatcgcatcggctcctggggcttctgcattcttcacatagttctcgagccttggctttcagctccatcagctcctttaagcacttctctgtattggttattctagttatccattcgtctaaatttttttcgaagtttttaacttctttgcctttggtttgaatttcctcctgtagctcggagtagtttgatcgtctgaagccttcttctctcaacttgtcaaagtcattctccatccagctttgttccgttgctagtgaggaactgcattcctttggaggaggagaggcgctctgctttttagagttcccagtttttctgctctgttttttccccatctttgtggttttatctacttttggtgtttgatgatggtgatgtacagatgggtttttggtgtggatgtcctttctgtttgttagttttccttctaacagacaggaccctcagctgcaggtctgttggagtttgctagaggtccactccaaaccctgtttgcttgggtatcagcagcggtggctgcagaacagcagattttcgtgaaccgcgaatgctgctctctgatcgttccgctggaagttttgtctcagaggagtacccggccgtgtgaggtgtcagtctgcccctacttgggggtgcctcccagttaggcttctcgggggtcaggggtcagggacccacttgaggaggcagtttgccggttctgagatctccagctgcgtgcttggagaaccactgctctcttcaaagctgtcggacagggacagttaagtctgcagaggttactgctgtctttttatttgtctgtgccctgcccccagaggcggggcctacagaggcaggcaggcctccttgagctgtggtgggctccacccagtcggagcttcctggctgctttgtttagctgagcaagcctgggctatggtgggtgcccctcccccagccttgctgccaccttgcagtttgatctcagaccactgtgctagcaatcagcgagactcagtgggcataggaccctgtgagccatgtgcgggatataatctcctggtgcaccgttttttaagcccgtcggaaaagcgcagtattagggtgggaatgacccgatattccaggtgcctactgtcacccctttctttcactaagaaagggaactccctgaccccttgtgcttcctgagtaaggcaatgcctcgccctgcttcagctcgcgcatggtgtgctgcacccactgtcctgagcccactgtctggcactccctagtgagatgaacacaatacctcagatggaaatgcagaaatctcccatcttctgtgtcgctcacgctgggagctgtagaccggagctgttcctattcggccatcttggctgccctctccaaattgacataaaatttctaaagtagactagcttctgaaatgattagcagcatgcattcaaaatgtatattttcaggaaagaaactacttccctttgaacaataagaaatctcccccattgatttgtgtcatttgtcagtaatgaataattgagaagaatcctagaaaagtagttacatttttcatataaattgcctcttccttggttagtttttcttccagttaatccaaaggaacttctcaattctctcaatggtaacagtgtgaaattgtttgatattttgtattatttttacttgtttttatggcatattcagttaagaatttatataatattcattatgtttgggccttagtattattaaagcaaaaaaaatagtttgtattatgtacacttagaattctctcattgtacattctatatttagaaccttcagtattttcccacaatctcttcagagattatggctttctggactgtaaaaaacataatatttctaataaaaataagcaattttttaaaacgttatgatttttagaaaattgccttaattatccttggggttgtgagccaatggcttatgagtatatgactttactttttcaaatgtatatttgaattagcctatatttattaagccaatatctaatgtgtcagacatcccatcttttgatatttcaatttaagtatatgagaagatgctctataaaccacaaagcgaaacatttaaagtttatgtcaattaaaaaatcacatccttttgttcacgtcgttaacttaaaaaatattcttctttaggttagccaactttcatctaggaaaatgaaaatacagctgaatcaaaattggttttgaaattagtctatagaaatgtgtttcttaagtagacttgtcagaagtttttataggaaacttcctagaatgttttattcttttgtcattttaatatgataactctgtatctaattgttttgtataaacttgtaataatgcattaaagttctaattaaatatatagagctgtttccccctaaacaaaatgttcatagtggctcagctttttaattcttgcagaaagagctttgaggttcaatagactaatccttgaatctttgcttgacttcttaagtcactcaacatctctgagaaactagcaggtgagtagtttctcacctataaaatgacaatgatagcacctttgtcaaagcattcttgtaaaagttgggtgaaatgtcaaatgcctgtacagtttcagacacatagttggctctgacaaatcataacaaataatttagcattatttgttattatgatttatttcctcattatcagttgtttcaagtaagcatttcaaaatttcaaacaatttcttattgctgtttcttactttccttcttctcatttgcctctggttaactgagagttgagcaattaaatcaagaagcaatttattaatgtatctaaaatcttggagtgagactagaagccaaaggcaaggtgccaacccctgggattaaagggcatgaacttattttgtctagtcagaagagctctgtgttcatgtatgaactccaggagttattctggtgattgacagtataggcagattaactccggattgttgcaatattatatttaacattttgtatttacttagtaattcatcgtattgtcttggcctgactggaatgttgtgaatgtggaaggagagtagagtgtgtctttgacaatataggtaatttttttcaatttctgggtgagttttctcatttaaatatatttgacttatattttagaggaaattatcatttaaaaacctttaatcagtagtatctagttaataagctgagaaacaaaactacagaaattttcagttttaataaactacagaaaagtttgtctgttatgccattgttattttatcataactgtcaagtagaaaaactgattatgtattattagtaaatataaaaatctcagtttttaagctaatgctaggcttacttttgttctaattagatccataaattcatgccttagtattaaactttttgtcatatgtaagtagtagtttatttccatgttgacaatttttggaaattcttagcaaaattactggttaccaataaatatgaatttttttgttagtatctatagataaatgaaggcaacatgatatattttgagaagttatagttacaattatatctgacacactacatattggcttcatgcatacaacttaattcaaatttatatatatacatatatatatgaaaaggtaacatcatataagccattggctcacaattccttgtataattaattaattatagaaatatctatgaatattttaacaacaagaaatgaaagaaaatattctgaaaggaaattagttgttaaagttgtcaaatgttatatttggtcatatcgaactcataagtaagctgagattcaatatactcagcatgcctgtgttgaagggtgtatgtaaataaagcaaagtggcttttgtttcctgtcaccttaccatgcccatttggaaggggaattttggtaagttcatatgaaactccttaatgcctgagaaagaccaactaaataaataaattaattaaatttctatctatctatctatatatctgaattagccacttaattttatcaataatgagacaataaaagagtactatttaaagtctcatgttattttacttatacccagaaatatcagatctaaatgttgctaaggtttaacagattgaaatactttaggtgatttagttcccagtcaaaagaaaaatcattgaattagtgtcttgaaggcagaatttcttccattagccttattagcattttattactttgctgtgaaatttcagcttctttaatttaacatataaatgtaatttaaggtgaattaatttgactttgaggcagtttcttaaaatgaacttggttgatagctctatcagaatctaaaacttagcacattcagcttatctttgtttctagaactcagtacgtgccatgtaactgctctagattctgaattatgtaatatattattagtttcaacactctctttagtaataacttttcatcaattatccaatgagagacaggtagttaggggaaaagaactcgagcaaaagaaaaacaatagcttatatcagttgagaatacccaacttaaaagaatctgaagagttgtgtattaatttagcagcattttactcaaattatggtaatgaaattatggtaaatttatgatgaaaaattatatagaatatagatgttattgaaaacaaaattaaactgacatttaattgtggtcaagatgttaaggtttttttttttttttttttttgagatggagttccgccctgtcactatggttaaagagagagagagagaagcagcaagtggttgcttttaggctctttttttctttttaaaaaatattctcagaaactccataagaggaaaagcaaactccttcatggcagagaagggaaggcagttgtcaaataaagagatgtagacctactcccattgcatccaggccatacagatacacaggttttctgtaacagatgtctaatatgttgacaatggtcagtttaaaatggggaaatagagatatttatccataaacaatgtgtctatggccaaatgcaatggagttgtacattttatcaaatggaaatatgcaataaaagagatgcagctgtggttgaaatgcaattaagttatatgcttgggacattacacaggcagcagtcactcattattgcaaggctggtctaccaagattctcaagttttacctgattgagactataaatgaaataattgtatttagagtaaaatatcattttgttcatataaccactcacttgtcaaataagaaattgaaatatttttctaggattgaccttcctgaatatttccgataactccctgagatgttttccatgtgtagctggaatgtgctttaactcttgtaatctaatatgcctgagaggagtgtcaatcagagcactccctgatgcttggaagtccttcacttttgctattcttgcctcccttctgctccttttggcctttgtaactttgtctcttgtgaaaaaaacactactgctactgatttttttcttcctggaaaatttctattgcctttctccctatgcactcagtcagcacatgctttatgtttttcacaatcaactggcttggaggtgcttcccacagcagagcctttataaggagaagacatgagtacacagagaggttaagtatcttgccttaaactgcattattagttttatgagaagagcaaagatcttggtgattacttagtttaccttgtaaccagtatgataaactaattcttattcaactttaatgagaatttgttttatccagttactttaaaaaatatgtatcaacttcagcaataatagtctggaccaaaaaaaaaaatatggatggtcacatctgcatttggaagctaattctagagcagcattaaaagtatatatagagagagttggtggattctcctaggttagacataccagtggtgactggtcagagtctacatttgagagtattgttaatttttcccaattttctgagtgctaagcccagaccagagatggcaactgagagcagaattctatgtgccggatacttggctgtattgtctgattattctagctgacacacacactgtcttgtcagcctggaggccctgtttatcagttttaaaattaataattagaatgaggagcatttggtaatcagtggaaggtacaaagttggttatgctcttagtactatcaggctacaactggagtcgtgtgtaatatgctcttacgtcaggtgaagtttttgttgtgacggttcatatttttgttttggcttttgtttttcatttcgataatcatttgtttcaagttgtattcctcctattccttcaagctttgtagactagaagtctagagctggagataaagttctctcttggttgtatctcttttgaggactattctaaagacctattcttagaagaggtgctaataaagttatgttgcctaagaccagataatgctgatgactgcattgtggatgagagagccaatgttgttaaaagaaagaaatgcaattatgtttcctttgagtagacagagaatatagaaaattatatatctataaatattttttgaactgatgaaataaattctatatatgttattattggtattaaatcttttgaaagtttttaagaatgaattaaaggttaaaatagtaaacagtggtggggcgccatggctcacgcctgtaatcccagcactttgggaggccgaggcaggcagatcacgaggtctagagatcaataccatcctggctaacacggtaaaaccctatctctactaaaaatacaaaaattagccgggcctggtggcatgcatctgtagtcccagctactcgggaggctgaggcaggagaatcgtttgaacctaggagatggaggttgcagtgagtcaggatcaccctattgcagtccagcctgggcaacagagcgagactctgtctaaaaaaaaaaaaaaaaaaaaagtaaacagtgctgcttataaaatgggataaatcaaaacacagaaaagggtgtataggtgtatatgagccttcaaaaaatggaattatctcatatttagccactaattctttttttatttatgcaaatcaaggtagaacaaaaatgtgtgtttttattctgcctatcggtatgtaagagattagtttgggacaagggtttattacaagagccaaaaatatctatgtatgaggacttatagttccattattactactaatttgttctgaaaatattatttttaactgagtttctttgtatatcagttttggcaaaggcctaaaaagtgaaatcattttaaaagaccatccataccagcattggagacccttccactttgatttatataagcagctcagagtggaacctagaaatggaagcaattgagggtccttcgagagttccaccctaagatctgtagactgtttcctctacaaaggatggggtacctttatcccttacctcccctgcttctatcatcacctctacagtcctgaaggagttataccctatggctagtgaaaatggaagggtcaaagaacaaagcagataaagagggaagaaaggctaagtaataccacttccactctttccccctcaaactttcgggatatcaagcctgaactagaagacagctgggaagaatagagaaattttaaatcagaaacttcacaggtcttttacaaagttattgaactggatattttaattacagaaatgggactgttctttttttgtatttttttattatactttaagtactagggtacatgtgcacaatgtgcaggtttgttacatatgtatatatgttccatgttggtgtgctgcacccattaacttgtcatttacatcaggtatatctcctaatgctatccctaccccctgcccccaccccacaacaggccccggtgtgtgatgttccccttcctgtgtccaggtgttctcattgttcaattcccacctatgagtgagaacatgtggcgtttggtttttcgtccttgcaatagtttgctgagaatgatggtttccagcttcatccaagtccctacaaaggacaggaactcatcattttttatggctgcatagtattccatggtgactatgtgccacattttctcaatccagtctatcattgttggacatttgggttggttcccagtctttgctattgtgaatagtgctgcaataaacatacatgtgcatgtgtctctatagcagcatgatttataatcttttgggtatatacccagtaatgggatggctgggtcaaatggtatttccagttctagatccctgaggaatcgccacactgtcttccacaatggttgaactagtttacagtcctaccaacagtgtaaaagtgtcctatttctccacatcctctccaacacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatatcctttgcccacctgttgatggggttgtttgtttttttcttgtaaatttgtttgagttctttgtagattctggatattagccctttgtcagatgaggagattgtaaaaattttctccagaaatgggactgttcttgtgattgactcagggaactgggaaagctgtggaatgtgcctaaaatttcatccaatagcaggataagaaatagcctgtcacataggctttcagggccagtgggagagggaatggagttaatttatagctatatctattgattaatactcatttaataaactgttccatacaagcagcagatttcaaaattggctgatttaaattaatcaactaacttactgactcacctactaactaaacaaataaataagtaaaagtgaactttatagaattgctttacgatcatagaatgaaatttggaaaacagtctgtgagctagatgacatggagaagcacagccctcaatccctccacgagccagtgaggacatggctgcctcttttgcagccagggtgtgctgaatttctcaatgtgtgctgttgtgctcatattaaattcagggtgctgtaattagcacaattgctcctgcttcccaggaaacaacattgttgtcactactgtcaccatatgccactggaatgggtccttccagttcttcaccaatgaattatgggactagatgtgtctgagtgcaaggttggctaaatgtgttttcctcctcgtgctgaaacacaaaagtgcactgtattagtccgttttcatgctgctgataaagatataccagagacagggcaatttacaaaagacggaggtttattggacttacagttccatgtggctggggcggcctcaggatcatggtagaaggcaaggaggagcatgtcatatcttgcatggatggcggcaggcaaaaagagagcctgctcaagaaactcccacttttaaaaccaccggatctcacaagacccattcactatcaccagaacagcatggtaaagaccccccacccccacaacccaccatcatgattcagtcatgattcccaccaggtccctcccctaacattgggaattatgtgagctacatgatgaaatttgggtagggacacagagccaaaccttgccatgcgcatagtagaggtaggttgggaaagtgttctctgtcctgaggctgaaagactatagcaacaaagaaggcagggagattgtctccagttcttcagaagaggctagtctgcctcttcaccactggtccatggagcagggatgactttgtcttcccacacttttgatatcacctaccattaggattcatcaacaaccagattagagccccaaagatgtgacaaagaagaataacctatcaatagtgtcctgtgtcagaagcagaagttagtaaaaattaaatggaacatatacccaatgaaacatagaacagcttaagtgttaataaataaaaagaaggctaatatttaaagagatttatttgtcaggtacattcattcgagtgcatgtgcacatacatacacatatacgtgctagatttggtgatactgaaaatcataatttcttaactaaatagttcagtaaaaaaattggaaatggggatcaaattagtggcctaggacaggaagtgctagaaatatctcaaaatacagagcatgaagtatgaagatatataaatcatgaggaggggaaagagggagaaagacttggaggatatagcctatggaaataatatacaaataccggaaattttagaaaaataattacattaagttgaaaaggcctgaacttgtagctgtgcttactgaaaatcctgaactcatactgaatcaggagaaaagataaccacctgagctaatacaaaaagatatgaaatccgaggagaaagaggaaatcacaaagcaaaaaaggacacattttaaaaaaggatttatatcagagttcttatatttgatttcaaacgataaaaggcagcagaataatatctataggttattaaagaagaagacagcaactcaggaatcctgtagccagtgaccatgtcattgaccataaggagaaaatattgttgtacaggaatccagtgaggattcctttatattatacagtctaagatatatactgtagaaaagattgaaggaaaaaaatagtgacctcaaatgggtcaagaatgtgggttggccgggctcggtggcttatgcctgtaatcccggcactttgggaggccgaggcatgcagaacacgaggtcgggagatccagaccagcctggctaacacggtgaaatcctgcttctactaaaaatacaaaaaactagctgggcgtggtggcaagcacctgtagtcccagctacttgggaggctaagtcaggagaatcacttgaatccgggaggtggaggttgcagtgagccgggattgtgccattgcactccagcctggataacagaacaagactcctcaaaaaaaaaaaaaaaaaaaaaaaaaaaaaaaaaaaaaaaggatctggggaggggggtgtttaaatctaatggatatgaataaacattctgcagtgtgtggaataagaacccaattagattcttaaaactgaaagctatgagtttaagggaaatctaaaatcaacgaaaacaaaatataagagttgaggttggcaggagagaaaagaagaaataaaaagtgttctaagtttccttatcaggggcaaggatgtgggcagcagagggtgggggcagagtgtgccctgaagggcatctaaaatttttgctttattgaaatgaggggaaaaggtagaaattaatcaccttggaaatgaaaaaaaattacctcttcttgggtattctctcaaaaatttttgtatttgactaaatatatgtatatatatattttagaaaaataattacattaagttgaaatatatatataaccttacattctaatatgtaaatatttgtatggcataagttctaaccataatagaaataagtaataaaatggtgattgttaaattatttcttcttggacattttaaacatacctggataatcgttgtatcaaaggaaaatcagtagtcaaattatataccatttagaaggcacttaaacagataattgatagtaaaaactatgaacaaaacaaatgctaaattcaatggaaaatcagctcaaaatgccgtaattatttttttaaaaagtaatggaacaccagaaattctcatcctaatgaatcacaaaaatgtaattaaattaagtaaattagtacagcattagtaaagtaaaagctgaaaatagcataacagcaagcaaatacagctagaaatttttaaaaatgcaaatctggttattttaaaagaaaaataaaaatgacaaacctcttgtaattctaataaaatagggaagaaaggaagtaaaaatactcctgatttggaataaggaaagagacataaccttagaaaaaggagagatcacaaaattaagagatgcttcatgcagttcttaaggaaattgattattttctagcaaaatttaaattgttaaatattgtccaaagagcagtgccaatcaaaaaatttgcttttaaagttagtattagaaatgtgattaagtatctgtatttggttgatggcaccaggtcagatggatatctgagttttcacttacctaaaattaaaatttatatgtgaatttaattgattctcaatgaacaatcccagcagagttttatgtttgtctgtgtgtgtgtttatttatttattcatttattttagagacaggtctcgctctgtggtccagaatggagtggagtggcatgcaattatggctcacaactgcagcctcaacctcctgggcttaagtgattctcttgcttcagcctcctgagtagcaaggattacaggatgcaccatgcccagctaatttttagtttttgtagaggcagggtttcgctatgttccttaggctggtgttgaaatcctagccaaagtgctgggattataggcatgagccacttctcagctgcttttttgttgttgttgtttgtttgtttgtaaaagaaaataatctggacattaactgcaagatagatgcctgagaataaccaaaaaagcccgaaatagaatagcagcaagggactgggacagggtgaagttttattagtagagttcagaagctaaaaacttctatgtcacattaatatggttttgcacaagaaaagaaaaataaattcttataacagagtaggtaagccagaagtagatcctaacatgtgaaactttaatacatgataaattttgggttcaactcgttgtggaagaatgagtattcaatggtggtgtggctactatatctccatcaaaagaaaataaaattagacctcgaagtgacacaacattcaaaattcggttctggatggagtaaagacttcatctgcaatctaggggaaaactagccatactttattatattttgccaaccaaagctatgcaagaaaagacagtcatatcttactatataaaaattaagttatatgtctatgaaatgatatttgctgaacaaaattaatagaaaaataaccaaaagattctccataatatacaaagattttttaaatttttaaagaaaaagataactaacccaggataaaaatagacaaaggatctaagtagacagttcaaggaagcaaaaatctagaaaatcatcaagtgaaagcccaatcaagttcaccagtcatcagggaagtgcaaatataaagtaacaatgagctatcacttcacacaatcagagtgcacaaaaatttagaagagcaaaaaagcctgttacggctgaaattcaggaagaagaatactcatatgcttgtggtgaaatgtacattccttttggaaagcaatcaggcaaaattcgatacaactagttacaaaccaggttccttacaagaatttaaggacaattaatgggagtttagagacaattaatgggaatgattgactaaattagaaaacattcatgaccagggatattatacaactatttttaaaagggtggggaggattagagctctaccttggaggaatttccatgaagtagtttgtgtgagaaaagtaagatttttttttaagtgttatattaaaattcccatgtacttcctcctccatgcatgcacaacccctcccactaccaacttccagtaccagagtggctgattataattgatgaacctgcattgacacatcattatcacccaagtccatagtttacattaggcttcactcttaatgttgtaaattctataggtttggacaatgtatcatgacacatatccaccattttagtatcacacagagtagttccactgccctaaaaatcctctgtgctctgcctatttatccctccttccctacaaatgtttggcaaccactggcctttttactgtctccattgcttgccttttccagaatgtcatatatttggaatcatatcatgttgcctttacagattggcttctttcacctactcatatgcatttaagattcctccatgtgtattcatggcttgagagctcacttcttttcagcactgaataatattccactgtctgtatgtgctaccttttatttatcagtttacccactgaaggacatcttagttgtctacaagttttagcaattagaaataaagctgctagctgggcgttgctcacgcctgtaatcccagcactttgggaggccgaggcacgctgatcacctgaggtgaggagtttgagaccagcctggccaacatggtgaaaccccgtctctactacaaatacaaaaattagccaggcagctgttcgggaggttgaggcaggagaatcacttgaacaggaggcagaggttgtagtgagccgagatcgcgccactgcactccagcctgagtggcagagttagactccatctcagaaaaaaaaaaaaaggctgctataagtatcaaaaaagtgttatatgatttaatttttacaaaaagacaaaaatctgtatacattatatgcgtacatgaacacacacacacacacacacacacacacacacacacccaccccagggatatgttctgagaaatgtgcccttaaatgatttcattattgtatgaacattgtagagcatacttacacaaacctagatggtatagcccactacacacctaggtgatatggtatagcctattaaccctagaccacaaacctctacagcatgttactatactgaatgctgtaagcagtcgtaacacagtgatatatatttgtgtatctaaacagaaaaactacaataaaaatgtggtattatactttgtggaaccaccattttatatgcggtctgttgtgactgaaacacagttatgcagcacatgactgtatgtataatgtatgtgtgtgtgtgtgtgtgtgtgtgtatagatactgtattagtctgttccacactgctatgaagaaatacccaagacaataatttacaaaaaaaagacatttaattgactcacagttctgcatggctggggaggcctccagaaacttaaaatcatggttaaaggcacttcttcacagggcagcaggagggagaagaatgagagctgagtgagggggggagcccttataaaaccacaagatcttgtgagaacttattatcacgagaatagcgtggtggacactgtccctatgattcaattacttcccactgggtccctcccaccacacatggggattatgggaactacaattcaggatgagatttgggtggggacacaaccaaaccatatcagatacacacacacacacacacacacacacacacacacacacacacatatatgtacatagtttaaaaatttatatcctttgttattttcatttttcaggagtttgatagaaaatgagtgaggaagaggtaaaagaaaaatcctgggacagtttttccaggacatatcaaggttcaaaaactctttctctagaataatatgcaaaatcatcaggataatattagcaaagatatataaaacatgtagttgcatatattttaaaaaacttattgaagatgcaatggattctaatttgtgtaagtaaatgagtaaaagcaaaatttcacattagaatgaatgaatctaagttttatagatagccacattcttagaaatgtcccatttgaggaagttggctgtaagtattcattttgtcttttattatgaatgatcaaataagattacccgttattcaaaaattgctatgtaggaaagatatgaaacatttcctgtcatcaatatttgaacaaaatttcccatcgatttatcaaagaaaacagtgcttttgaattgatatctgcagaattacaaatcatttatattgatgctttgttcttaattattgatgtctaacaatgatttaatttctcttttgtatagcttcacagtaaccatttcagtcaggttgtggtcattgacagacatatgcatataattagcgttatctattgttatgagctatcactcatatagtgcattcatatatagttgtattagtaatataaattcttgttcataaagtgaaaaaataatatgcttctctagctttagtgcctccaagtatattgagcaattattttccttaaggaaccacatttatatatcttctgtataggatttttaagatttctggaactttccagagaaaaagatgacatccaatatagtttttagtgtgtctttccatctgggttttcagattaatttggtttaattcaaagattaaagacagaaaaattggaccaaatggtggaataaactcctgtggaaaacatgcttctgctgtgaatattttttagattaattgatttttttaacttgtgactacatcctgtgacttcagtcgcagttaataactgattaatcataagcctatggattaattgcaccagtgcatgttgggaggtgagttagctggtttatgtcactagagaaactcgagtggtagtggagagtggactaaacaaatgcttccataatttagtgaactgaactcaaacgaagctatttagtgtataataactaactttggagtttttgaggttaagaaagcgtatgccttgatgtaaatataaggaagggtcaaaaataattttaagttttctagcctagaatcctagaagcttaaatgaaaaccttctgaaaaatagggacacacaactgataaaataaatcttggccaggtgtgatggcttatgcctataattccacactttgggaggctaaggtgggcagatcacttgaggttaggtgtttgtgaccagcttggcccagcatggtgaaaccccgcctctactaaaaatacaaaaattagccggggtagtggcacgcacctgtaatcccagctacgccagcggctgaggcatgagaatcgcttaacctgggaggcggaggttgcagtgagccgagatcgcgccactgctctccagcctgggtgacagagactctgtctcaaaaaaaaaaaaaaaaaaaaaaaaaaaaaaaaaaaaaaaaaaagaagaagaagaagaaaagaaaagaattgtaaaaaaattcatataaaaaatgtcgcaagacccttggggtgtcgctttgccagccagaaacctctgtggccagtggcacctttgcccaagttttgctcagtttcactgggtttgttttgccctctcggcctgttaggctgtgctcagcttgcgctactggcctggatctcacacctgtcaagggtgagccagccatggaacggtgagggctgtttgagcaaccacagggtctggccactgtgtacagccagacatgccagctgtagcggggtgggcaactcccggcatgggcgttggctccctgctaggccgcagctggagcaggcgtactgcaagcggctttcactgcagacactggggaacatggtggtacccagaatcttggagacgcgaggaactgcagagctccgaagagagtgtcacagctctggcttggggagctgctaggtctgggtttcccgaaggaccatggctcttctctgtttctgtcttctcttcttctcatcatccgcaatgtggcaagcagggaggcatgtttcagtcctgtttgtgttatagctctttcaatcctgccattcagaaggtcccgagttcttgtcccgcatccagtgagcatgaggtacaaggacaactacaggcgtgagcaaggcgaagaggagctttattgagcaatagcacaggtctcaggagacctgaagtgggtacctcctttcgcaggcaggtcatcgcagcatctgtacggccctcaggttgtcatgatgagtgtacagctctcagtggagaggagacccacagtgtgtagctcttttccctagggaggttatcctgttgtctgtcccagtctggctgagtctgggattttaatcggcttccgaggggaggaagtgcttgctgattggtccatgggcagccatgggcaaccctggaaaaagcaccataagttctcactttggtagggggaactggcagcctaggccccatgctacagagtccatggtttgaaggtgggatttcacaggggtcctgcccctttccgcccagccgcctatctgcctcttcatggcgccctggctgttcatgctagggagtgcctgcaggccggtgccgagtggccctcagccccatcttggcctctctgctgtacttgtcactacctaaagtccggaggtgggtgaggtagtaagaggctggtgtgtcagtaccgaccctagcatcatacacaccaggcctggtcttgacagcgcttgggctggaccacaactttgctccaaaattggagccagtgctgggagccgggagaggccaggcagtgggagcaggcacttccaagcatgcaggggcaggggggcttcacaggccaagagcacagggatgtccgggtccactgctgcggctgggtggctgcagctgtgcctgggatcacagggctcccaccccaccaacttggaagggggcaggaatcctgcctgttcccggctcccgcagtttccatggagtgcacagccttagctgcatctcccccactgcggtcgtcgtctttgcagcagccactccaaatggggccactgctgccatcaaagtataacactaaaataataattatttactaaaaaatagctatttcaaacattgggcattttcctaatgctccttatgttttattttatcctaggaatttaaatgcactcagcttaaggaaaaacaaactctctctgcttaatgaaaaacaaaacaggaacaaaacaaaacaagactctcttgatcacatgttgtcctctactcccctaactactttttttattttttatgtttttgttagagccaagtttcttgaaaggattatacccattaatctctccatgtttttacttgactttcactctgtaaagtacaggaaaatgctagacccatcactccactgacacaactctggcaaaggtccccagtgatctattacttgccaaatttaaagtcactttccagttctgttgtcttttcaccacttattctgctctccaacctctccatggctgtggaagtgctattttatttactattgatttgttttgactctacctctcttcttctttatcactttttccttagtcttttacaaagccctcccgcccaactgttttttttttttttttatttcttttcttttctttttttgcctgtacttagtgctgcccaggcctctctcactggtccttccctttttccattctgcatattccttgagtggtccattcccctccacagcatactgatgactcccaaatccatatctgtagcccagacttattttggctctaggtcgtgtacattgcaactggaggagctgcgtcaaccaaacagaactcaactttcttaccttttacaactcccatcccactccacccacagccaggtgaagttctctctttacgtttcatgtttcagttagtgcactgtctacccaactgccaaatccaggtccttagagaccttttttaactcccaccttttgcccagcccggtttctaatcactcacctagttcagttcagttaagcctcctctccatgcccattgtcacccttatttcaaagcccctgtcattgttcatctcagttgttaccacaaccttcttactgatctccttaccactctttttgccacccccaaatctcttctccagaaggagctaggatgatctttctaaagcgaaagcctggctaaaaaagtaatggaatggattttctttagcatagatggtgctactaatgatttggtccatttttgtttctcaaacatcataccaaattactattcctcaatacccagaagtcttttctagctttgctggatatctgatattggctctgatatctcagagctttatgtgtgctacttcctactcttcacatgtatacattactctatacttgtgaagaattttggcccctgttgaataataaaagtcatatgcacttaaaataacattttgtaattatttaatttaatatattatctggcatactctcttcataatttaggatttatttcaggcatcatcttttcaggtagcctttactgttctttccagaaagaaatagttgtctgtatttggcttacatctctataggatcatttagttaattgtgttgtgtttttttttcatcttattcatttatttgcctttttttgactcatgaactgtaggctacttgtaaactgagttatttacataatgcttaccatattgtagacatgtaaaatatgcatgaagataatgaacataaacattttagattaagatatatttgataatactcatcgtgttacatatatactggcaaattacttcatttctctgaaacttgactcccaggacattaaaagagacgaggtttctataaaaatgaaattagttggcatatgtaaagtttcttccaaacatcctggcccaaaataggtattcaataaatattaggcatagcattcattagttgattatttgtacaccatgtcctgaacacctacatgttgagattaatagaaactcaaaaaaatattgcaaagtaaaactgggcaagtagataattcttataggtatacaaagaaaaaccatggaaaagttcagattgtcttggaacatttctcttaccattacatcaaaacctatgtcaaatttttcataccacaaattcttttgggagacaattgggagacagttatttctagagttgaggaaaacagcatatattacattaattttcttaaactgactttaatctactagtgtttggcacatttgatcagccaaaaaaagtttcaagaaaattagtttagttataaaggggtagctactgcatttaaatgaaaaaacacatttttcttaattattatgatacatatcaatttccttgctgaaaactgacattgactatattcatgacagattaatcttcctttatattaatttattagattattgagtgtgcctattatattggtttttaagaatataaatataaggtatgagtcctatacacatagaaatatattttataggaaaccatattgttattgaaatatatttaaaataaatacatatcaaataagataattatttacattactgtatatatgtgaagaattttggccccagtttaataataaaaatcatacacttttaaaataatattttgtaattatttaatatctagatatttgaatttcacacatttagcttataaaattaaatttattttaaagagataaatataaataaaataacaataacagaagagagttcagtgtggttaggtaatattatcagggtcataaagtatgaaaattgactgttgaataaacatagagacatattttatgcttcctgaactacatttaaaagctagagaaaattatgaatagtaacttcaagtccttatcataaaactctgtagcaggtgctttttcttcctggaagcgttggaagatgttggctctccagtcagcccttctaatggagttgtcctcagctggcaagagccacctcactgtgggaaatgctaatgcagtgaagcatcaatctcctttgtaggaaaactctgcagggccactctgaaaggccttctcaactgaacagctccatctgacctatttggaagtaatgcagcacagttgaactcattccactgcctaatccctctttttttaaaacactactacatgagttgattctgagggcactctccaacaaacttccgaaatgcatgtcttcgtcaaagaatcagatttccaaagaacccattctaggtgatctgaggaagataactttaaaatggaattttagaggtggatcactcagcagccaactagctggctgcagtgagggccccattgctgttggcaggtagctactgatagctcttttttttttttttttttttgagacagagtcttgctctgtcacccaggctggagtacagtggcacaatctcggctcactacaacctctacctcccgggttcaagcgattctcatgcctcagccttctgagtaactgggattacaggcatgcaccaccatgtccagctaatttttatatttttagtagagacaaggtttcaccatgttggccaggctggtctttaatttcctacttcaggtgatccacctgccttggccttccaaagtgctaggattacaggcatgagccaccacgcccagccaaccacttatagctcttgattgctatagtgggaagttgttaaaatcttcacctgtgataaggataggtattgaggaaaggtaatgccctgtgagttcaatatttcaggcttctgaggaattcagaggaaagtaataattataaggacaatggaatcaggttctgctgggttccttttacgcagtggagaaaaaaaatgaaaggctgagtgtaattaatcatcacttgaccgtggtatgtgagcataagacctctttggcaaaatacaaagagattcttatcttctgcagtcaaaggtcataaaagcagataataaggcttaggacttatttaaaagtataacagaatttcaagaggcctgcatcctcagctatgccagagtctgaaccctggttgggaacaaggggaatcttacgggaggttacatctgagtttatggactccacaaccttgaagtctcaaattatcctaaaccatctggacctatggaagttgcctattcctcctaattagaggcagtcatttccatcttgcttgaagatgatacagaaacctcttcccttggaggtaactcacacccttctcgggatagaaccccacttccattctggccaccagatccatatagggtcaatagatgacattacttggctctggaattgttgggcttctaagacaggaaaaagattatgctttaaattagctatagacctcagccaggagttagggaagtatgtatggagctagatgctgaggctgctggatgagatgggatggagaataagagattgaataaaattgaggatggaaaataggatcaagtgaggatagtgacacagattattgatatgggaacattccaccatgatacaagatttaacacttagacaaggacagcaggaaatagtgttatacactgctaggatggctcttggaagcttggggaaagcaatggtctccactaaataaagtataaatgcccaaactgctgtgcagacaatgaaaaaaggaccaaatgactcagagaagtgggaatgctaaagtgaatatgtcatataagttccagaaatatcatcagctcactttttctttgtaaaggcttggagaatacctccttgactaaagcagtaagaatgtgctgatggctgagacacaagcatcattaagaagctcagtggtgactggactgtcctctgtaggcaaatgttgatagcagtagatgctattatagaattggcctctctcgtaacagcggggatgacaggttttcaaaataatggaggctaggaggtagttcttagttgtcacaagaaaaggaggcacacttattttttgttttttgtttttgtttttgagacagagtctcactctgtcccccaggttggagtgcagtggtgtgatcttggctcactgcaaccttcacctcccgggttcaagcaattctcctgcctcagcgtcctgactagctgggactataggtgcctgccaccatgcctggctaatttttgtatttttggtagagatgggtttcaccatgttggccaggcttgtctcgaacccctgacctcaaatgatccacccaaccttggtctcccaaactgctgggattacaggcatgatccactgtgcccagccaggcacatttatcttaatgaatggcttgttcaaatatatctaagactccagaatcacagagagctatggagatggttaacagaacacagcatctctaggggaaaataagtggacagccaagaaactattgcacaatctacacaaattaaaaatgggtgagtaagagtctgcatatggctgtctaatgaaaagccacgatccttgtccaatttctgtacctgaggcaattttcagattttgagctcgttgactgaaaacttcaactgaatcaccagaaagaaccccgaaacaccatagcaaatgtatgtggtaattattctctcatttctttctataaaaaacctacatccatttacttgaataatcatacactagggagaatggactcctgagatactttgagaaatgtcatacacaggatccagattgacctggatatcagtattctggagtgggcacattgccatggattatctggtcatacgtactacatcaactaaaaatgccaacttaatagagcgatagaatggccttttagagagggcaattgagtcttacagagaaaatattcagtaaggagtgggtgctaccctccatgatgcagttaaattctaaatcaatgaccattattatatgctgctttttctccttatagaataccaggtccaagaaccaagaagtgacctcactatcatcacatccagtgacctactggaggattgctttccttcccgcaactctgggctctgccagtttagaggtcccagttcccagaaagggaaaaagcttctattaagtgacatagcaagagtcccattaatctttaagccatagcatcaactcagtaactttaggcttctgtgtcaggaagcagcagacaagaggagtcactatcctggtgggagtgaccagcctatatgaggctgttggtaggactgttgttacatagtgaggcaggaaacagtatgtttgatacccagttaatgcagtgagtcatttctcggtattctcttgttcaattttggtcataaacagacaagtacatcagccttggtttgagaagatattatgatcaagggctcaaatctgacaaaattctagtaatgcaactaggtaagctacctataccaaaaaatgtactagcgcagggtgagaggaatctagaatggcaatagtagaaggagatgatggatatagtcctactatagttccttttgaaagttttcccagaaagagactaaccagagtcttggaatagcttttcacagatagatttatcacacctagcaagtagatctgactggatactgcagtgcaccagttagatcccttccccagaactgaagcactcattcctcccgctgctgagagtattaacagatgattgctatcaggtaaaattgctctctctagaaataagccaaacagagcaggccctcccaaggttatgtctcctagcgaggagtagcacaaattgaatgacctgttgataggggaggtggtcggtgtataaaggcttagcccctttgcctcagggcagggcagctttgaggggatatcacagctcagagagttctgcaaagctactgagaccttttgtagttcaaccctccccttgatcagtcctacttctttcactctctcatatgtgttgatctgtaagatacttcccagaaccatttctgcgcacacatctctgaatctgttttctcagaaacctgtcctaaatcaaatacaaatattcaatatatatttagtaatataaagaatatatattaaaatagatttaagtgatatgtgtgtataaattacttacattatatattattatatatataagtatgtatatctacacatgggcatacatgtgggcacacacaaacatacatatataatctcccttaaaattgtatatttttagctgtgccatcatttcacttgtcttaaacaaatcttgttttggcatgttgtttttaaatctgaaatgcaaaaaacacttagaaatttctaaacatgagtcaattcaacagataacctagccaatactataagccattgtcacaaaattagaatcttgaaaaccaatgacccaaaagtcatccagaccagggaagaacaggtttggtttattcctgactgagtctgttgacaccaccacttgacaagaaagagctggggatacatcaagaaatgggtgttggaaagtacaaacctattaactgtttggaagtcatcattgttacactgtttaccatcaaattctgttttgttcctgagctttctgaattcagaatttaatttttacaacacatacagctcataacttctaaaaatgagcctgtgactaaagagattatgttttgaacaagaaaaaaagtaaattgtttacaattgaatcagagtatcttttatcaagtcactaaggctaaattcaattaatcaatatatatgatgtatatgaaaggctaatcaccaaattaatgaatatttgataggttttaaaaatctcaaaacattttatgataatgatgctggtatccctaaatatccgaacttaataaaaccagacagcatatatcgctgcacagctaatagaatgaatttaaatggaaagttcctttaagctttaccaaaaagcagcagttgttctgtaaatttaaactactaaaattagaggcctttgaggtagctgtgaaaatattctgatgttggaagaaaaaaagccctcagaatgttgcaaaactagaaatcaaagtagggctgtcaagtgaatcacatttgaaaaaaaactttttaaaaaatggggaaattttggattctgttctttactttgattctctaaggtagctattacttcactactttggttggcattttattatgttaacacatcagagagaatcttttctaaggaacaatgtcttttaaatattcagggtagcatatgctcacacacttcactattcttatgtccatataaatactgtaggttatttccaggcctttgttaaagtttttgtcatgtagaagcatttgatagtctggacaatgggcaagtggcattttacctatttataataagagttgaatgtattatgaattggtgaaataaaaacaagaaaacagcatagaatcaataggagtttaaatgagactccaataatgatagtaatattattaataatagtaatagccaacttttattaagcattcattaaaagtaatgtcaaaaactgaaattacttttgcaccaacttaatactatgtgtccagggctttatggactatctcatttaatccttcaacagcctaaataatatggtatcattatcattccgatctgctgacaaggaaattgaagaccccaaagttaagtaacctttcttggttataattaaaaggggtaaagctgggtgaaggtggtaatgaacacagcaggttttgcatcatacttaaagtatatactaagtttatactagcacatggaactaaaagcttgctgctttaagggaagtacacttttaaaatttatctttcgcttaagaaaagaacctggaatatgccatatcaggggttggcagattatggcccattagccaaagctggttgaggagtgtctgtatttataaataaagttttattggaactcagcaacattcattattaatttacctattgtgttttgctgctttcacactgcaatggtagagatgggtagttgaaacaatcatttgaatcacaaagcccaaggtatttatgaattgacctttttcagaaaatgctgagcctctactgtacagtctttctttaggatacatgcaaaatgacacataattagttccaatatccagtaatagaaacaggagtgccttttaataatgccttttagcactcttcaaattaacaaatataatctggaatataaaatttgagataacatttagtcctgtgcaagatcatattttggtactatacatattctaatcatttgtaatttttaaattatttttaatatataagttataaataattggaaaaagaagtatattaagacaaagaggtctagtatagtagttcacgcctgtaatctaacactttgggagactgaggtgggaggatcgcttgaagccaggagtttaagaccagcctggacaacatagccagtccctgtctgtacaaaaaaaaaaaaaaattagccgggcatggtagcacatgcctgtagtctcagctactcaggagactgaggtaggaggatggcttgggttcaggaggttgaggctgcagtaagctctgattgcgccactggacttcagcctggttgacagagcaagactctgttttaaaaaaagaaaaaagagaaagagtaagtcaagcagcctgatattaattttttttttgtcactgaggttcattgttttggctaagctcttgaatttgagtgttgtaaatttttatctctctcatggaactctgttttatgtggctattgacaaagagttagaaatatacaagattaattttactatatccacaaatagagatactaatatacttcttatcattggaaacgtctttgtaaatgaattcaataagctgagtgaaaaaaagagtacctagtggtaagtaatacaatcaatgaggaatatgcatttttggttgggttatataagcacaatactttaaaagtcatctatctcataacattgccatttggttgtttttatttcctttagatttggatgatccagtagtaactgttcatcaaagtataggtgaagctaaagaacaattttactatgagagaacagtgttcctccggtgtgttgccaattccaatcctcctgttcggtatagctggagacgtggccaggaggtcttgctgcaaggatctgataaaggagttgagatttatgaaccattctttacccaggtatgaattaaggtacagtatttccaccctactctgctaggatactttcctaattcaggcagcatgaattcatagctatttgaaaagatagtttctctattctggcctttcaaaaaccaatgtgtgcttgacttaaagattagagaacttaaatataaaggacaacttatttttatgtggttagttaaatttaaaatgttaacttttgaaaacattttttaacttactatgtcctaacttttttttaatctataagttttcctatgtttcactataatgtacatagttatacattttgctagctgatttgggttttgtggaaagtatttctcaaaaggagagattttgatttccccatttgcaaatggtgaataactattaaaaaaatgaagaaacttgtttgaaatttatttggctttagttttaggaaagatatgtctttaatttcctttagtcatgtttgtttttgacttggtttagaaatagagctttaattatgctaaaaatgaaaatatttaacgagtcattaaaaatgtatttaataaaagttgaattaattttacataaagtgagcgtaatatgaaatattcttgtgtaatacacaaagagtaaggaattaataagtcctgaggaagatattgaaattcgtgggaatatttgcatgctgttattataaaggttttttgatgaaagaagcataaacctaaattaacaatgaaaaagttttaaataaaaaaaaatttggacaaatgttcaaaagtattgtgataatgaaaaataattttaaaaattatataaattggctaggcgtggtggctcatgcctgtactctcagcattttgggaggctgaggctgagatgaggtcaagagattgagatgatcctggccaacatggtgaaaccccatctctactgaaaatacagaaattagctgggcatggtggcacgtgcctgtaatcccagctactcaggatcccatttttcaccattgaatatatttccttatatggtaaactaaggcctgagatccttcagattagtataattgccaatatttagacattaactgtggaataatgcagtgattatatgataacatctgcacacatcatatatattcctgttttgcaaatagattgtaaattaaaatatgtattctttattttttaaaaggtatagaacagttttaacttaccaaaatataaatctctggaaatcagcatcgcacatgtattactagtcagttcaccataacatagtactgaaacgaagcctgttctaatctgatcgtctcttgatttaggccactatgatactaagtgttctctgccagcaggcaggactgaattttcccccatacattccgcagtactttaatgcattctccaattgttactaaaatgatttttttagtttaaaatattatccagataaatgatcatctattacatattttatttttctattgtcaatttatttttaaaatatggacattaagatttagaaaacatgttttcctctagaatcttgtaaaacatgataacatttatagataatgaggaaattctaaacatcttttctctatatggctatttctttttgtttgtttgtttgtttgtttgtttgtttgtttttgagatggagccttgctctgtcacctgggctggagtgcagtggcatgatctccactcactgcaacttctgcctcagggtttaagcgtttctcatgcctcagcctcctgagtagctgggattacaggcacctgccaccacactgggctaatttttgtatttttagtagaggtggggtttcaccatgttggctaggctgatctcaagctcctgacctcaagcaatccacctgccttggcctcccaatgtgctgggattacaggtgtgagccaccgtgcccggctatatggctatttctaacctgcaaatgggtctaatcacttggaaatgaacacaggggccttggccagattttggaaaatctttcatactatcaaagtatttaggaatttattttaaatttattaaacaagcacaatcaaacttttaaaaaattgatacattgtaattgtccatatttatctggtatggtgtgatgttttgatacatgtctacacattgtatcataatcaaatcagggtatttagcatatccattacctgatacatttatcatttcttcatggtgagaacattcagaacattctcgtctagctgtattgaaacatacaatacaatattgttaaatagtcaacttattctgcaatagaacactagaatttattcctccaaagtgtaactttgcacctattaaccaatctctctctattctcccttctacctccctctctctaaccactgctaatgattattgtgctccctaattctatgaggtcaacttctttagattccacacatgagtagataatatagtatttgtctttctgtaccttaattattttacttaacataatgtcctccagatccatccatgttgctggctctgggacagacccatcatttgcagcaatgtgggtggatctggagaacattatattaggtaaaataaacactcattattttatagctgcattcattatttcatagctgaatagtattccattatgtacatattccacattttctttatccattcatctgttgatggacacttaggtttattccatattttgtctattgtgaatagtcctgtaataaatatggaggtgcaggtatctcctcgacatactgtcttaatttcttttggatctatccaacagtaggattgctggatcatattatagctctatttttaattttttgaggaacctctatactgttttccataatggctgtactaatttgcattcccgccaacagtgtataagtgttcctctttctctgcatccacaccagaatttgttattttttgtccttttgataatagcattctaatgggagggaggtgatagctcactgtggttttgttttgcatgtccctaataattagtgatgttgagcattttttcacataactgttggtcatttgtatgtattcttttgagtaatgtctatttacatcttttgcccattttaaaatgagatttttttttgctattgagttgagttctgtgtattttctagatattaacctcttatcaaatgcatagtttgcaaatattttctcccattctgtaagttgtttcttcactgtgttgattgtttccattcctatgcccaagctttttagttcaatataattctgtttctctatttctgtttcagttgcctgtccccagaccaatgtcatgaagcatttcccctatgttttcttctagtagttgtgttatctcaggtcttacatttaagtcttgaattcattttgagttgatgtttttatatgcggagagatagaagtctagctttacttttctgcatgtgaatattcaagcttcccagcactatctactgaagacacattgtccattccctaatgtgagattttagcacttttgttgaaaattcattggctgtaagtgtgttgatttggttatgtgctgtctattccattccattggtctctatgtctatttttatgtcagtactatgctgttttggttactatagtattgtagaatattttgaagtcagatagtatgatgccaactttgttgtttttgctcaaaattgctttggctgtttgggatcttttgtggtttcatagaaattttggattgtgttttccaatatctgtgaagaatttcattggtattttgacaagattggattgaatctgtggatcactttggatagcacagacattttaacaatgttaattcttccaatccattaacctgtgatatcttccaatttaattgtatcctcttcagtttttctcatcgatgtttgatggtttgaattgtatccatctttcccctccttggttaaatttatttctaggtattctttagtttgataatatggcagaggccttcttaacactgaggactcatcatctcagagaagccatctatgaaaagctgatatgatgtctcattccttcctttttatacttccatattgggttactctttccctgtttactttatcttttgcttattgtgctagtgtttttatgcctctctctccctctctccatatgtgtatatatatatatatatatgtgtgtgtgtgtatatatatatatgtgtatatatatgtgtgtatatatatatgtgtatatatatgtgtgtatatatatacatatatatacacatatatatttgtgtgtatatatgtatatataaccttatataaacatatacatatatacttcttagatgttattgatttcttgaactactgtttcccatactgccatgtgtactctataatgaaaaaaacttttatgttagtattgtttgtattggagcacttcaataatattttaatttttaaatttatctccttaggttgatagtcattgacctttgtggcttcatgacgtaaataagattcagttaaaataagatctagtatattcaagatatgggcataccttttccagagacacagaggtcactaggcaaggcttctcctctaatgtttgttgatatataaaggaaaacttaaggtgatcaataattatgatataaaataaaaatcgttgtctaaatagagctacacaacactgctatggagggagcactcaaggtggagacattagcacatgcaagtaatgcagaagaaagacaatgtctccaaagagtatctgtatctctggttagttagaacaataattagtatgtgtggagaacagggaactgtgaagctgggaagtcatactgggtatatatggtggaagggttcagataatagatcatatgtctacttaagttttaatgttagaaaatgaaacttcttttgaagatatgttttcaataataatgttatttaataataatgtcttgtttttaataaaatagaatttctaagatgagatatatctattttgtatacccattcattatatgttaataactatagcaatttgaattgaatatttattcctgaattctgttgagtgacaaaaatcttgtttatacctttttatagacaatgtttccagaaaaaaattggtctgtgttcctaaagctgatatgaattcataagcacataatgcagtatttctaagacgaataattatacttttcgtccttccactcacttactactaaaagacataggccagcatatatcattttctatttataaatttgtaataaattagtcattagagcttcataaaatgaatctaaattgacagactttagtttttactgatatctaagtatcaaaatgaatgaatataatttttttaaagttctagtttattttataagtaatatggaaatacggcttgaggctgcttcattacagcaatgtcagcattggtaagggccactaactaatatacattgtatgtcttccttttatttcttttgttaaaaaataatgtcaaaagttaaatatatgtattgcagataattttgtaattgtttaagaaatgttaaacaattgcttaaatcttacaaattgaaaattcactttccattagtctagaacttttgtaaagatgttcatgacatcatcttgtgtattgtaattataccatctaattacaagactgaacatatttacatcaattacctaattagttataattagtctaattagactaattatacaattagacaataatcaactcaaaattcctttttacaaatcatgaaaattcacttgcaaaaagcctcccaacacccaaagtatcaaattcaaatgatcaacaaaataaaattaatgttaaagtagttataaatagtaaagcctaaattatactcattatcacaggtatacatatatgccatttgataacattaatctatgtgtgcacatattctctgctttcttatacattctgctgtattgttttaaaatatttttattatatgctgactgtcatgaattaagaaggtaaggctcaaaattttccataattctgttattttaaacaatattccattaacagacttcatctgtattacccactctcccattggcatggtatatacattaatcttacatattaacttagagaccatgttacctgggccctctaggttcacatatcttggtatcttgttttctgactgcaggaaatcattttaactcacccagaacaactctccaatcccatgatagctgaaccattgggaaatcatggctctagaggcttttctttcttttttgtctattctttacagtccattttgttattgtgttctgtgttttgtgttgccatataggaacacctgagattaggtaatgtataaagaaaagagatttatttggttctcagttttgcagactgtacaggaagcatgatgtggcatctgcgtctggtgagggcttcatgctgctttcactcatggcaaaaggcaaaggggagctggtatgtgcagagatcacatgatgagagaggaagcaagagagagagggggaggtatcagatttctttttaacaaccagctctcaaggaaattaacagagttagaactcacagcccccctcaggacattaatcatctattcatgaggggtctgcccgcatgacccagatacctttcattaggccctacctccaacattgggattaaatttcaacatgaagattagggacaaacatccaaactatagcaccttctcctatgccaattttgttgctgtgctctgaataagaattaactaggatatggatgtgcataccattgtatttatagggccacacttgtaggtctttaaagaatagaaatcatctcaaacagtagcacaaattctcttttgtaatatcaatattaccaccaaattcatattttttacctttagataacataaataccagcagtgtccatgaccaaaaaaattcaggtatacaaaatattttaaggatgcatcctttacaaaagccacctctgcattttaatggccagagctgcattgatgttgattctctgtacttgattattgtatatatttcccttggggcttacctttcttttacattctcttttccataattgactgttcagctctgctatgggtggccccaaatgcagcttcataaatctatcttgcaggctaccctaatgtaaagatttttaaagttcctattactaccattagagtcaacatggttcaggaagcttactaaaaccttactgtgtgctctattcctatctagtcagcaatcttttctgagttgacaacatgcaaaacactgcccaaatggtagggaagagaatttgaagtgatctcattaaatggaaaggcaggatcaatacatagacataatgtaaatgataaaaacatatataaatatatacacaaatgtgactgatataaatagacaaaagcattaactcaaaaagtaaaggagaatacgtataggaagaatacacttttagaggatggatcagaagtaagagcttttaggttgaaatctcttcatattgaggctggtgcagtggctcatgcctgtaatcccagcactttgggaggccaaggcaggcagatcacttgaggccaggagttccagaccagcctggtcaatatggtgaaatcccgtctctactaaaaatataaaaattatcccagtgtgatggcatgcacctataatcccagctacttgggaggctgaagcatgggaatcgcttgaacctggaggcagagtttcagcgagccgaggttgcgccactgcactccagcctgggtgacagagctaaactatgtctcaaaaaaaaaaaaaaaaaaagagagaaaacactttcttgaaataatggctgtcagataaaattcaaaaagactggagagtagagttgtttggtgaaatggagaattagggttggtggaaatcaagtttgacgtatcttccaagaggagaaagcaagccttggtgaaaaaaattagaaagaggagattagtagcgttaaacacagaataagtaactttagaataaatataaatctgcgatcatagcccctctaatatgaccttttccaagctttgaaatcttatctcattttatgctctttgttgcgctgcactccagtcacaatatattttttgaaggacacatcagttcagataggaacaaaaaaatgactcatagcaaggaatggggagcattaggaaatcataaagagatacctcaagatagtgacataactaatttgatgagaatgaagagtttatgtgaggaataaggaaaaagtgttttgcttagactgcatagagtctcaaatgacaaactaacggtttttgaaatgacctttcagtgaaggggaacaattcaaggttttctagcccttaaaccttgaccccgcccaccccctgaaaaaaaaagaaaagagaattagaaatgcagcatagattatcttaagagatccaaaaggataagagactacatttcttcttggggaaaatgttgagtgggatagaccaaaatttaagtatgtcctataatgtatgctagcaaacattgcaactccaaggacaagaaaaattaggataatctagaatttattaattataatactattggtgatttttagtaagtttgctttttttctttttgtctagagatttgtcagttatctatacattagtgctcattggaaccatgataatggatcagatttcactaggaatatattagtaaaaggttgcagacttcagtaactagaatattcaatggtaaaacaaccaagaaatgactaaattattatatctgtaattaattgcctatatacgaggagctgtcacagtagtaaaggtaatctaaagtgttagaaataagcagagaagtatggaagcatacaaaagaaaggtttattaaattttaacaagagatcatcatcattaatgaaattactaggtactatttcagtggaatgttggaaaagtattattcagaaaatgcaaattgaaacagaatttgtcagtggaaacagaaacaaggactgacagagtataattaactctatgtgagtaaagagactttattattaaatatacatctaaatgacaatgttcattatttgtttatatctgagaatcattatcactccgtggttgcttttagaatattgactacatgcagtaaatctttcagaatgattagaggttggttatttttggagtaattatgtgtgtgatatatatatatatatatagtgtgtgtgtgtgtatatatacacacataaatatgtaattgcatgtattatatattgtttcattatatcatcatatatatgtaactgcatgtatctgtacctatatatcatcaatatctatatccatgtgttttttcagttgtaattctactgattttcatttgttttatttcttttgatatggctcaagttttgtcttgagttttgtcctgataatttgtcttcagttcaaatttccttccaaacctaaaagcacaatctagataaatcattactagagtaacagacccactttcttttttacaatatgcacaaatatctattgattatctgtaataatgtaagggaatttttctcttaagtgtatttaggctctgattatattttactcatttaattatattgagtttataccagtgccaaacaaatagtaaattctggagaaataaatatatataaagcaaaccttgggtagttacagtactattaactgaaaaagtattaacttaaaaattgtctcctctctgctaagccctgtgtcacgtgcccagaatataatgctgagagcaagacagacataatctctactctctgggtacttactggcaaagggagaagtctggcaaggagatggcataattagatttcatgtatttaacaagtgaataaaaataattatgtgaggttatgtatatgttaattagctcgattgtgatgattattttacaatgtatatcaaagcacagttgtataccttaaatgtatacaattattttgtccattatacttcaataaagctgaaaaaaatattggttaaagtgtaaatcattgtggcttgcttgcattcttaagctatactaagtacaatcatgagttttttagttgattgtagggtttagagcattatgattaaaaatagatacaaagaataattgggattgaacatgagtaaagatcaataaaaggatctagctgagagacagagatactgaatgtatgaataagaagttataattgggtgtaaattcccattattacagaaggaggagtaggtttaaaggaatatatttgaagttcaatttaggatatgttgagttcagatgtgtctgaagtatcagaatggacatattgacaaacatttgttatgtgtatctgaaacttaagggagaattctggaaatggggcttagacttgggagtggggcaagaaaatagagcttgtagtagaaattcatcagcaaggataatgccacctaatgaaatgttataaagtgaggttaactatggaacaagtagaattccaaggaataacactagtcgtattgagaggagaaagaaaagcaaagaaatttgagcaatacgtgtgacaaaggtaggagaggtaagatgtatcactttatttaaaaattatctgagttgactaattctagcatatcattttctttcaactgttctttctagctaagcccactttctaggcattttatatcatgtatgggaattctgtaacacaagagaatagttttatatataaactctagaaacatatagatttatgtgtatacttgtatcggatacatttatattttcttgtaagttaaaaattcagtgtttcttctaaacaaaaattgaaaggtagtttttttttgtttgtttgttttttttttttttaccactgaggaaaatgctaaaggggtgactgatttaagactgaatttggacagtgaatgaaaatacttatggccacaattccatgcacactagaatagagattcatttgacagatttgcaaaactgtgtgcctatgtctgggtaagctttcttgcaaatgaacagcagtgtttttatgtagtaagtcactaagtattccagtcctcctctataacatatgaaagtattgcaagttttagaactcgacaaatgttacccaggtaaagtgatgaaacacattgttccgtacacacgttatctggaaaaaataaacattttgaatttttatagtatccctaatactataaaatcattgagacactgttttgccattaaaataagtaagttatttacaagaagaactattttgagatgatgcattaatgactttagaaggcaaagaaagcccaggggacctaatttgaattgggcaggagactacgttttgttgtttgttctttttttcctttcaacaatttcaatccaatgtttttacaaagtctttcttggttcatcaagagtttgttagatacttctggccacttgcttgatttgcatctatctacagttgtgcagatttacctggagagttaccccttaaactcttgaacatgaaataacaagaacaataataatatagaaacactcacgaatgcttctttccttcagttttagatctgtcacctgtcattgctccatatacaaaatatttatgtttataaatgtaattatctatcattagatttacgtaattaactttgttctaacaaccgtgtttcatttgttggcgcttcttcagattcttttcttttgtcttctcacatcgatgtctgaatagattgcagtgtttgttgaatgcactccattattaagtacactgctctgatctttgcataataatttgcataactaccaccagaaatagacttttcccctgaggaagctagtttgcaaagaaaatgttatgaattttcattgtagtctgttagtttttatctccaggcatacttaatattacagtattattttaaaatgcagtgttattttaaagttagttcatttataacttatttgaaagataggacatttcccttaaaaaaagacagtctgtcatattctgataataatatgatttaatacaatgtaatgtgatgtgatgtttcattcattctggttgtgttggctttttctaatgacttttattttttgtgtacattttcagggtgaaacaaagatcttaaaactaaagaatcttcgacctcaggactatgctaattatagctgcattgcttcagtgaggaatgtatgtaatattcctgataagatggtgtcgtttagactgtccaataaaacaggtatggaattatctctgtatgttacatgtatcttatctacaactaatgtttaaaaactctctttaacttttttaaagaccaaatgatttctacggtgtatgtaggaataagcacctttattcccagaaaatcctgggatatctgaaaagcttcatacatggacacagtaaaatgtcattgtaatatactccatgtaatatgtttacgtgtataacatacaaaattatagctctttaaagtattgcattctaaaatgtcactaacgagcatatatcctgttcaaaaatattcttgagaaatactagattctacatataaaaattcgtgattgaagttgctaaatgagttttgtgctttcaaagttaagtaaaagaaactttcttttactttgtgtcaagtcaagaaaactaataggtaatttcagatagatgtttttagaacaatatttttgtagaaaatgtgaaaacattaataggattgaaacttaagttagcctttgttcaataatatagaccccagaataacggtaaacatatttagaagaaattgataaatgaaagagcaaagagaaggtatatgagaaaaacatattttgtatgaatgtgcataaagaattactttaataaattaaaatttgaactggttttgagaaactccaatttttcatatcaatataaatttttacatatatatattattatactttaagttctagggtacatgtgcacaacgtgcaggtttgttacatatgtatacatgggccatgttggtgtgctgcacccattaactcgtcatttacattaggtatataagtttttacttttaagtaactatattagactaaagatttttaaagacccttttcccattaaacaaaaatctctaaaagtgtgggctttttttgtgtctgggtctagactctgcttgtgccacttactagcttttgcaccttgttgagcaagtcatcttactcttctttgcctgatttcctcataaactcatgaagttgtagaaagaattaatgagtggatacgtataaagcatgtgaaacacactttattagttcttccaacaaagagctggtcagcaaatccaactaactcagttgataaaaagattaaacctaggactttattgtaaaatatattttaaaaagtcaactatgacattggttcatcaacatgtgttccatcgagttgccaagatttcaaaatgttcattgttttatacatttatttttctattcatcagaaacttattgggaccctcctatggttcagcaatggaggaacactgattttggctaagatttaaattgtcttaaactagagaatgctcgaaaaacaagcaatgggggaaaggattccctatttaataaatggtgctgggaaaattggctagccataagtagaaagctgaaactggatcccttccttacaccttatacaaaaatcaattcaagatggattaaagacttaaatgttagacctaaaaccataaaaaccctagaagaaaacctaggcattaccattcaggacataggcatgggcaaggacttcatgtctaaaacaccagaagcaatggcaacaaaagccaaaattgacaaatgggatctaattaaactaaagagcttctgcacagcaaaagaaactaccatcagagtgaacaggcaacctacaaaatgggagaaaattttcgcaacctacttatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcgtcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctccgggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaaggatgagttcatgtcctttgtggggacatggatgaaattggaaatcttcattctcagtaaactatcgcaagaacaaaaaaccaaacaccgcatattctcactcataggtgggaattgaacaatgagatcacatggacacaggaaggggaacatcacactctggggactgttgtggggtcggggggggagctatagcattgggagatatacctaatgctagatgacgagttagtgggtgcagtgcaccagcatggcacatgtatacatatgtaactaacctgcacattgtgcacatgtaccctaaaacttaaagtataataataaaagaaaaaaaaaaactagagaatgctctatttcgtatagttaaaagtcattaaaatacaagaacaatgagagaaaattaaactttatcaataatcataagaaatagttgatggaggctgggcacggtggctcactcctgtaatcccagcactttgggaggccgaggtgggcagatcacgaggtcaggagattgagaccatcctggctaacacagtgaaacctcgtctcaaaatacaaaacattagccgggcatggtggcaggcgactgtagtcccagctgcttgggaggctgaggcaggaaaatggcgtgaactcaggaggtggaggttgcagtgagctgagatagcgccactgcactccagcctgggtgacagtgagagactgtctcaaaaaaaaaaaaaaaagtgatggaaattatgttgcagaaaaaaatagaaatataaaatcttagtggacttagcacttataaaagttaatctcatctgacttaaaaaaggggaaattggatattgagaaacaagaataaacaggttaacatataagaactggttataattatgttattcttcatggcatgaaatgtattgtgccttataactaattttgtttttcttagcttctttaatttttttgaaatatatagatacagagaaaattaaaaataaaatgaaagtatggcctatgggatgaataaaagaattactatggaatgaggaagaaaaaaacactagtatatattattaattaagttaccactttgcactttagcagtgccttattaatttttaaaatctttagtgtttttatctcagtttatttttataactataggaacataaacaggtagatttttcttgtcatgtatttttctatcatctgacacataatgaactgtcctgcagcaattaaagcatcctcactggattgttttgagaatgaactaaattgacttatgcaaaaattctttaaagacaaagataaccaataaaattatatttaatatttttatgttgtagatgtgatttttatcattttccaaggtcccacagctcataaggaatggggactagattgactccagtgtttgaagagttattctaaataggagactgacagctcttcttagttttcacagagatggagaaaatgaacttaaatctcagccagagtgttttgttaggaataaataaggacttcataccttaaagccaaaaggggaagattaccaggaaaagtgatagaattcctgagatcttttaaagtaactggatgactttatttctgtgattattaaaaaaaaaaatttggcttagaaaacagtctttgaatacctgttctatggaggtcacaggagtgctgtactagagatactttatttaacctttcagctttatgttgcattttttatttttcagctaatatgtatctagactgggcaaacataaaaacctattattcacctttataaattatctcacaaagtttttgattgatgttcactgcaaaatgagtattagaattatggtaagtaattgagtttaaaaatataaactagtacctattcaactcttcagtaactgtaatcagacatgtcatatgcttcatactttacacattcaaactgggttcacttcagaaatttttccatctggtggtgctcatagttggaagggtttgtgaatttcaaataggtgaaataaatgaggtagctttcaaaatacacagggtataaattaagcttagaacatcctcatgcaaatgagtctgtaaactacaagtaattgcatgcgagatatttcattgctcttttaatagtggaagaggaacataagttaccattgctataatcaatgtgaaagtcagttgctcctagtgattcttactgttttgaatctctaagtgatgtacgtaaaattactgtattttaaactgttggtttgcaaaatgtcaaggaaaatgtgtaccttattgaaagaagaaaattatacatattgtaatatgtttcgttaatcttctctgtaaaccaatatgtttataaaagtcttactttactttagaaattattctttcaatgaatgtcaaataattggctaatcaatgtacttttggtagagacaaaatgccactggaacatctccacaatcacatcaactttttaattgcagtcagtctatggacctgatttgcacaatgcccaaatgatacaggatgtaaagatggaaacaatgtatactagaagtaaaaatgtctaaaaagttcttactgcagaacagttacaccatggagtaagttttctggctccatcccatacctgctgaactagacttcctggcagatggcctggcaatgtatacactttaaacaagtttaaataattactttggatgataataatatgtagtccttgttatcctactgtttccatgagcccattccattttgtgaatagaaattaattatctagaactgcttcgaaaggcagtgtctaggtgtcatgataaagtcaatgtcatctgtagaattccagtgatgtggtttcttaactttcctactgtgaaatagcattgtggtggaactcataattgtatatcagccagagaaagtgttaattaatttgttgactcccatttcttgtttggcatgctatgaaaatgtctcctgccacagaagtgtcattatgtatcacacctaatctagctgtcttaaaatttatcaagacagttcatagaattttataaaagataaagtgacttatttatttatttattgtcatgcaccctgaccaattgacacagtgcttaggagggtctagaagttgttttggttgtttccctactcatatttggatgaaaagggggcttacctcttgattggtaaattatttttaaaatttatatatatctttaacctgggagcataaattcaaattgccatgaatatatactcccttgattggtaaattcttaatgtagctgtatttctcatagtttattaaaataagcctgttaaaatttataagtttagatggtaatataggtgtattttgaaattatcataattaggataactgagtataaattattttaaatttcttatattatgtgtgttaccaacactaggacacatagaaattatgataaaacaagttttatttattttaatgaatttcaagcacttatgacttgatgtctcacaacttcaaaggcaaataagaattaagtaggttacctatattaggatgaaaaacatattttttacctgcttgagaggttatgatgaagtgtataaaaaagggataggtgtggctcatttggcctaattatataagtcccttgatttagtctgctctaccttagcatttataaacattatctaattaagatatcatctttaaatgggatttaattcaagaaaccaagccataaaagtattactggctatagaaatagagggaaaatatttatctttctcctccctccctctctcacttattcttcaattttttttcctttctcttctactctttttttttctttttgtctcaataaattttcatggaaaaagatagaggtcaagaaacgtctttgtttcctatgttaggcaactattatctctttttattattttatatagctcttaggaaagttatgatataaatgtccagaaattgttgtgaatttcagtataaaacctttggtatactgttatctattcatgatagttctcttcatgtttagaggaatttaactaacttacttaagccttatgaaaaagaaaatatcttagttatataaattttgatagctgtgggcatgaaacaaaatacaaaaacaatttctcttgcgatatgctacacctatggtcatagacagccagtgtaagtgcaagaggaagtagcagcaaagattttgccgtaacttgcaccttagtactaacatcagccattttccttagccatatgaatttctctagcctcttgtgtttagatgatcttcatagcatctagataatcaagagaatcatttattagaatctagatatgctagttaaccatcaataacagtttttaaggactatttaggtttgtgaaaatagatggtatacgtatgatgatgtcctatgttagtcagcttgggctgccatagcagagcaccacagactgagtgactgaaacggtagaaatttatattctcataggtctagaggtcaaaagtttacaaggtgccatcagggttggtttctggtgaaggctattttcttggcttgcggatggctgctttcttgctgtgtcttcatataacctttcctctgtgcattcatggagggaaagagagaaagctctagtgtcccttcctctagtgtcccaaacatggacactagccatatttgattagagtctcatccttaggacctcatttacccttggttacctctctgtaaaagccctatctccaaatacagtcacacagacaggattcaggatatgaatttggagggaaagacacaattcagtctataatactcccaaattactgaatgtggactttgcatttaggattgcttttccttaaaatttcagacataagtttataatatatgctaaatcaaagcaagaaaatgagtcagatatgttaaagagcctattcctcactgagaactcaaattaaagaagtgactctattgagaacatttatggccttgtattcttagctttggggaaatacaaagaacacaactctaaaggaagaaggtaagatgaaattttagggagagacagatatcactcctgttatacatcatggatttttaaaagcatcgtcaaaagattacagcagggacataaatgataagtcagtgaacttgtgcattattcttggatttttttccctgagtttctttttcagtgagggcaaagctaatatgtgaaatggaagaaaaaacattggacttttcacctttcatgcgctaaaatattggaaatatgggtgctttaataattttttatcatagataataatccaggttatctgaacaacagtgtttactactacagccaataatggaacacaacaaatcttattagaatattgtagatatagagaataagatgttccctgtaactcttttgcataagttttaacattcaaaagtataaggtttaaattttggttctgaaatcttttatgatgttactaatagttagcttctctaaacttatttttcaccttcttaaaaatgaagaaaacatttttgttttcaaaaataataacacatgggcatcttttggggacagcattgttctgcctacagggtatagcttcaatcatggatgattaatcttgaaataagttcatgatcattttatggatgacttttgtcactgcatatgttagatattagtatttcccactaaaatctatagaaatgactcatattctaggtatatttatatctaacctattaggagaacaaatgtttaacataaatacaaaatattttttatgaaattgataatggtttattaggaaatagaagaaacttgcaaggttgtggttgttgatattcaacagattcttcatttcagtgctctgtcatttcctaaggtaatcaagcacatatatgacctattttcactaatgtaacttcagaaatgtaaaaatatagatgatgataagacagcaaatcttgaacagaagcaatggtcattaagaggtttcaactttggttttcctaaggcagtatccagagcaataagatgacccagattttttaaaattctattactgtcataaaaggaagtttgcatgttgctgagatcgccctacattggtgcattttgttgtcctaccaatgaaatttttgtatttctttattcaaatgtatcttgaaactatgggttcttaacataaatataccccataaactagtaactctcccagaagatatcataatccagatacaataaacagccttagtcaaatgaaagacaacactaaaagccatctcacaatacaaatattttggaccatatcaaataatctgtgttttagcaaacatctaggatattcattgattatatttttctaactttaaatatgtattatttttaatatgctgttagattataattgaaaaatttaaaataattattcattagaaaatcttgcaaaagtccagaccatgtattttgtatttgtttcagtagattgggtcgaggatatgctaaaataaagtaataggattttttatactcctaagaacaattaatttttaattttcaaacttgctagattatggatttgtagaccacagcttggttcttttcagagttttactggtctagtgaaatactaagaattgcattatcataggcaataattcagttggtagaaatacattttacaatttcttgatgatttttgagctagtcacatataacttgtggcttagaatagctccatgatcatttactgacaatttgcttttataggttactggctctaacaaaggagatacaataaaatacaaaatattattttcttaagttcatgtggccagtcatattacttattcactccgaatactaggatagattatgtcaaaatgtcatctttaggcagggcaaccatcctaatttgccttggactcactggaagtcccacatcctgggaaacccaatagtccccccaaaacaaaacaattggtcactcaatgaaaaaatccactatccagcctacctccatgtaagattcaagtcttaatgtcaattattaatgttggtgcatatggagccttaaacaactctacctaaagaagcattattgaacaagagctgggtgtggattctggttctctctacagtagagtagtatgatcaattccttcaactctgtgaatttgctttctgctaaatcatgtttatgaggtgttctagggtaggtaacataatgatgggaatagaatgctcacaataaaatttcacatttatttagcaaaataatgacaataacaacaataataaaacacagaggaaatgaggttgctacaaaggagtagatgcagcccataagtacacagctgcccttgagccccaaggtccatgcaagcaaagtttaggcatacagaatttgagaagattaatacctgattgtgctattatccttttatacatggggcttacatgattatttcttaaaaattaactgacaagttatttctggacctaatgcacatatttgagtgactctttgcaaatatttgtgctatcaatatttctagtagaaaaagtcactgtcaggaagattttatcctaacttaagagaagatgcatacctagccactgttcttctccaagctgtaaggcatttacagtaccagtttccccagattcatacctcactacagatattgtgaagataaaattaaatcatatgtttatagtaactggcaaatagtaggctcttagttatggtggtggtagtgggtgtactgaaaatatcctttgtgaagaaagaaaagaggctttctaaaatatcatctagctcatcaattttcctttttctttcttatttagtgaaaagtatcaatgatataatctatctactaatatatatattcagaagtaatattaaatcatagcgaaattccaaaattttgtcaatagttggcaaaataagtaaatataaaatattgtatatccatttaatgtaaattatattactattatgcatgttagagtgagtatgtttattacattagttctgctgaattttctaaagcctttttggaatattctatatttactttcttaatgaagaaacctaaacatgttcttattgtgtctgaagaccaagcaaactaatcagtgccaggtaaatacaatttttaaaaatattttagtaggaaaatagaaactggtttttatctcaccaaagaacgcttataggatacatctccaagttacagacaaggcaaaatgcaaacagctctcctttggctcagttataaatgagtgagtttttcccccctgatattctgatatgatgaaatacatttttgttaaatcttcatgctaaaatatttatgctttcaaaacatttttctgatgttagctacactcataggatttaataatgtggtatagctaaatttagccttggggccactgttaatattacagaggcatgtgtaccacaactcggcatgatttacaacatccacattggtttacgtggagcttttaattaaatcagaaaaaaatgactctatgtggtagttcatattgtagggatagtgtatccagtccattgttataaggactaacaggagagaagattggtatgctgggaaatagtgaacaggtcaagtatcagagatatattagcatcaacctttaactgtacatctggatgcagcatgtactttttgtctgcagttgtggcaattatttccaaagcatcacagtaatttcagctgttccctcaatttccagcttctgcaaagtctcttctaagagccacctttatatttatttttttcttgataacaacatactcttcttgctactcttctgttcctgaagaaaataggtatgtctagttgtttagtaatatgctttagttcatatttcaaaggtatttctttcttctacctccttttagtcattctgctttagttgctgtattctactgtttaatcatttatggattgcattttcaatcacattctatccaataaatctgcagttagtcagcagtattggtttttgataggcaccctgtgtcacaggaatttttttattggaaccttgccctcatgttctggggacctattgccttggtttcacaagcatggaaataatcaagagacaaggtattggattttgggcacaaataggtgtgacaattaaagctactctttacgtttttactttaagaagctactcttaaagtcttttctttgatttggcattatgacattgtactcaaccaaggaaaaggtaggatctgtagtcttcccggtgaagcgtcactgggtagtgtagtgtctttttagaaaattcttcaaaaccaattttctttgttttgctggcaaatgtttgtagttctgaaatgaccaaatagaggtaattttatacagcttgatttaacaagtaacagtagatgagaatccttcaaaatgattgtcacatattaagtgcaaattaaaatacctatgtccaaagtgaagagagaaaatattaggcaccacaggaaagatataaacaaagctattggaaaagaaagcaggtaatatgggttctttatttatctggtattcaatatacaaagacaattgtcttgaaggggaaaaaaggaggaaaagagactaaattctttctattcttaatatgtctttctaattcccttgatcaggaatactttataaagtcctgtattactgcatattttctttcaaatttaaacttagttcaatgtgaagaaagccgtaatgttagtggctttgttttttcattttggaatcatcagtaaaaagcaatctgatgtgatagccacataaaattatgatactgtgaactgtacaaagacattatattacattttaaggaactgaaatattcactgaatatgcatggtctgcacactaaacattgtgtgtttaagaaaaatgttagatatgaatacaagtttaataaagcattattgtatgcatacagatccacagttaaagaatatgtagggccgggcccggtggctcacgcctgtaatcctagcactttgggaggccgaggcgggcagagcacgaggccaggagattgagaccatcctggctaacacggtgaaaccccgtctctactaaaaatacaaaaaattacccgggtgtggtggcgggtgcctgtagtcccagctacggggtgggggggggggggcggggctgaggcaggagaatggcgtgaacccaggaggcggagcttgcggtgagccgaaactgcgccactgcactccagcctgggcgacagagcgagactccgtctcaaaaaaaaaaaaaaaagagaatatgtaggctggacatggtggctcacacctgtaatcccagtctctgctttgggaggcagaggcaggaggattgctcaaggctgggagtttgagaccagcctgggcaatatagtgagacctcatttctatgaaaaataatttaaaatattatccaggtatggtggtgcatgcctgtaatcccagctacttgggaggctgaggcaggagaatcacttgagcctgccaggttgaggctgcagtgagctctgatcacgccgctgcactccagactgaacgacagagtgagagacctttttttgttgttgatgttgttgtttttataaaaaaagcgtatataatatgggtctaactttcaagtcattggagagttaaataggcaaatcaatacacatatacattaagaacttggaaaacaaaataattctatattgaaaacaaatggtattttttgtttttgctctacaaggatatttcagtagctcattaatcagataaaaaagagaaatgtgatggtaccaaaatctgtattgaaaataccagaactagaatttgaaagctgtattttcagtagcttcgagaaataaaatattgacagagaggaagtgaattcataggtgatccaatgttttatgtttcatttaaaaatagtattaaaaggttttgttgctttttaatatttctttaagcaatattcaattttgtgtagtaacctatttagttcttctatatgtattccattacagtattatcttattcaaaaaataaatacctcctttatcatgtaggagcattgtcctagaacatggcaacaatctgctctgaatgtctgaaatccctgataagaaatgtagctccttgaatagttaggcttgaattggctcttgttgaaattagatctgtgataacaatactaagcagcattaagtatttatggtaagtcaataagtaatgacacctactacaaggtctgtagtttaaaattgtcattttattcaggtaaaacacttttttatggctttgtaattcagttcagtaaattggcttctaactgcatgcaaaacttggaactaaatccctctccttggcacatttattttttaaaacatggtttttaaattttattttattaattgcagtaagaactcaacatgaaatatatgcttctaaagttttaagtgcacagtacattattgttgactataattgcaatgttgtaccacagatctctagagcttattcttcttgcttgacttaaactttatgcctgttgattagtaactcttcatttccctcctcactcaacccctgatagccacatttccaccctttgattctatgattctatgaatttgactactttaggtaccttatataaatgcaattgtgcaatatttctctttcgggctcatttcacttagcataatgttctgaaggctcatctattttgtcacatattgcagactttgcttattttttcaggccaaataatattccattatatgtacataccacattttctatattcattcatcagttgatgcacatttaggttacgtgcacctcttgactgtagtgaacagagctgcagtgaatataggaatcctaatatatctttgagatcctgatttcatttcttttggaaaaataagcagtcctggaagtaggattactgggtcatatggtagacacagttttaatattttgaggaacctctatatcgttttccattgcagctgcaccagtttgcattgcacgaagcttccagtttcttcacatccttgctgacacttatcgtctttctttaaaagtagtagtcatcctgacaggtgtgagttggtatcttattgtgattttgatttgcatttcctttatgatttgtaacactgagcatttgttcatatacttatccatttgtgtgtcttctttggagaatgtctgttcaaatctttatcccatttttgaatcaggttatttgttgtttgtttgttttttgctattgagttttgggatttccttaaatattttgaaatctcaattggatatatggtttgcattttgttttctcccacttaataggctgtcttttcactctatttttttttctgtgcagaacctttttttttattttgatgtggtcccacttgtttatttttgttgttgttttctatgcttttgtgttatatctatgaaatcattcccaagatcaatggaatgaatcttttcctctatgttttcttatagtagttttataattttgtgtcttatatttaagcctttagtccactttgagttgtttttggtgtattgtgtaagttagggatcagatttaatttttttctttgcacatggatatccaatatttccaacatctcttgtctttgtctaggagactatctttttcccattgtgttttcttgacccacttgtcaaacatatatttgtggatttgtttctgggctctctattctgttccatttgtctatttgtctgtctttatgccagtgctctactgttttgattactatagctttgcaatacagtttgaaatcagctagtgtgctaactcctgctttgttctccatcctcaagattgatttggctatttgtggtttttgtggttccatatgaattttagaattttttttctatttctgtaaaaaataccattagaatattaaatgagatttcattgaatctgtaggtcactttgggcagtatggacattttaacaatattaagtcttccaatccataaaatgtgatgtcttttcatttgtttgtgccctgtttcacctccttcaccaatgttttgtagtttttagtatacaagccttttgcttccgtagttaagcttattcccaggtatttaatttttttggtgttattgtaaatgtgattgtttttcaaattttctttttagataacttgttgttaatagtacaaacaggactggtttttgtacatttattttgtatcctgcaattttcctgaagtattttttcatagagtttttagggcttactataaataagatcatatgttctgcaaacagggacagtttcactcgttccttttcagttttaatgcctcctattcttttttcttgccgaattactctggctgggactaacactactgtgttgaaaagaagtggtgaaagcaggcatcctttccgtattccagaccttataggaaaacctttttgattttcacactgaatatgttattatctgtgggagttacatataggcttttattaatataaggtaatttcctaccattcctagtttgttgagagtgttatcatgaaagggtgctgaattgtgactaatgctttttctacatctatgaagataatcatgtgatttttatcctttattctactaatgtagtgtatcacattaattgattttcttatgttgaatgatacatttctttttaacaaatgatgctctgaatctttttctttctccttttcccctctttttatttaattaaccatgtggaaggcatatcaatataaacatagaaataaaaaaaaacttgatatatctgtgcctgaaaagcaaatatctcacacaaacatttaagacaaaatctatatatttctcgggtttcttagggaaggccttaatttattgaggcacgtctgccttctagaattagtctcctcatccagacatcttcaatgcacacatatccattaaagggtagagcagcaatcccagacatgagctagtaatgagtatttggtaagatttgaagtatatatgacacagtacttgtctgagttgtgacccaactcaagcaatcaagatattatattcttattgtattttataaaattacttctggaattaaaagtaattgacagttgtaatgcttgaatgtgttaagtatgaatttatatgtaatttgaatgcttttatttattttatctgccctttagtctagagtgtattcagcagaatgttgatcacttttgtccttttgtccacttcttatgttttacattataccgtaaaagcataagcaaaaattttcttccattttgtaggttggctcggatgataggcattttttttttttttttggctgtgcagaagctctttggattactcgggtcccatttgtcaattgttgcttttgttgcaattgcttttgacgtttttgtcatgaaatctttgcccatgcctatgttccaaaaggtattgcctagattttcttctagggtttttatagtttggggttttacatgtaagtctttaatccgtcttaagttaatttttgtataaggtgtaaggaagtggcctagtttcaattttctgcatatggctagcccattctcctagcactatatattaaatagggaatcttttccccattgcttgtttttgtcaggtttgtcgaagatcagatggttgtagatgtgcagttttatttctgagatctctattctgttccattggtctatgtgtctgttttgtaccactaccctgctgttttggttactgtaaccttgtagtatagtttgaagttggtagtgtgatgcctccagctttgttcttttttgcttaggattgtcttggctatatgggctctttttgggttccatataaatttagtagttttttcctaattctgggaagaatgtcaatggtagtttaattagaatagcattgaatgtataaattatattgggcaggatgaccattttcaccatattgattcttcatatccatgaacatggaatgttcttccatttgtttgtgtcctctttgatttccttgaacagtggtttgtagttctccttgaagaggtcgttaacttcccttgttagctgtattcctttggtattttattctttggtattttattctctttgtagcagttgtgaatgggagttcactcatcatttggctctctgcttgtctactgtttctgtataggaatgcttgtgatttttgcacattgattttgtatcctgagactttgctgaagttgcttatcaccttaagaagcattaggggtgagatgatggggttttctagatgtaggatcgtgtcatctgcaaatagatacagtttgacttcctctctttctatctgaataccctttatttctttctcttgcctgattgccctggccagaacttccagtactatgttgattagggttggtgagagatggcattcttgtcttgtgctgattttcaaggggaatgcttccagcttttgcccattcagtatgatattggctgtgagtttttcataaatggctcttattattttgaggtgtgttccatcaatacctagtttattgagagtttttaacatgaagggatgttgaattttatcaaaggcctttttggtgtctgttgagataatcaagtggtttttgtctttagttctgcttatgtgatgaattatgtttattgatttgtgtatgttgaaccagtcttgcaagttgaagctgacttgatcgtggtggataagctttttgatgtactgctggattcagtttgccagtattttattgaggatattcgcatggatgttcatcagagatattggcctgcagtttcctttttttattgtatctctgccaggttttggtactaggatcatgctggcctcataaagtgagttagggaggagtccctcctttttgatcgtttggaatagtttcagtaaatccatccggtcgtgggccttttttgttgttgttgttgttggtaggctatttattattgcctcaatttcaggccttgttattggtctattcagggattcaacttgggagggtgcatgtgtctaagaatttattaatttcttctagattttctagtttgtttgaatggaggtgtttatagtattctctgatggttgtttgtatttctgtggagtcagtggatatccagaatctacaatgaacttaagcaaatttataagagaaaaatattcccgttaaaaagttagcaaaggacatgaacagacacctctcaaaagaagatacttaagcaggcaacaagcatatgagaaaaagctcaacatcactgattactagagaaatgcaaatgaaaaccacaatgagataccacctcatgccagtcagaatgatgattattaaaaagccaagaaacaaccaatgctggtgaggctgtggagaaataggaatgtttttacactgttggtgggaatgtaaattagttcaaccattgtggaaagacagtgttgtgattcctcaaagacgtagaaccagaaataccatttgacccagcaatcctattactgggtatatacctaaaggaatataaatcattctattataaagatatatgcacacatatgttcattgcagcactgtttccaatagcaaagacatggaatcaacccaaatgcccatcagtgatagactggataaagcaaatgtggtacatatataccatggaatactatgcagccagagaaaggaacgatgttctttgcagggacatggatggagtttaaagccattttattcagcaaactaatgaggaacagaaaaccaaatactgcatgttcttacttataagtgggagctgaacaataaggacccatggacacagggaggagaacaacacacactagagcctgtcttgaggggtagagggagggagagcatcacgataaatagctaatgaatgccaggcttaatacctaggtgatgggtttataggtgcagaaaaccaccatggcacacgtttacctatgtaacaaagctgcatgtcctgcacatgtatcccagaacttaaaataaaataacacattttttaaaaaagcataagcaaaaaattttctcattctgtctccctttttctcctcactctttctcttctcttcccatttcttttatctttctttcctctcccgcttttttttactgttgaataaactttgccattgttctgcattccaggttcctcatctcagtcctttcaacttagcccctttgttgttcatattacaggttcatgataaagagttagcctgggcagacagtaagagcatgagctctgcagtcagacaatctacatccttgtcaggctcttccttggagaactatgtaatttttgtgtctcaaaatcttcatcttattactaacatctagctgctcaagtgtattacctcttatcttttttaatctggcattttggggtgatagttgaaacatatggaagataggttaatattgtactttgtgaccccatttactgttctatattagatagttgtttctttcactcttttcttgctggcagattaccaactgctactgttgctctccattttcctgcctcaagaagtctttccattttaaatttctcctcgttacctcttagattctgagaatttaaatcactgagccaattaaaaagttttgtatgtgtgagatgtgaacatatccagagcaatggcttaagaacctcttccacggacacttcaggatttaggctttgtaattatgacttatgtggttcacaaatccttttcaacttctattttggatggtgaatatttctgcaattctgactagcaaatcaagtttgtttttactctatccaattttttcataatatactagatggcatcaatgctattccttctttctgttagagaggcagcactaattcttctcctggcctaaatatcatccaatattcaatcaaacttggaaattatgaattttgtttattttgcattggagtttacctacagccttttacattcatcttaagccagattccctagaatagaatcccagcttcacttttcactagctgtgtgacttaggggttatcaaaagtgtttctaaatggtttctcagtttggtaaaaaataaaataaagtaataatagtacctacctcctataattaaatgagttaatgtatgcaaagcttttggagaatgtctaggacattttaagggctataattgtctcctaattacaaactccacaagggcaggattttggcctgttttttttctaacatctccaatgcctggtatgcaattggtacttaataaatatatgttgaattaggattttttcttaaaatagaacatacgtacatctctaaatttacaatgagtttatttggtagtaattgttggcctagctaattaatcccctgatgtgatttttaatctttgctatatcatggaaccaatgtagacatttgagtagccaaacatagatatatcatagattaagaggctatatgtgcagatgttttcctaatcatgataaaaacttgctctaagcaatcctttagaaattatgtaacagaattttctcactttttagaagagcaaacagaggcccagcagagttaaatttattcaacattatcctttaagattggctataaataaatgttagccaaaatttctataaaataaagttacagagtcataaaggtgttcaaaatattacactgtgataaagtgtccccagaatggattatgaaaaagaaaactaatctttttcagacaaaatatttttcccagtaggagagtacctttccatatggtacaaaatgaaaaagtaaaaactatagctatgaaatcaacaccagatggtcttagaggtgatgtctttatctcttctgctgttgctattttacactcagaaaagagctttaaatcttgactaatttgctaaatccccattaaagtatgtacatactagccctcttgtgaaaaaagccacgtagcctttattttggtttcagagtcaacattcggctgagttacatggtttattaaaaataatgttcaatggtataaatgaacaaataagtacaaaggagtgcaaacagtacactgtattttttttttttgggagtggtgcattacattttgatagataaatgctttgccatctccttgttagtaatataaaacataggtaagtttaaatgggtagaacaatgaaataacttgcaagttgtcataactagaatttgtcaataaatggctcatgaaattcttatcatctgtcacactatttcacagtgtttgtaggtttttttgattattttattttactttctgtagtttttgaaacaaagtctcgctgtctccctaggctggagtgcagtggcacaatctcggctcactgcagcctctatctcccggatcctaacaattatcttgcctcagcctcccaagtagctgggactacaggtctgtgccaccacacctggctaatttttgtatttttggtagaggcatatttttgccatgttggccaggttggtcttgaactcccgacctcaagtgttactcctgccttggcctcccaaattgtgggattacaagtgtgagccatcatgcctggccttttgatcattttaaattaagtttgatgaatactcagagcttagatggagttttggtttaataatttttaaattcaactttcttttattcagtaaaattttattgagcacctattctttgtcaaatactcttctgggtgctggtggtacaaagatgaaaaacactaccctttttactctgatgtcctactcctaaatatctcacagtgaaagcataggggcaaatgtcctaatgagggggtattataaagagctattctcacacaaagaaagaagcaactcagttggtctggacaaaagctggaaattttggtgaagaattgttattgttatttgagcatgataaattgcctgatgactggtttaatgagtggacaagcactggaagagaattccaggtagaagaaatagaaagttcatgctctgctgattttgtggtgaaagtgtctttacagtctagtactgtgcttaaaattctggtgttttccattaataacaagaaaattttatggacaacaaacacttcagttggaaatgcttagcttggatttttctctctatgggagctgaccctctgggattctgcagcaagtgaatgctcagcttcctgtaaacttgaatgagaccaagtttgccaggacctcacctgttggaaagaacagtaaaggattgttgatcaagggaaggagatatgtgtagtgctaatttttttcttcatcataccttgtcaatgtttataaagacctttcacgctgctaggtattagtaccccaactattggtatagcttatacacggggatcatcttttttgcttcactgacttttgctcaccttagaacacaagttctgtttctctagcttttctatttatattgttcagtgaatagatttcagcattttcttgcgcatccgtgtgaagagagcaccaaacagactttgtgtgagcaacatggctgtttatttcacctgggtgcaggcgggctgagtccgaaaagagagtcagcgaagggagataagggtggggccgttttataggatttgggtaggtaaaggaaaattacagtcaaagggggtttgttctctggcgggtaggagtgggggtcgcaaggtgctcagtgggggtgctttttgagccaggatgagccaggaaaaggactttcacaaggtaatgtcatcagttaaggcaaggaccggccatttacacttcttttgtggtggaatgtcatcagttaaggtggggcaaggcatattcacttcttctgtgattcttcagttacttcaggccatctgggcgtatacgtgcaagtcacaggggatgcgatggcttggcttgggctcagaggcctgatattcctgccttcttatattaataagaaaaataaaacaaaatagtgttgaagtgttggggcggcgaaaattttttggggggtgttatggaccttaaatgggctgtaccctgtagcattccgaggacaggcctgaattctgagaagggaatgtggtaaaagtattgtccagtcctttttaagttggtggctgagcttggtgaggtgtgtttttaaaagacctttagtccattctacttttcttgaagatggaggaccataagggatataaaggtttcactgaataccaagagcctgaaaaactgcttggctgatttgactaataaaggctggtctgttatcagactgtatagaggtgggaaggctaaactgaggaattatgtctgacagaacggaagagatgactgcggtggccttctcagaccctgtaggaaaggcctctacttattttgagggcctctaaaagtattaaagcagcggcagccactgcacgcagacatgagggctaggctaaaacagtaaggtcaagttgtttggagagaaaggctacagggtgtggtcctggctcttgtgtaaaaattctgaccgcgctaaccatgcctaggaaggaaaggagttgttttgtagaaggtgcttgggtttgagagatcagtcggacacgatcggcagggagagcacgtgtgtttttatgagaattatgccgagataggtaacagatgaggaagaaatttgggcttgattgaagtaatgggggctgtctgtgaagctttgcggcagtacagcctaggtaatttgctgagcttgatggatgtcagggtcagtccaagggaaagcgaagagagcctgggattaagggtgcaaaggaatagtaaagaaagcatgtttgagatctagaacagaataatgggttgtagaggcaggtattgaggataggagagtatatgggtttggcaccacggggtttataggcacaacaatttggttgataaggtgcagatcctgaactaacttgtaagacttgtctggttttaggacaggtaaaatgggggaactgtaaggagagtttataggctttaaaaggccatgctgtagcaggtgagtgataacaggctttaatctttttaaagtgtgctgcgggatgggatattggccttgagtggggtaagggtgattaggttttaatgagatggtaaggggtgcatgatcggtcgccaaggagggagtagaggtgtcttatacttgtgggttaaggtggggggatagaagaggtggacgcaaaggaggctttggcttgggaagaagggtggcaatgagatatagctgtagtccaggaatagtcagggaagcagataatttagttaaagtgtctcggcctaataagggaactgggcaggtggggataactaaaaaggagtgcttaaaagagtattgtctaagttggcaccagagttggggagttttaagaggtttagaagcctggccgtcaatacccacaacagttatggaagcaagggaaacgggcccttgaaaagagggtaatgtggagtgagtagcctctgtattgattaagaaggggacgggcttaccttccactgtgagagttaccggaagctcggcgtctgtgatggtctagggggcttccgaggcgatcgggcagtgtcagtcttcagctgctaagccgagaagatctgggaaggagtcagtcagagagccttgagccaaagttccaggggctctgggagtggctgccaggtgagttgaacagtccgattttcagtggggtcccgcacagatgggacgcggcttaggaggaatcccaggctgcgggcattccttggcccagtggccagatttccggcacatgtagcaagctcctgtgggaggaggttctggaggaacgcctggctgctgcggttcaggcctttggaagttcttgtgtgctggagatgtggctggggtttgtctcacaatggaggcaaggaattgcaacttttttctattatggtacaccttgaaggcgaggttaattaaatcctgttgtggggtttgagggccgaaatttaatttttggagttttatttaatgtcgggagcagattgggtaataaaatgtattttgagaataagacggccttttgaccttttagggtctagggctgtaaagtgtctcagggttgctgccaaatgagccatgaactgggctggatttttatatttgatgaaaaaaagcctaaacgctatccgatttgggataaagaaaaaggagcattaactttgactattcctttagctccagccacctttttaagagtaaattgctgggcaggagggggagggctagtcggctagtcacggaacgaaactgtaagccggaccaggtgtgaggaggggaggtgataaaaagattatagggtggaggagcagaggctgagaaagaattgggacctagctcagcctggcgaggagcagcctggggaggaggggagaggtcagatgggtctgtagaaaaggaagattagaaagactcagcgatgcttggggttggtactgaggggacaggcgggagggaaagaaggaagatttgggacgagttgcactggtcacagagattaggaagggactgatgtgtaaaagaatgcctggacgtcaggcacctcagaccgtttgcctattttacgacaagaattatttcgattttgcaggatggaaaaattcaaagtgccattttctggctatttggaactactgtcgagtttgtattggggtcaagcagcattgcagaagaaaataaggcatttaggttttaggtcaggtgtgagttgaagaggttttaagtttttgagaacacaggctaagggagaagaaggaggaatggaaggtggaagcttacccatagtgaaggaggcaagcccagagaaaagagtagagacacggagaaggggtggggggttcttgccctccagaaaagcagagaaggggttggggcacagaaataagggattggggcacagagataagaggtcagggtgcagaaataagggattggggcacagagataagaggttggggtgcggaaataagcaattgggggcttcttgccccctaggaaagcaggacttgccactaagggtgaaggagaaggggctgaggggtacttgcccctgccccaggaaagcgggacttgccgctaagggtgaaggaccaaggcggcgtccctgcgtggtctgacacccttgaaacgtgagtgtataatcagagaggcgtccctgcaatgattaaacaccaagggaaggctgccttccaagtccgtgaccggtgccggagttttgggttcacagataaaacatgtctcttttgtctccaccagaaaatgaaaggaattgaaattaagagaagggagagattgaagtgtggcaccaagattgaaaggagaaagaggttgagggatagtgagggaggttggagaagagagtaaaaagaggccgcttaccggatttgaaattggtgagatgtttgtttcttgggctggtcggtctgaggacctgaggtcgtaggtggatctttctcacggagcaaagagcaggaggacaggggattgatctcccaagggaggtcccccgatctgagtcacggcaccaaatttcatgcacgtccgtgtgaagagaccaccaaacaggctttgtgtgagcaacatggctgtttatttcacctgggtgcaggcaggctgagtccgaaaagagagtcagcgaagggagataagggtggggccgttttataggatttgggtaggtaaaggaaaattacagtcaaagggggtttgttctctggcgggtaggagtgggggtcgcaaggtgctcagtgggcaggagtggggggtcacaaggtgctcagtgggggtgctttttgagccaggatgagccaggaaaaggactttcacaaggtaatgtcatcagttaaggcaaggaccggccatttacacttcttttgtggtggaatgtcatcagttaaggtggggcaaggcatattcacttgttttgtgattcttcagttacttcaggccatctgggcatatacgtgcaagtcacaggggatgcgatggcttggcttgggctcagaggcctgagaagcataagtgtcacttactatattttgcaaagtcttagtttactgaagaatgtaacttttggcagttttctttgctcaccgtgctctaatgacataaatatcccagtcaagcctggtaaatgcatatgacttcagagaacaggcaggtgaagtaaacatacaaagtcagttaagacaaggagagtcatgcagagtgtgctgtttctcttcttgttaagttgtaaacttctgacagcagggattctttgactcttttgttcgctgatatatcacagcttactgtcacagggcctgatatctagtagatgctgtagaaatacttatgaatgaatgggtagggaacctattgcactagggagaacaagcaatgcctaaaggcattcatcactgttgataacaacaacaacagatactgtgccaggcaaacaaagcccatctagggaatctctcatttaggatccatggtcatatgaatcgcatctcttcctaaaagttatgcaatttttcaaaaaggaacagtattctgcctttgcaatcatttccataaatgtctgtcctgtgaatatcaatgagaaatgcatgttggcttcaatatctgtagcaaaagtttactcctacattaaaaactgtttatgaatacaatttcaaatattgttatttcctagagcatcattttaaatagaatttcccagcatgataccaatcttgggcttcatgagagtcaatcaatatgtgaaggatagtatttgaataataactccacataaatgggtagattattttgagttttcacatcaacttctaatatattatctcatctttattttgtgaaatattcactgctacttatatttcaatgaaatacctgttgaaaatgaatttcaatgaaatatatgaaagtacagtgatatcttcatcacagtgaagtgactagttcttccaagagaaatatttttctattccttgaatctgtaagcacagtttaagcatgtttctctacatacaagctggatttaatttgtttagcatatgtatgtgttctatggtttaaataatgtagagtcacggaacagaagcggaaacttaattgtgtatttttacctcgtctctcttaaattcatactgtgctctcattatttcatttttcacccatatcttgattgataggggtgctttcacttaccgcctaccccttccttgttctttctttactctttacacattgtctccatgtagccactcgttgatcactggatttacatggaaacaaagtcatagcagacacagtgggtgtcttgcctttcctcctgtcctggcctggaggttgctgcagtttctttggacagattgcatatttattcttcgatctgagaactttcactgaatgcaggaatgtgttcgaccagggcatgagatgggaaagttaaggcccagagaataattcccaattaatgagggacaggagttgatagataagcacctgagccaggctccttgttctttagatagagagctttgcggtgcccttgacttggtctctcagagggttcctagcagctgggagccaagtttcccacagtgataacctgctcatcagtgaccctttactggcttttcttccttccttgttttgcccttttctgcttcttcaatatgtttcctgtgatcccagcccaaatcaactgctgtgccaggacctgctttcaaactaaagcagatatttcctacctgagcattttaaaattggcgtttattctgttttattatttatttagttagtttgtgtgtgtgtgtgtgtgtttgtgtgtgtgtgtgtgtgtgtgtgtgtttctccttcctcacaatcttctctgtgaattaggttactttataatactcagattatttccattcaaaaaaaaaaaagtcttgagcttaaattagaatatctctaattcaaggcaattggcaggtttatacaattgttaactgctttatactaagttgcttagagtctggatggaaagctgggttcctttttcataattaaatgctccagatgtacagagagccaaagtctgtaaggatgtaaagatgattaacactgtatcctgctttcagattttaaaaaggatgcttatcttcatatttacctattatgttaggtagcggcaaaaacaaagcacctaagaagtcaatgacctgctaaaatagtgttttctttctacataatgtattattacttaaccccaaattaaatatttgtgtcacacaccaagaagacatcatgaggaactgaatcactataatttttagtgggcatgaaccccagtatacatacttgggtttgaaaaatatgtatctgtctctactatgtcataattcagtattattttttctttcaactctttattctgccataacctcagaaaactttatcaatttggaattcccacttaatttaaattctaggagatgctgttgtaccaaggcctggagcatgatgtctgaatcctttgacaggcatatatttcctgagacttctctcattcctattgtttttggcacttttcagtgctagctggtctctctgctccctccattccaccattgtgggactgggagctgtctccctggaacatggagtattttccatgagatgactatgtccttgtctatataggcagccacactcagtgacctcaaataggaagggacaaactgatctcctatgatcttgaatatccagatgtttgggatttggtgtgggtgtcaagaggccagttattcctctcttggacccactgaagtgtctgttgctcagtccaagaaaactttgtttgccaggagaagaggtgcttatggggaaataggaagaattcctttttctcaaagatattttctaaaatatactttctatgttgcagttattgaaattctattgagagttcatgattttggaaaatagaaaccacagactttttgttcccctttcccttcctttctttccttttctttctctcttctcttattttcttgtcattcgaaatcactatgcctctccaggaccaatttctttctatctatctgtctatctatctatctatctatctatctatctatctatctatctatctatcgtccctccattcatcaagtatccccactacagagcacctcaggcatgctagaacattggcatcctgatctttatgaggagactcaaatctctgtggcaatgtctatcatgacctgtgccttccattattacatgttggaagactaccagcctggtattctgactggcaccatagtcatttttaagcactgcttacagagagaatgtttacagctggtggtgtagttggaattattttaatgtaattggagccacaatttgacactaattataaaacatttaaaataatctataatttagaatataaatgctctgcttaatcagaaagtttccctcttttttactttacgtatttcacctttttcatttttcattttggtttgatgaagatctcaaataaatatttcatactgtctcatccagtgtttccttatcccatttcagttttcatgtttgattttttattgcttatcaatgagaataaactaataatctatctcacatgttgctgcgatgaatcaatggacatttacattctgtaattgttttttagaacagtgaacttttttcatggtaataagggaatttatgacctctatgaccttccatgtttaaccttatatagtaatgagataattcaattaacacatgctgtagacgtatgctaaacatgtacatgatttagtaaaatgaactttatctttcttcatgtcttatatacccatataagtgcagaagaagaagcttgtaatggatagaatgagggtggttgggcagtttcaggacattgtgaaaaagtatcacttacctacacaagtgctaacatagatatagtaccttttgcccatgagcttttaaaggtcctgggaaaatgttgaatcttgaaaaacaatagtttcaatttccaaataaaaatattataaaacaaaattaataattatttatttgaaatgtagagatgtatttaaatatgttttatatatatggtataggactttcaaaagtcaaaatggtagagatatttctgcagtatgcaatcagaataactgtattctatagtgaccacatattttatagtagttactcacttattcattttcccatttactgcctcgtgttactaatatttattaagcacccactgagttccaagcactggactaggctgtgagggtaaataaatgataaaagaaaacactttgtgcatcctttgtactagctattatcaaaaggacttcagattacgcatgttaaattatctaaatacttcaagatagttacaagtattttcccccatttcaacaatgggaaattgaggccctcaactgaaaacaaagaacttgctcaagttcacacaggtattaaatggcagagtcaagacttgaacccaggtaccttactctagaatttgtactcttaccacttaactatcacattatataatacttcagagaatgcaatcatgacacttttcatctggctgaagagtcatattggtagcctggctaatatacaaggtaatatgaagaaaaaactggcaggggtagctatggaaacctataagaagagaatgactaacctataatgttttatgttactctttgtatacccccaaattagcaaatgattcatccaatatgaaatattttccttaaaatattttaatggacaaaaatatttttatgtttttcctatatcagtttttactcaacgacatgatttacactgaagcttgcttgataaatctgaatgtctctggttcttaagcaaagccttatagttttaaaaagctgatatttatgaaataaaaagtaaaatactagaacaaaatgacaatgatttcaacttttttttctattttgaaatttaaagctagcaaattttggtattaaaatatatacaaatatttttaaagtcttgaaattgttagctgttttgtggtctatctgggctatttttagtttcaggtataaacagataaaataagtgccaccatcaataaacgtaacttgagcaatactgtgtttccaagtcaaatttggaagaaaacatttttaacaatgttgtgaaggtagttctaaaatgtattatagttagaacagtgatcttgttatatatgcattattttttgagctttgaaattatcttaagcttttttgcattaaataatatctaatagaaaacaactcatcctatacaaatcaatttcaggggcaaatattcccggacttaatgtcaccattgggtatgtccatagtccaaatatatgctgttaatggcctttaggccttgggccttttaatttgactaaaatgtgatgtaaaagaaattaatctgttaatatgatataaatgttgagatctctatattttaatcaaatacttgtgtatgattatgctatttaccttaagtcagggtatagagattttctttacctcttcatgatgatatattaataattaagtataatatctattttcagaatatttaattagtactgtcctccatcagtttaacattaaataactctttgaggtttttttcaccaaaatatggcaacttttgcatacttttttcatgatgtgcatttcccaacaggtttgtaatcataaatatttagaatttcatattaactcctcagaagggctaatagtatgacattttaaaaattcccatattatttaaagtgatgttagaagactcaacatgaaacattgatgcttaaaaaggtcatacaggcacttcatgtctttcccatagaactgtaatgtgaaattattttcttgccttttctggcttttttttttttttttttcaaacacggcagacagttttgaacttcacaagtagtctagcttttattctgagtaaaacactcctcaactctaagctgaagttaatatattaaaaaaaacacagtacaattgaacagtttaaatatttccgatgtagattgatttcatataatacagctctaactttgacaaaatatttctgaatgtgtcacttgaaatgtcattataatgtatttctcctgtttttatttagggatgcattatttaggctagcacggcagtgtaagcagaaaaaaaatgtgctatatgtgaagaaagtttttgtacagtttctatttggagtgtttgatgaaaaggctgcacacagctttttctactgaatgaatgtttatctttgtattttttaacctaaaagattacaaaagacttgttttcagtaagggatttttataacccaaacagtagtggcaagcatggtttggtggctgtttgagctcttgaatgtttgtttctaagttttaaagctgtgttgataggagctcactgcctagacctttgtaagtgaagaggttagagatgaagtatggacactgcattagaattagatgattttatttttttctttcgagaacaaaaatcaggctcactgaatggtaaaagcctgggtgatctatgactttatctgtcacttggttgtattcagattgcaaaaatttatcatttcatctcagaatgatccaaaaaataaataattaaccatcttcaccatgaaaatacaaggactgaatatctgcagtatctgtactgggaatgacaaaaacagaagatgattgtcagcattaaaaaagaaagggatattttgttttaaaaccttaatcatgcttattattccaatttcagaacaataatccaggaaacataaattttatttcccctttctatgtgtaagattcttaatacagttctacatgtttataccatttaattaaaatatgaaaccattaaatcttgtttaaatttgagtaatacagtatgattttggcaaaagaggactatatttcattttaattttttgaatgaaccaatataatgcatgctgttgaattctagttgtagcatatctaaataggtgcacgttcttctgtttatgtcttttagcatcaccgtcaattaaactcttggtggatgatcctatagttgtaaatcctggagaggccataacattagtatgtgttacaacaggaggagagcctgcaccttctctcacctgggtcaggtcctttgggactctgcctgaaaagactgttttgaatggaggaactttgaccatacctgccatcacctcagatgatgctggtacttacagctgcattgccaataataatgtgggaaaccctgcaaaaaagtccaccaacatcattgtgagaggtaagtttgctgaaagaatgttacaacgtagattcctaggttaggctctcaaaaagcaaataatggttgatataaaattacctcctcaaatattgcatgtatctgtaaaatacagataaaatcatgtataaataataatggtgggtaattataagtggaacttaaacaggttaaagattaataacagtgctttatatatgcgttgaatagctttcataacatattcttagtgataccatcaaatgctttttataatatgttgttagctaaaaaaagattgaaagaaaaaatgtggcttgcagcataaaacattcactgtgtaaaatatacactgattgtataatagtttaggaattcagtaaatttatcaatttaataaacttttattgagcccctattacaatcatggctttaaattgtgaggttatatagagatctatcaaacattaccctgtactcaggattccactgtcagatagtgaaaataatatatatcaatagtcatatgatacggtgttctaaaagaataaacaaaagatatagaaattaaaaaatgtatagccacttctggctgaggttattagggaatatctaataacattcatactaggtcttataggtcgagtagtgttttgacagattgaaattgagaaaagacagaaaagtcagagatagaagacgcaatgcttatttgaggaactgaagcaaaatgtaagtcactaagtcaaagtagcaatgctgttctaatgtggtcattaccagctagtatgctggcaccatttaggcatgttttctctccattttggaagatggaaagaagttctgaggcagatgtacaaagagaccatatgcttcttcatatctcacttcacctggtatggtcctgggttggaagtggagggtgcacactgaggcctctgaagttaaaagggacatccatatgctgaagatgaccttttgaacacgcaaatgaaaattacttatgatggaagcaaaacataatcaaatgtatagagataaacacttgtgattttgtgaatgtagattgtggtggttttagttatctgttattttgcaaattattaggaatatgctatttgacaaaagtatactctattcaaaacatttcaaggtacagtgtaaatcaaaacactatgaatagcgtaccatctgccacaaaattgtataccatacaatatttattatatgtacatatgtacatgtataacatgtatgattattttatatatcaaaacaaaataaaacatactgccagttaaactaccataatgtcttatgagatagaagattattgaaaaagctcttctaaatttgtttatactttgattttttttaaaatatgtcatttattggcctgcataaaaaggccaataaaagcaaaataatttaattttttataatagttcacactcagaactcgacttctaaattagtttttattacagggtcattgatgatcatggttttctatacgatattgttcttgtgtcattaagagcattaataattccaaattatggagaaatactgcctctgagattttattttaagtcaggtcatgattactaatagcaaccatgacagactattgaatgtaagaggcattctgatctcagaattgttaaaatgtaaaaataaagatggattttagaatcaatgaaatgtgctctttatttcaattgtttaatgaacttctactgcacaactaccatgggctaaggactcagcaaatgtaaggaatgcatgagtgtgactgcaaagatcagtgactaaatgtctgccctcaaaggagttacagttctttatggaatacagaaatacaaagtaatcgtatatggaaatatatagaaaacaaagaattcacaatggaagtatccaacttttatttttaaaatattagtattgagaaatggggctcattttaagccttgtgtcagtgagcaaccagattctgttctctctctaccccatttttttaaaagagaaatagaaaaattgtattgtaatcggtgtttgtttcatttctattttttgtttgctttaaaaatacttgcttttctaagtaggcataaaataatctaccaaatcttgctgtaattattaaagtattgaagtatgatgattaaagcattgaagtattgaagtataatgattaaagtgtaatattaaagtactgcaacatctatccttaagtgccatgaatacaatgcagaatcttttattccattagtttatcaagaacagtaacttgttagagaaaaatgatgcattgaatttaattttcataatgggatcatttgcaactatattgaatccatgtacaactggcaaaatgtccaatataaaatatctgtgttgcttatgcaccctttgtaagggactaacccagtgaacaacaaatatgtgcctagggtatgattttctcctctctaccctacctaacagttttcacctgtatccttacaaaagaaagtttccaactttgacatgaaagacctgaaataaacaaagccttaaaaatttatttcttcaattttatgatttctttttatgcctttaatttatctgatgtgtacatttgcataatcatattatattgccagtgagacttctcagcagtggcattcacataattcataaaatcaagtttgtatataatcttactgaatttagaagtagccttggttttaaaggatcctagattaaactgtggggagaaaaaccactacaataatatgaggcatctgatttctggtctacagaagtcaagaaattcagttaaggaaaacagttttctctttattacatcaaagaaattattttcaaggcttctgaatgtgtagacctctgtgagtcttagattaattgtgtcatggatacagtagatatagaaatctaggtttatctcctctcattcttctctgtaattaaatcaggatccatggaccaggtttctgagtaagcataaagatattttgtgcatcgaattcccatcctcatttaagaatgtccatgcacagcataagagtgtagagtgctgatagaaataaaattcaagaaacatttcagaattctttattctacttttttaaaaatagagaagagtgtaaagtaaataatggagataacactctatgtagataagaagtagaaaactgaatacaaatctcacatggtttactactttgggagaacatttattaatgtagcatcaatgccttttcttatagttttttaagaaattgcagtgtctgagctacatttctcataagttaggagagaagcagttgcctaatacacctgaagggaatgttacattgatttcctagccacgtgttgtacaccctgagctcaatgctttccaaactcctgttagatatgtcacttccatgtaaaggtctctgttttcatgattcgttctatttagaaatgcctacatctctcttctctcatgaattaaatcactgtgttgaacatgtatggttcaaaataccaagacattactgtattttagtgtatagtggcctctttgaatgttctgtagtatattcaaaatcacaaacccacatttagttcagtgttttggatgcatggtccaaaatagtaataactctaaacctgatttaatgcaaaaatttctcccctccccagcttgggtccactttggctggagagctgaagtaagaaagggagatggagcacaggtggcttttttgtctgttacctctccacctacctctccacttaacccaaccccagcctgatagataggttctgaccaccgtagctcagagtgagctatgaagatcttctctatataaagcttccccaattccttggtgacatgttaatggacccttagaaagtttctctacctagacgatatatacatctatgtagatcaaagagaggtgtccagtgatgggcgtttccctgagtccatgaatatgccacatttcctgaacatcttgtgctatacccctaccccttttctgctgacggcttctccctttttcctctaagcagccaactaaacagagcccaagacatggtcatgtcccttccctgtgagactcacatctgtctgttggaaatgcttaccaatagactatgagagcacataaatttcagtgtactacctctgttctcttgccacacaggttttagtttcttcagatatgagtcaggcaacattggagggaaaatatttcaaagctgacaggtcccatggaaagctcctcagtatgattgagatgaaacagacaggttctcctttctccaccttgggtttggaagaagttgcatctcacagttttctctaaagatatccttctaattaaatttggtttcttactcttcttttacctttaattgtctatgaagtctaagaatcatggcttgagatttcttccactttctccaaaaattctgcataagaaagaggtctgttttgcacttactatggaattctgtgtgttctattttcaggtaaaagtgagccaggaaaattctatcatctagttttacaaaaatgtagaaggattagaggaattttcaaattttcttactgcattcttgaaggtgatttatcagccagtccttctggttctatcttcaaaatatacttttaatcagatcctatctttccatgttcactgctaccacacatgtccaaatcatcgatgtatcactcctggttgattaaaatagtctttctattgttattctttccactgtagcccctcttttagaaattcacctgctatattagataaagtagcctgggctaagttaataaatatacccatacatgtaattactcaaaagaacttcagattttgttcatgaaagagtacagagtatttactagttgataatgctgctgagtgtacttgtgtgtgtgtggtggggaggttgttccatgtggtcattcaggtatcagggctgatcatgtctctgccatcttcaatttgtggctgctaaggttactatggatgttgcctccatccctgtcatcgggaaatgggacggagcttgaatgggcatacatgggagatttttatgggcagatatacattagttccagtcagtctattgactagaactcagacacatgcctatacccaatggcttgaaggctggaaaattcttactgtgcactcagaaataacaaaaaaaaatctcattatcctgatcagattcctcccatggcttttcatctcacccaaaatggaattaaaattcctcatcatcatttcatatgactcccatttttacttgctctactttagacgcattggtctttctgctttgaatgttagttttcaaatactaccctctagtaaacaccttctctgattcccctatcttaagatagcatatctctaatttccataccatgatttattgcttcttatcacatcactacctggaattattttatccatatttccttacttattgtctgctttttaataggactataggggtaaagaatttgtctgtttattgtcttatttagtgatgtagtcttggagcctagaatattacccagcatatagtagatgctcaataaacatgtgtttagtgagagaatctcttttttaagttcatcagctcatattagatttcttttctggatatgactctttgataacctaagtaagtattaaatgatgttaagcaaaattagaaaattccatgtccatactcaatcattaaataatttgtgtgatgtgaccaacttgtctgaaaggtcacattgttctgattattcattgctatgtaacaaaccatcccaaaagagtagcttataacaataataatcatttgttttgttcacaaatctgggagttgagaggctcagctaaaaaattcagggtatcccatataattgcagctagagggtggctaggtctgcagtaatcttcaatgcttctttattcaaataactagtgcctggactaagaagctcctacagctggactcctcagggctgtctgtctcttctctttgtctctctctcattcttgtctctttacatgatttcttctcatggcagcttcaaggtagccagacttctataagactgccaggccaagtgttccaagaactgcatgggtttttctaatgtagcttctgaagaactacagtatcattattgtattccattcttcagtgcagtgacacaatctggcccactccctggaagggtcaaatatctctaccctgttatggaacagacacattttaaagccactgtagtatgcagtatacctcataaactatattcttcacatcatgctcccatgacgccttgatacccatttaggcctttactttttccatttttgaacccatggcctctgcaaaatgacactgtaaatgattttagaatcaatgaaatgtgctctttattaattttagaattatttcagcattttttttttgtggataggatctaagagtcctaatataaagaagtaaagaagtatgtcaatattgaaatagagttaacctttgtggaagaagtcaatatgtattcaatgaggcatgaatttcactttcataactgcacagaaatatgctgtaacctccaggaacattataactctcttccaaaaagtgatgatttaactaattctagtttatcaacatgaaaggactgtagtctttaaatatgaattttaatattaaataatttgttctgaacttatttgactgaaacatgccaaatattagcactgctaatatttctaaattatctttatgcttattacaaaaagacttataattccaaagttttatgattaaaagttcttaacatttgagtgtaccagtatgtttagagaatagtaataactaacactgattgagcacttattgtgtaccaggctaccagtaatgctatatgcattaactttttaaccatctcaatacagttatcaggtaaaaaattattattccctttttttttcagaagtaaaacagaaggccgggcacagtgcttcatgcctgtaatcccagcactttgggaggctgaggcaggtggatcacaagatcaggagattaagaccatcctgcttcctccatgtccctacaaaggacatgaactcatccttttttatggctgcatagtattccatggtatatatgtgctatacatatgtaacaaacctgcaggttgtgcacatgtaccttagaacttaaagtataataaaaaaaatacaaaaacataagaccatcctggccaacatggggaaaccctgtctctactaaaaactgcagaaattagcctggtgtggcagctcgcacctataatcccaactactcagggggctgaggcaggagaattgcttgaacccaggaggtggaggctgcagtgagctgagatcaccctactgcactccagcctgggagacagagtgagactacatctacaaacaaacaaacaaaaaagaaacctaaaacagaagagagagcattaagtaacttcccaaaagcaagctttatttaaataatagagctgggattcaaagaccacacaataagtttccagggccattttcttagccaaggagcgattcaaattttagccaaatttttacaaatatttaattttctcccaaatatttgaactgataatagtccttttctatttcctctattcttgcattgccaaagatgtactagggattctttccagattcggaatcccttctttttatactcaggaaaaaaaaatctcaacaatactcagtcttcagacatttttcttagtaacattgttttctttcccaaatatacagcctcttttaattgaaggaaattctgtttttgttaatcagtatttttcctccagtaatggtggacataatcttacttaatgtcaagttctaactaacatagtgtttacagtttatgattttctaaatatcattatattttgaaggacttgatagaactgactgtcactggctttcttacaaatgactgtacaaaacttttaaagaatttgtagttactggaagatatcagtgggaatcactaaagacaaagatacaaaatatccccataactaaaacattcagcataagcaagaaaatacaatgtatacttacaactgggcactcactgtttttgttgaaaggtatatatcttaagctattaatcagaatgccaatcagaattaattggcaatttcccagaatgatttgatcaaatatagcccatatgcatttctgaatataaattagtggtgaatttccagttactgggccagtgtagttcttcccaagcatttagattcatcaaatttaatttttactcatcaatagctttgttacataatctttcattattaaaactataatgatgatggctaaaattgtagaaaaccaatgccttcacattccccaaaagcagaactgtctgctgtgtgcaggtgtcccaattattcatgcagattaagtgcttatttctcttttcccaatttaatattctgtagtaattacacctccccaaaacaccagagagaatgttattatattactttgtagctcaaaaatgcattattatcttttaaaaattagtcaaggccatataaaatctaaaaattatcattcagtagttctcatgtgaatttaggtagctgagtttccttttgtaaataaaactaacttatccttgttcattaaaataatttatgaagaattataaatataatttcaaataaaaaattttgtctagatattgaaaaatctcctaattttatgtaatgataggcagcttagttaaacatggttcttttattaaaacatttaaattttcctacttagtaaatggagtctctcgtcatatttactctagccaagagaaaatctttcaattttcttttaaaaatgatagtagtgctctaaaagtcggcactggttagtgtccagaaaagagggattttattcaaatattaacatttctaaaattctttcattagtttctttgagactcttggtagttttttttttttttttttgataccctacagttgtaaaacagtgccaagacaatgaatactaatatgaaaacgcataattcagcattttttcctttgttgtggcaggtacttaattcccagattcactggcttaccagatttagtttggactaaatgatctataggcaggaaggtgtaggacaagatatctgtgatctggttctggttttgccttaaactagctctgacatcatagatatgtaaataggcctttggttacttctctgtgatactaagaaactgcagtacataaactttaagatagatttgctctaaccatctaaccatctataattctttttttttttttttttttttttgatgtggagtctgcctcttgtgtttaagcaattctcatgcctcaaccttcagagtagctgggattacaggcacccgccaccatgcctggctaattttttgtgtttttttgtagaggtggggtttcaccatgttagccaggctggtctcgaacacctgatctcaggtgatccacctgcctaggcctcccaaagtgctgggattacaggtgtgagccaccgcacccagccaaccatctataattctataagagcaaaatgctccgtgatccatgcccattacaaatgcaggaggtcacatgtctttatggattcacatgtattaacatataattattgaagaacactaatttcctgatgaagttctactctaaaaaattatgtattggttatttacatcaggatattaaaccaggaaaataaatgcaagtgatgctttaataggtattttaaaaatttctgctctatgctatatctgtgtcagttgctataagggaaaagtccctgaggccatagagttcatacacttatgcacaaagatatcagggcaactctctccatatggcatgcaaaagaataaactaacatcacaactgaagcataggcaatgtgttgttcaaatctcagatgaagaaacaattaattctgattagggagatagaaaaaattcctcagaggatggtgccaattagctgggctttgaaaaatgagagtatctacatattcagaaataaaatgtctctttcatttgctgcccaggatggtgatattaactagttttttgaacttacttcattttcttatttatgaagtattagaaactattgataattatttaaagtaaaaaaaaatctatgtttaacttctatctttaataatagaaccttttcaaaaaataagtaatgggtacattctattctatgatttaaaaataatgcttaaaacttatttttgcaattttgaattgcatgtggttttacatacaatttttaattgaattagcaacctgacaaattttctgtttgccgtgtttttctgtctctttgaattctgttcaaattcctccaatgtcagtgctcattctaaatgcttccaatgatttctaaatagatgtaatcaaatataattctttaattgttccttttctagattctataggataatttcttaattttagttttcaaagaatcttctcttcttctttttactttgttggctcaacaaatatacttttctgaaaactgtatgagaatggaaatcatcaacccagtaattcaaatccatcttagccaaaacaatctgttaagatgaaccaagaattagtgactgcttaaaaaaaaaacaaaaaacaaaaaacaaaaaaaaaaaaccttacacattgaaagtccataatcacggtagttaaaattgattaaactatacatttaagacatgaacatttcaatgtatgtaaattatatttcagtattcaaaataaggtaattaatttaaaagcattgagatatattcttttctgctatcttaaagtttatgtaaaatcagtgttactttctctttaattgttttaaataactcaggagaagccatctgggcttacagattgctttgtgcaatgactggcaattttagatttactttttataataaatataagactagtcaaatatttaggaataaacatttttacatcttagttttgtttttctaggaatctgaatatgccagttcagttgtcaagtttattaatataaagttgttgtaattcctgtaattatcttttttaattttgggggaagggggtccaggatgtgctggtaaaccagctctctggaaaaaaaaaaaaaagacttgatttatagtatttaccaattttcatagcatgcataatcagatgatggccaatatccaagttttgtagttggaaagaaatgcatataatctgctgtcatgagcaagaatgaagtggttccaaccaaccactgttgtaatctatagtgagactagactgtgatattgatcatctgtgtcaatatcattcagtttttctccattagttttactagaggttattcaaattccttagttactttaaagagccaacatttgaattctaggttttcttgattgttgtacatgtgttttctattataatgatttctgtccttgattattccttccttctataccattatatttcaaatgctaattatttttctaatttttaaagcagtgatttgattactgattttattattttctgtttttcctcatgtaggcttttaagactgtaaatgttcctttaggtatactattaactgtatcgcaagacttttgatatgtaatgtttattattattcagtttgaaatactttcttattttcactgtgatttttttttctttgacccaaggattatttagaactttatttctgaagtttcaaacacatgggttttctaattatatttttgttattggctgtagcttaatttcattttgatcagaatttagattctgaatgtcttagttagcacgtgttcctgtaacaaaaataccatagactgggtgtttctaaacaacaaatggtgatgtctcacagttctagatcctggaagtccaagatcagtgtgttggcatggttggattctagtgaggacacacttctggcctgcacactgcaaacgtttcatatcctcacatggaatagagcagagagggaaagccagctctctctgtaactcttatatgggtgtaatcccactcatgaggtctccactctgataactttgtctaatcctaattccttctgaaaagctccacgtcctgatactatcacaaatgggttagggtgggtaagtagggttacaacaaaagaaatgttgggaaaacacatgcattcagtccataacactgaattacttttatttttactttattactcagcatgtcagttttttttttttttttaatttttgctgttttttagcttcttgaagtgggaattagataatttacttgagacttttcttcttttttactgtaggcatttagcagtgcaaatttccctctcagcacttctttaactgtcttacaaattttgatatcttctgttttcattcagttcagtgtgtttgttttttaatttcccttggtacttctttgacccatagattatttagaagagtgttgttcagtttccaagaatttggagatttcctataatctctctgtcacttatttctcttttaattctattgcagttagagaacaattgtggtttaaaaaatatgttcaggtttgtttttaagcagcatatggtctatcctatgttccatgggaacttgagaagagtaagcattcttctgttgttgggataatgctcgataaatgttgatttgatactattagttgagttctataatatctttgttgattggttatgtagtttttccatctatttaaaggggggaatatcaaagtctccaagtataattgtggatttgtctatttttcctttcagttctatctgtttttgcttcacatattttctgcttttttttggagggggaagggtatatacagatttacaattgctgtgactttttagtggttggaccttttgtcattgtatatgtccctctctgaatctggcaattttctttgccctaaagtctacattatctagccaccctgcttacttttgatggttgtttgcatgatatatatattttgtccttttacttttaacctacctatatcattatatttgaaatgaatttcttatagataatatataggtgagtcctgttttttaaatccactttgccaatccttgtttcaattggtgtatttagataatttacactgaatataattattgaaatattagagcttttctgcaacttaccttctgtttccaattctctgtttcttatttctgttttctttgtcttgacttcttgtgggttactttaacatgaagaacttcttcttcctagaatatagagtagtgtacttttccctattcctttcactaagtataattgcatatttcaggtttacattttgatttatttatagtatttttaagtgtatgtttttatatagctttccaccttccaccccacccccctaggccctagctgtatttctaagagtttctttgttatctttagacattttatagtaagtgcttagatgtggattttttgtgtgtttattgtgcttggattgttatgagcttcttgaatatgtggattacagttacataagttttagaaaatcttgggccagtatttctgcagatatttactttttctcattctttttcctgtctctttcattaatttaatttttcttatgttagacctttcactgagctttacgtattttgtgctctgtcctaatttttcctccttgttcttctccatctgtgcttcagtctacaaattgcttattgttccatcttcttgttcaccagtcttgtattctgttgtttctaatctactagtagacatatttattgaattcttcatttcacttatttaattttttttcattgtaaactttacatttgatttagttttataggttccaattatctggcaaaatttttcatcttttcatttagcttttcccagctttgtatcctatgttcttaagtatttctatcatagctattttactgtttttatctgagaacacctgttttgatcatctgtggtctgttggctttgctatatttttctttgtcttctctcttgacaagtcttattttttactgactgccatttattttgtatgaaaaaccggctcaggattaggttatcttgcttcagaaatatttttcttttcttttttatattactttatcttataatagataaagtacagtcttactgtttcattccaatcagtggctgagcatattgaagactggcttgttaatgctgtatttgtctgctatttgccccattcctaggacataacctttcagtgtttccagtcgagtactctggaccattcactgcagatttttccttggattttcagcctacagctgtatacctgaaatagacaatgacttgaaagaaaaatagctatagtatgtgaagctcatttttttttttttttccttccctggaatttgatctctcaagttcaggttgcctgaactgatatctgatactttcaaaaaggacttaaaaaaatctcattggtttttcttttttctctatgggagtgttgatcagctgccagtgaccccagaaaagtcagaaatggaaatgcaattcagtgtactttgaactgaatatatttgtagtgagacagactaactttgtatgagtatttgaagaacaatgatgatagaacacagaaaactcaaatttcataagtgagtaaaataaaacataactgagtagcttaagttggttaatttttccagcataaatttgatactcccttaaacatctatagttaaaggagcttttgctatctcctaattttgaggagcaaaaaatgtaacaaaatatgaaaagactttaatctgatgtatttacatagtaaaggtgataacagtagcataattttacaatgtaatgatcaacagcactgaaacaataattggcaaatggttccatcagaaaatgatgacaaaatttaaattgagcaataaattcacaattctttcttccctaattggatatgtctgaattgcagtcactgcatactaaaaataatatggtaatggatatgtctttttccggtgataatttaggaaccattcatacttaccagttaacatatgatatatggttgtatgtaatacagcaattttatttaggaaacatgtcatttccaaaagtaagctcataatagtattttctagatgaataaactctagtgtttttgttttgtttttctaaaagcacatgtgtctaaattctctgcctaattttcctgaccttggagaaaaaaactaaaggcacagatgttatatgtttagaagttgcattataagtgggtagtatattgttttacaaaaatagttttgtgaaattatatttaaaatattacttaattggaaaatatttgatttttataatcttgatacttttgatacttagagacatcttatcattaagttgttcgtgtttccgtttcatcatctgtagactaaagataacatggtataaatgatctggaaatgaacttttgaaaaatgtatacatttaagagctacaactttttttttaattgagaaagagttgtttatgagtaaaatgagaaccagaaagtaatactattttaaatattttttaaaggaaattttaaaaatgaaggtgttgtcaacaatgtaaaataccagaatgagttaaggtagatgaagactgaaacatgaaaataatgctgctggtatactgtaacatagagacacgagtaagaaggcacattttggcagatcgtggaagtaactagtatttaagaaataaagactctggagttggatgatttgaagaagttgaccatgaataaaagtaaaagtaggatatgtgaaataatggtttttaatataacagagacttgagcacttgcaaaagcttgagttaagtaatcagcagcaagatggagattgaaaattgaagaaaggaaatgagcagagtgccggaggatgatagatgcaggcccaggtacaatagcaatgggacaaagaatggatcattatgaaacacaatggaaaaggctagaaagaggtggaactataaatgcgctttgacgtggtatggaattcactttgggcatttatacttaatgctgttttagtgaagtaaaaggccatagcttttgctgactgtgaccagtaggctcaggtatggttttgaggatagtaagaacagattcttgaagaaaagataagagaatgtgagggaggatgcacaaagcatcactgagcaacagagagattgttgcatattaagtggccatgttcttaatatttattaataacaaaataatttaaaactaactcatatatatctcaagatttgttttctagaaaaatatttttaattgacaaaattatattttctcactgaagtaaaacctttccaaagtctccatggaagaaaattagcttgatcttgcgttataaattgttataaatttcctccagaaataattgaattaaatgtaagtgaaatataaacttatttttactactcttagtctctagcatgtctgaattgattttagaatcatttcttctaccctgtctgtaatgacaggactatatcccactaatgcctgaattatgtaattggcattcagtatctgttaaattgaattagacaaatgttaactttcacctgcctatactttcctcattctattttactgaatttcaggtggactgcaaatagaaattaggagaaaaggccgggcacggtggctcacgcctgtaatcccagcactttgggaggccgaggcgggcggatcacgaggtcaggagatcgagaccatcctgactaacacggtgaaaccccgtctctactaaatacacaaaaaattagccgggcgtggtggcgggcgcctgtagtcccagctactcgggaggctgaggcaggagaatggcgtgaacctggaaggcggagcttgcagggagccgagattgcgccactgcactccagcctgggcgacagagcgagactctgtctcaaaaaaaaaaaaaaaaaaaaaattagtagaaaatcggctgaaacaaataacacagtatatttgacaacattcatattttgtcaacacagcctaaaactacttattaccacataactactgacatttggatgcaataaatgtctttctaaagtaaaactgagtgcaaagggataatttggctattcttatcactaaaatttttgccaaattttaaataatgctatcagaaattatctgtatttttcatatttgatttgcctgcatcccaatattatttcattctagcttgtaccccaaatagtgttaagaacaagggaatacttaacaaaaatataattccatgctgaatttttctgatatctaaaaggttgaagtaatgacatttcatcaatgcttgggttttgctcaattttgcaacaaaaatgttagaatcaaggacaaaattaaatgtatggctccattgttttgagcagtgagtagttgtggatctctcaatctattaatgagaaattatccacataataaattgccctaatttatgccttctttggatgactaaaaatatcacccaagtaatctgtaaattacaaagggtattttattaaggaatttttatgtcaagtgaagagtaagtaactgttgatgttcagagagttttcctcactttggccctctcttcctttcttccttccatccttgtttccttttttttttttcatctcacttacatgtggaatctaaaaaaagttgtattgataaaagtagaaagtagaatggtggttacgagagactgggggcatggggagtactggggagatgttggtcaaaggatacaaaatttcagttagataggaggaataagcccagagaggtctcttcagcatggcaagtgctggtcaaatattagtagcttcctagagaactatgtcctgaataaattataggtgttatcaagcctggataggaaggactgttaggatcatttttcagtaatagttataggtagagaaagtagaaatggagatgttatatatttgctgtgcttagtagtcaacattttctttccaaaagtttatttttgaaagattattttatttctctagtgaaaaatgtgtgaatgaagttatctcagttttttcttaataattttcccccaaatttgagaaggaaaaaacaggtacataggttggtgagttgtgctgtcctaatgtctaaattggatttatatttcaaaaatttgatatggatattttctttgatatgttgacattctaatgagtttgtgagagattctagctccatgttttttatgggaggctgtctcggcttgactgttgaagcatatggttctgtacttaactgtctttcggagttacttgtcagggagtataaactcagttattgctacaaatatctttcaaagccttaattcaggatattgatatatatggaggagagcatgtactatattttcaactattctaggtcagtagatctcattctgaaggatgaatcagaatctttagtagaccttaaaaatctagatccccagtctctactctaaaatatcatacctggaatcactaagggatgtaattcagacattgtggtctgatgtttaccttttgttaagaactggcttcaatacagtaaaatctgtccctgaattgacatatcctatcatattatatcatatttcctcatccctcacgtattagaattccttttgctgatttctcttggcctgatgttttaagcctacactaagcagtttttaaataaatagtcccccaaaattgtttcttgtttgttgtaagagagttttcaaagatattattcatcactctatcttataccatttttctgagaaccataaaagagaagttgtacttctcttgtacaacttttttttaatctgcaagaactgtccgttttataattgaccatgttttccttatcattttggttgccgtaatgtttactgtgtaatatatgacttaccattgtaaaatatatagaatttattgcactttttttttcatcaatgtcagttctggctttgtcttattttcctaactggatattatcattgcttcttttttttttctgcagatgcactgtgttaacaataaatatgaacacctggtaaaatgttcttagaacatggctaggtataagtaaattagtttcagcttctaacttgggttaagtcccattatgtagaaaatgcaaaataacatcacacatatacagcgatcatgctgagcccagaagaacacaactaagaacaggaaaacaacaaaagaaaacaaaaaataacagtaatacagctatgaaaagggagagaacaactgcatatgataaagttcatgtacatctttcacaaaagaggcagcgtagcaaattaggaaaggaataaagctttcacactaaccctatgatgattgtaaggaataagagctgatagttacaagcaaagaaaatgaccaaaacgaaaagcaactgacacaaagtaaaaaatgcatgcctgcctgtagccatttagtgaaaggggaaaagatagtgtttctgttataatcaaaaggaatccagcgcctaactgtgctgttcagtagtgtaaattcatgatgctggtgcctgaaaatgcttaatgtttaaagttgtggtcttagagtgctgttttcaatgatactaaaaaaaaaacttgttttaagttcatgatgagttgccagccagacaagttttaactttgctgcaaagccctattaaatgagaaatgattatcttattaaaaaatgggtgagtagaaatgtgcaggattttcacataaggaaatattttccaggtcacataaatttcaattatgactctattttgtttccatgaataataatgatgaaataaaacatatgaagctaatgtattgcaccattgcctaagtcaagggggtggattcaagaaaattaattctgatataatcttctgaataatagctttataagattctcattggtttgttcccaagtttcatgtggacttccaaataaaggtgcatggttcatatagtacgatttcaaatatgtagataaaataggaagtgaaaaaggagagtcagagtaattaaagatgtttttaaaaaataatgcttattggttgggtaatacacacacacacacacacacacacacataacacacactcatacataacacacactcatacacatatattgaaatacatcgtaacctgataaaatgtgatggaacatggcattgtactttcagcagccccatttatacatcttcatttggcctaactgagctttcagagagtcatatgttaagaaaaatgtgtcattttgatttttaaccgcaagaaattatgaatattaatgaaaaatattacatatggtatatattggatggctccacattttatatttttgtttttttcaaaatatctagaaagttaatgttaaagagtattaagttttttttcctctgcatgttttttggaaagacagttcatctgttataattaaacttaaaaaatattgtacaagtttctatgagattttgagtagtagtttacaaaaagcatatagtatttatcaggcaccatcactaatcgtacccatttgtataagaaggattaatttatttccttgacaaatattttattgagtaaaagtcagttttcttcactagttttatttgttagttattctttgggtttttttgtgagtattcgatactaatttttatattggtgatagttttcaaagggtcataaatgtttagcttaattcgaggagaatagtttaataggaggaggataatctagaaatgtaaaaatgcatagtccactgttatcactggagggtacagattttgtgtctgtggatataaataacaataaaccagctgattttttaatattaatttctcaacttcttaagaaaaaattttttaaatatcaagaatagtacaaagaactctcatatatagcctttacccagctttgctattagttgagtttttctatttactttatcattctttatataaatgtgtataaatgttttatgagtcctttgagagtagcttggtgatatagtgcctctttacacaaaacacttcagtgagcatttcctgtataaccacagtatagttattaaaatatggaaattttatcttgacaaaatacgatttcattgatagcccattattcaaattttgtcagttgtctgataattgacaaaatggaacaaatttgttcaggttaatgattaggtgacaacaatcaatctgatgactacttggtaatagcttcagatatgtcccctctggatgaaaagctttacaggtgttgtatcttccatgtcaccaacctaagtgctgtgacaacttactttgtggaagtgagggtgctcaggaagacagcaatatgaagtacctctgttttcaggaagcttgagagtccagagaatacaaaatatctggaagagagttttcttatagacaaagaatagtggcaattcttcagactcattacatgaattggggaaagcattacaaaaaagatgacattagatctgggcttcagtgactgaatccaatgtggacagagagcatggacaagatgtcatacaaggcaaatccaacagtaagggcacattctgggagactgaaaagagtaaaggaaatgcggggaaaggtttgattatgtggagaatgtgtcataaatgaaagagtgagaaggaaaaaaaagatcagacataccttaaagtagtgatataagaaatttaattgaggaacattgattgaagtgctgcatcacataaaaatcgagcggacaatgggaaataagcaactgtatctcagagagttgagaacagagggttttactaaagtgggacctgtgctgagatacagactatggatgtaaaagcaagctgtgaagaagtgatagtgtagacggagaggagacaagaggtgcccagattcaggacaaaggaaatggaagtataattggtctgggagctataaacaaaaggtcagaataggttgtatacagcaaatgcagcaggagtttggactgagctgctgctcctcagaacatattctccctggcaattgttaaaagttctgggctgggcgcggtggctcacgcctgtaatcccagcactctgggagggcgaagcgggcggatcacgaggtcaggagatcgagaccatcctggctaacacggtgaaaccccgtctcaactaaaaatagaaaaaattagccgggcgtggtggcgggtgcctgtatagtcccagctactcgggaggctgaggcaggagaatggcgtgaagtcggagcttgcagtgagccgagatcgcgccaccgcactgcactccagcctgggtgacagagcgagactccacgttcaaaaaaaaaaaaaagttctgttactggtgagaatcaaaactattgagaggttaaaagtgagtgatttatatattactatcttgagagtgagaaataaaaagagagtaaataagaaatagcttcagaagataaagaagttgaggaaagactttctgtattatattagttgttgttgctttgttttaattaatgattaattaaattaattaatcattaattatttaattatgatcatgctaatttaattatgatcatgttcataaatacatgggaaagactttactgtgaggaaaaattttaagagaaaattgatgatgtgtgagtgatattcaatgcaaagctggagctgagttcaggagcacaatttaagaggtcagctttagaaagatcaacccggcatcctcagagacaggtgggaaatgaaagcgaatgtttgaaattatagagaaacacattttgaaggaacgtgagaggattgtctagagtgattgaaagctaagctaaaaccaaaagttggcacagtacgaattcctattccagtacccatgaagctgccactctctggaatgacctttcagcatctttaactgtctgccttccttttatccccgaattctcaggcaccaccaaatacatgaagtcttctcttaccctttcacaataatgagttgtcttataataaaatactgtcagtctttgtctttatcaaatttttggtttctatacttttccccatcactaggctcttcatctgtgcacctttggcagaaagaatagtgatagacatgctgtgagtgctcagaaatacggaataaaaagcagctcacatctagtgtttggatattctgtgttggaactagcatactcagagtttcatggatcaattgtatgcttcataattactaccattttacagatttgggagattgaggctctatagagctaaccgtacaacattacactgccaataaatgatgaaatcatattagaaccaggcagtctgacctcagaatacttgctcttcactgttttctatattgactctcccagaaaccattgccactcaccaaaaacttaataggctattaatcgcttacccttaaattatgaccatatcaggtatttagatattccctcatgatagttggttacattcttaatactcagtgttagaaattcgtaggtaaagaaggttgactttaaggtgcttaatattgagccctcaacatttttatcatcttctgaagagatctggaaataataagtgtttttgtgaaacttttctcaagctttggccatgtggaaaggaagtagttccatgttaatctatgtgagatcaggttagactcttttgttattgatacttatgggagttacgtttaaataacatttcaaatgttataattaggattaacaggcttttgaagatcctgcaaagtaaaaagatatgctatggcactttttagtttgtgccttaatatctcaataatccttctgggtgagctgatgacctgccttctctgttcgagccctgtatttctaaaggatggcagcataaactttttcaataacagaggctctcaaacccgagagtatatcagaatcactcagaggggttgttaaaatgcagatggctggactctataccaaaacctgaggattgggcctggggtgtcatccaataacttgcctttctaacaaattctcaggtgatgctgctgatattggactagggttcatacttggagaaccaatactttaaactatcactatcatagtttcactttcaaaaagtagaaataacttcagtgaattactggtcttatcatcaactcattttccttaagaatgaatttagatcaactcctccaacataatagtcattgtttctcttagatgtgtcttaacattagactgacttatatccaacaagtctctaagaaatgcaaacaattgaacgcaaaatattttcttgaggtgctcacagattttgcacttaaaaaattgtattttcactgtgtataggtacaatataagctttctataatgtctctatccacatgtattcttctatctacctcactacagagtctaggtcctagtttggcttttctcctttcttagaacgtgtgactcttatttcttatcagttaactattaatgaatacattttcatgtacctgcaacatataatacctgcaaacccccccccccccaaacaacaacaaccaacaaacttcctgggtcattttcgtagaatataaacttgtattcactcttgtttaatatttacccagacaatgtctttgaatttttccttaaattgagcctgaacaactatacgatggtgacagactcctttggttcctgtataaagttacagtagttagctcaccttgaggtatagattgacaactaggattgtgaattttattgttatgatcactataaagaagtgggtaaaaatgctgcttgtttcatgtctcctttatgcaggtgcagaaaatacatttgattcagatctctgaaacaggaatagtaatttttgtttgttgtttatttgaggaattggagtatttttacgtcccagatactgtgaattgtgaaattagtatttccctctttgcctttcttcctgtaaagagtaaagccaattaaatggctcaacaaacaattgtacaggatggaaaagtatgtctataccaccagcattttgacttatttgcttgtttgatagaattttctcattaaaaagagaaaaaaaaaacccacagacactatagtatgtattttaaaaatatactttaaacacacctaaggaaaggtagggtatactttttcaaaaaggaaagattatacatttctatttataatacatataacatattatagcatattaaatttatttagttttgagtctcttcacacctcagcaccctgccatcttttaattaaccaacacatccggatctttgttttgtggtttattatcagaaactctatacctgcagggcattaaagattaaacagagcttaccacattggagaagatagctttataaagggattaaattaacctctttaactctcaaatactctcgtacttacatgacattccatctttgagcaacatactggggtgtgtgtgtgttgtaaccataagtatttctttgacatttgaaattttgtagcaacgaattccctagactgatcctattttcatctattttaataatgcacatgactaaatttaatgttgtgaaagaaaaattacattggatgcttgttaaaaatggcaaggaatatttaaaaccattcccatgtggggagagagatttaactcaactcagatgtaataaaagcaggaggatttttaaatgctgggtgaactaataggaagtactggaataggctgggtgcggtggttcacacctgtaatcccagcacttcggaaggccgaggcaggcggatcacctgaggtcaggagtttgagaccagcctggccaacatggtgaaacccagtctctaccaaaaaaatacaaaaattagctaggcttgatggcacatgcctgtagtctcagctacttgggaagctgaggtgggagaattgcttgaacccaggaggcagaggttgcagtgagccaagatcacaccactgcactccagcctgggtgacagaacgagactatgtaaaaataaataaataaataaaataataaaaaaaaagtactggaagactttatgggagaggttggtcaatgtgattaaaacatctgtctttgctgtttgtctcttttcacatttcagagttaggctctaggctcttaccctctacagagaatgggagataggggcaatgtctcaggaacttcaaagatgactattatatttcaaagggatggctcccacatacttgagaaagacatttttgagtttcagattatttacaactcgatggagcagaggaagaatttacaatttctctaaattttcaagttttgtcgtgtaaatgctgtatgaaaatgaggaccaggggcctatagtaaaaaataaatctatgtaacagaatagaaggatgattaccggaacaggggtgggattgggggaggaaggtgggcatggttagttggtataaaaaatagttataaaggacgaatatgacctagtatttgatagcacaacagggtgactatagtcaattatgattatttaattgtacatttaaaaataacaaagcatataattggattgtaacacaaaggataaatgcttgaagggatggataaccccaccccacccaaaaaaagaaaaagaaataaatctatctaaagtttagttaaaatagggggaatggttagatgcgccaggtcaatagtattcactcttcatcttcttaccagataaggcaattaagataatttacataaattgttagtaattaaagatatttctcatttagtcattcagtatatctaagttattttatttggtctgtagtgttaaaatgaaaacatatatttaaatgattttaacacatttttcttttaaattgaaatatgcatggatctggttgcaatattctacatctcaagaaacaaaacaaacagacaactatctcatgttctaacatgggcagcaaaaggaaagagaacatcaagggaaaactccatggcttctaattacggcaaaatgatttagaaaaatcctacctttctcaacaaacctgactttacaactgctgtttgaatgatagaactgggacaatgtcatgacaattgtgatgtgaatgagaacagtccactaatttattttcgaatgttagaactgttcaagtgatagatagaactcaaatgaactgttcaaatgatagaactcaaatgaaccagggagactgtcatgacaattgtgatgtgaatgagaacagtccatgaatttattttcttaaacgttatatcctaccagttatagaggccagtataaaagagatgttcaagaaagaagagccaataatgtaaagtgacacgaagtggaaagtgtaaataatacaaacatgaatgggaactagaaaatattggattaattgattaggagatcattactaatctttgagccctcactgccagagtagcatcagtgaaacccagcacataaagtatcctagtgagtgagtgcaactggtatttcaccattttatcaagcaatatgccacaaatggtttgagggattattggggttaagagaagtgttttaagtttagaagtgacctaaacaagtttcagtctgagagaatacagtatggaagaggaaatactgatatttcaaaagaagtggccaactggatgtaggacctcaggatactgtgagagaggttggcagaaggggcagaatcactttggaaagggaaagggcaccgcttacgagacagaaaacaaaaaagctcaagaaaggtaacgaaagattttagattaagttagtctcattatctcatctaattttcacaactacatgatcaatttcataaatattaaggatgtactattttcaaaaggatttcaaatgaattatattttgtaccaatctttctaaactgccactcatctgatagctgtttctagtcctaggtctttagcaactaataaaaagtataatatacctgaacacattctcatttctcatagtgaaaaagtattattaaatttgatagaaaaggtgagctcaaaatacccactaatttttaacattatagggccagcaaagtaataatcttctattcaaataactggtgctaaggtatcatgctaattcagataccatttacatggtagccacatgtaaatgttttcatttatgacaccgataaagacattttggtaatttatcagcaatatatatatatatattttttttttcttacttaaaataggattaaaatggtaggaatggcaaaataataatgataataattatgttattattttagttcactttttcccccttcttaagaagaatttaccccaaaaagagtacattgtgcctgcctaaaacgtcctttctttctctaattcttacccaaaatgcttacctgctgatgttctattgagaaaggatattcaagagacatttataattcaaccatactatgcttaaacaattcaaatgattaactgtactaattagctttgagtaaattcacaaaataaatagagccttgatactttacaattaaatagaaccccaacttcatttcatcgtctgactctacatttagattatcaggggtgctatgttaaaccactttcaggaagggtgtaacgtatttttgttcttgcattattaatgaacttccattcagactagattggcaaatggagttgttagatacagagaagtgagtataagaatacttaatagcatatcagagaaaaaaatttaaaagacctccctgctcatatccattttccagaatctttaatacttttaagactaacactgcatatactttttataataacataagatataaataaattaactcaaattattatttcttcaagcaaatgagaaagattaagtcttgttcatatcagtgcttagagttgtacaaaagctgatgcatttaactcctctttaatgctgtttgcatattgcaaaatgtacatttcagagacaggaacaaactggtaagttaattttgttttctaaattgttggttggaaagaaagaggcacgcggctcttagtgtaggtgagtttattagatgaatctgaaatatatttttataacttcaatgtaccattacttattaacttaaaaaattaagatcattcccaagccctttagctttttaaataataaatattattttcactagagagtcacaccttgctgattatttcgtgatgctcataagggaaatgcctacaatattaagaatggaatctaattttacagtcttttcaatgattctcttcgactggcagattttcttaggtcattgtttcccaaactttattctctgggatgctagtcctcagagatgttcccccttggtagatgcaatcagcctctccagtaatgtgacaatttgcatgttagcatgttcaaagctctgaaaagtttgggagaaatacgaactttttttcatatagtcaattttcaaactttatttgttacactttggttggttgtttgtttctttgtttgtggtggagttttgctcttgttgtccaggctggagtgcagtggcctgatcttggctcactgcaacctccggttcccgggttcaagagtttctcctgcctaagcctcccaagtagctgggattacaggcgcctgccaccacgcctagctaattttttgtatttttagtagagatggggtttcactgtgttggacagactggttttgaaatcctgacctcaggttctctgcccgtctcagcctcccaaagtgcaggcatgagccactacacctggcctacactttgttttaatgtaacctcattaaccattttctgaaacaggttttagcaaatactatttcagacaatgtaaatgtgcgtagatgtcagttttttttttccttcttccatcttcagattatcaactgattatcagttgagtaattatccatatttgctcagaaatgattattatctgaagcatataaacaagcccttttggatgaaatcctcctttacaaagagagttgtctgatagccgatgtcccatacacatagctaactagtcagtggatgtgctagaatgaggtttcttgtgttgtgtacagaattctcttcctcacatatattcccatgttgatgctgtttgttcatcaagtgttattctgttcccacaacaaaatcactgaatccttgaggacatcaaatctgttctttttcctattctatttccccagatgcatctcagaacacaagactgcaacacaaaatcaaaattaacaggaacttaccatactgaatggaaacaattggcatttgtaaagttaatgctttgaaatgtcaattataattaaattcaataaagagtattaagtaccaactttaacaatgcaccatattcaggatttgggggcaatgaagaagagtaaggtgtacccactccaaccccaggtgttcacagccctattgaggagaaagataggttcctagttatagtaggacagattatacatactatcgtttactatcttttaagttgctttgctgatgtaacctatttccaactgcttatttaattggcattcagtgggtcaggaaaatacttcatctttcacacatagatatttttattctcttcagcaaagaataaataggaaattgatttttatttatctgattgcactattaatggtttctatatccagatctcaacaaggttttgtcagtcctttaggttgtccagaatcctacaacctgattataaaacataatcgatttagagagtcttttcagcaatttatcaacctgaaatggtgatcagtggtcactctgtatcttacattcttctgaaatagatacttaacagaagctaaaaagctgacacctcatatttattatctccaaagagatgcttttcacattaaagtataagactgttgtctttttttgttctgtcaataaattttagtttattattgaattactatgtattgcatacttcatggaacatttgaccaacaaaacaatgtacgttataattttaaatctaaaactacaatcaagatacaatctcacagcctcctctttgtggaaaccacaagcctagacttctctgaaggcaatgttccctctttcaagcctatgctcaagatgtaatctagttttacataacaggagtcttccattgaaccattgacattcacattcacaggcatggactcttatttctagggaaggtgagcaacaaaccctacccaaatttttgcagtgagtagcctctgtttcaatacttgggtttcactccatttacacagcacatctgtgtagcctgaagaagagggatttcagtaagtgcaattagaatgtccttgcaagtatactgttaaaaagtgaatataggccaagcctgtattcaattcacaatattaaaaaagggaggctatagttacattgcaatgtttccaaactgattatccagaacagaggttcagcttgatgccaatcttttacatgcactgccagactaaacaagtaccttttaaggttcatctatcacgatttatgatacattaagccaaatctaatgttctctcaggctggtgttaggggattttcaatattcagactgagaaattgcatttggggaaagggatttctgctatcctttttccatagaatttgtttagttctatagagtctcaataagtctattggacctctgttatactccagtactaattacagattgattttaagagtttaaaatcttaactggtagcaggaaatgactttaaattaacattacatgagctactataaattgttcacggaaaaagagagcgtttaattataaacgaaggaacctgctgcccagttgattaactacatcaaacactttatattttcaaaactcaggcacaattgttaataagctatttctcacaatgtgtctctaagggagcctaactctatcaccttctattttcataaatgatgcacttgatccataaaaattagattgcccatcttggaccacgtagacatgaaaaactggaattaggttgcaaattctcaatgtacccagacctagtttacagagctatgctcttagttttctgagctaagtaagaaaacaaaatttctctgtcctctgttactatatatgagtacacgcacacacaccttttatctgaacatttcttttttgtatgcaaaaccagttatgttattttgttagagggacaacataaacagaaatgactctctattaaataatctgttacttattctgatgttccttaacttgagctcacttagcagacttgtttctctttttccctttagattctgtgtcattcagaagactagtacaattgacttaggccaaatcatagaattatctgataactaagattcaccaatgtttttcgctatgagttcactcttaaaagcatgcttgattatattgctttttattaatttgtctaattgtatattacatataatcttatgtattaattgattatgggtttataatctctaatattttttctttgggttttaaagttgtttttatgaataaatattctataacataatacagatactgatttcatatttttatcagtattttttgagttgtttagtattttaaatctaatttggctggtaagattgcagttctctcaatatcactttaatatgtcactatgcagagcacagaagtggaaaacaatagctgcatggtaaataaatgacaaccacttaaacatctcagttttgtgtgtgtttacatatgcaaccaacatatatctttgtaatgaaaactattctaaaagatatcccatatgaaccctgatattagtcatatggttattaataaattattatatgcaataataaaactttcaaaattgtaatcttaaaatttctctttaaaaacaggataaagaaaattcttagcaaatgaagggaaactctcatttaactgttatggtgctaataaaagtaaatgctcttgacattaaattttacatctgtttttaacagaaaatatattttatactcatatgatttgctttgtactgtaaaacttcaattacattggcattgtatgagcacaattattatataccaaatatggcagccagatatggacatttcatcacatttcccttcccaaatacaatgtaaagtcataggtcagtgcctgtgaaaatatgaatatatgattctaggtaacagaataccaaaatgtatcctaatttcaccctagagtaacttactgataaagatatggttaggggtaaataagattcataagttgcattttattatggaaaaatgtaacaaatgacagtatgagaatgtgatttaagtatttgtcttctcatgttttcattaagattaaaacttagtgcattttctaaacagtaattcagggaggctgtcctctgagattgaaacttcttcaggcatataaaatatttcatcgctatatatgtctgtggtttttctagacataagtatcataaatgttgtgtgaataagttggcctctaatctatgaatatgcaggctgcagtacatgagggccatggttatgtctattttgttcatgtcctgtagtcagaacccagcctagtggctagtcttgaggaggagcccttcaaatatatcttaaatgaaaaagaaagacacaaacattgtttttgatatctatgtatatcttcctattgagatgccaacaagaaagcagatgaaaatatttgaggctaaagagttttaaaacttagaaaagtttttaagacttaaaagtatatttatctctagttcattctgcatgattctatagatttttatagtgcttactggtttttattggactaactgacaaaaatatggttaaactaaggaggggctatccagaatgctgttagcagccttctagtgtctgtaggtcctctaaattcatggcatttttgacaatatcattacatatttaggcttaatgttaaaagtggatgaccaatattttatcctgataattgtgtttcactgtgtatgccacattttgtcatgtagggatagtcattttaaaggagagggaaatggggaagatgatgaaaaaaaaaaaaaagaaaaatctgtgtataagagaatcactgtcacaaaagagagaaagcttttccatattgagtattgtggtatcattcaaagttcaggcccttagtagaaagtctatagatgctcccttggcagccttttggtagtcattactactgacctcttgtgaaaacagcactgcctttagacctggaaaacatttctgttagcatacaaacctgttttctaagctgtctgtggagaggttcttttggtcatccgcattagagagccaacaaacagttttaactggaaacatctatgtatggtagaatagaaaagttcatagtaaatgttttgaacatgctttttgccccaggttttctttttcagttcagattatttcaatatatgaaaatgtttcatgaatgtgaatggactcaaatattaccgaactagtgttgatcaacatatagatacaaccttaggagaatgttcttatgtcctttgtgtaatatttgagttgtttggaaaattatacaataactaagtagtgacatagggaaagtattaggttaaatgagatccatattcttacttttaattttaatatgctatgactacatagaatctgtcatttgttcaaaattcaatgtcaatatttaagtataattgcacatagacttaaggcattacttttgatatcactggaaaatcttaccaaatttataaaaatcagtgttcacagtctttaattgacttagatttttttagattatttctgggtacctgcatgaggttttttgatgtacacacaacttggatataaaaaagaaatatatgtacactttatttggttttactttatttcagctcagagatgattatctacagttaatgaatccttaaagttatgaaagtaacactaactccttatggaatttttatgttgtagcattaaaaaaaggacgattttggatcacaccagatccttatcacaaagatgacaacatccagattggccgtgaggtgaaaatatcttgccaagtagaagctgttccttctgaggagctaacatttagttggtttaaaaatggtcgtccattaagaagttctgagcggatggtcattacacagactgatcctgatgtctctccgggaacaacaaacttggacatcattgatttaaaattcacggattttgggacgtacacatgtgtagcatctctgaagggaggaggaatatctgatatcagtatcgatgttaatatatccagcagcacaggtaagaggcatatatttatgatgtaaaagatgttcacatttagaatgattgaagtttaacagatcaagtaggttttagttaaaaatattttttcccttttaagtttcctaaaaacaaaattataatgttctgaatgctcaatgaatactaggttctgaaacactgttttatcagttttgatttagatttacataagattttacagaaattatccaaataaaattaatagcattgactaagatagatataggcttataagttaaataatactagtatttcatcaaaatactctgaagagtctaaaattatattaataaaattaaacaacaaatgtctagagttaagacaattttcagaaattttaaacaaagcataactatatagtgctaagaagaaaatactgagagataatttaagagtgttcaaatgcaaaatatgtaagaaatgtaccctacactaacaaaaattgatatgttaaagttgtagtcagatgtgatttttttgcagaatcatatggtaaaatctgttcataatgaaaatagttaagtacgaaaatatattggagtgaaattctttcttttaaagttaaaaacgaaaacatgttattagttttttcttgattaaatgtacatctgttgacaaggaaaattacagggatttggtggaggagggttcattcagatgctttaaagccctgtgattctatgaggcacaatcagcacacatccagagtttcaaagtagctgtatttgttttgccagcttgttaccaaattgaattttaatggaagattcttacatcatgaaagataaataatatgtgttgaaaacatagagacaaatgtagtagacacatgatcaggcagcgttttgtatcttgtactttgaagtattcacctataattttgtgccttctcatggttccaaattgcagtgaacactggattgattttactccttaagaatagaagtttatgattcaggctaacaaaaatgtgctaactttgcacaattgtgctttgttcctagaagatattcaatttttatcatctatcactaaaacaaaaggaaattagggtgatgaaaagtacttgtgtttggacattatttcttttctagcttaaaaaaaagctagagacaataaaaacatttttaaaaaaattctaacatatttaaacgttggtgctagcgctaagagatggattattttaggatatctgagggaaaactgttgatacacacagtcagttatcacttgtttatgtattcattcaatcaacaaatatccattgattcttcacctcagtgtgctaggtgacactgtacactgtactgtatgacattccaatataatatttcctgtaagagagtaagagcaaattttgtagatccaggataatttgtcctcattttctgagggatagtttcccataaatgttctagacttaatcaaaaccatttctttgtttggtttggtttggctgggttttttttgtttgtttcctttacagaaccagtgacacaaagctcagatccaaagaatcaatgcttttatctaaaagaactcctttgatgggagcacagtttatataccattaaacttagacaaaagatggagcacagaatggagacaagaaagcagcattatatacagggctcacaaaacgagccctaacatttatttttaaacatactagttatattgcctgtttgaaactatgtgttatatatgacaaaatagtaaagatgaccaacattgatttgtgaaatttccaccaatcctttaaagaaaattcaagattagtaataagagattggttgtaatcattaaattttcctaactatcattaatttgcctggctacccaaggtaacactattggagataaaagaaatatattgacttcttccaaaacactacccctggaaagtacccacttaactacagatagatgtggtttctccatagaatggaagctctacaaagtctgagactttgtctgcatcactcattgctataatctcaatagccgaaacaatacatggcacatagaaggtactaaacagataattattaactaacaaaatgactaatttatgcatacacctttcattttaggttttctcccctcccattgtctctataatatagacatttgctgtgcctcttactgcccttattgtaattccctactgacttaaagttatttgatagacaaatttatagtgacttaatgttttatcactcccaaagacaggagcagctcctcaatttgtggtgtccagtgaaaataaaaatgcatgccccttgttcaaaaattaataaactcactatggcaacatcaaagcattaaagcaaatttggggctgttctaagtgtggctacacggatggcaggctcttgaggctagatggcctaggagattttattgtgatagaaggcctacagaagatgatgcctaacctaaagaatgagttactgaagatgattacatattctgtcttcaagccaaaactgacctttgatgttccaatttgcttacaatagagtggaatactagaatgcagtataaagttctataaatctgagattgtatgattcaactgacatcattaaaatgatatttatcccaatactattgaagactaaagtgctttaatatgaaaataggtgtattctaggatatagtttgaacagtgaaaatgaataagctatagcatacaaggaaatcttggattatatcaattttatgaaccctggaggatactgaggaaattcacacaaatgggatgagtgagtcaaagaaaaggaagcaacaatgtaagacataaatatatatgtggtgatgtgttagattcttggttttgctagtatttctattataagaaattgagcattgaccaaatggtcagtagctgacttgtgggctaagcatttctttatgttaaatataaggcattttagggtgacattttaaaacattttgaaaatttctgagctttttgtttttcatataaaatcttacatcgaatctcaattgttactctgttgtttctttttcctctctctttaattcttcatcattcaatttgagtgttactgtgttttaagagtcatataatgatattttttaagtagaggctgagataccacaaggcatttttacctgagacagaaaatcatttttcttaaatgacagagccacatttcaacatatgtttttgatgacttttaaaattgaaatacaaaatatttcagggaagtaaatcctaatttacagaattattcatattctcaaaagacaatgatctgattttagaagacagtttagggccaggcatggtggctcacactgtaatcccagcaatctgggaggctgactcaggaggatccctttaggccagaagtttgaggctgcagtgagctatcatggtaccacttcacttcaacctggttgacagaccaagactctgtctcaaaaaagcaaggcaaggcaaggcaaggcagggcagggcagggcaaggtagggcagggcaaggtaaggcaaggcaaggcagattggagaggagagaagaagggaggggaaaggaggggaggggaggggaaaggaggggaggggaggggagaggagggaaagaaaaggaaagaagaaaagagaggcctcatgtgttttggagtttgaatttgattgataaaaactatgatatatgtgattataggttgtcttactttcatctttaaacatgcaaattgtttcattgggagtattttttttttaatttaaaattagtgtttcctttagatttctttcctgtgttattgctacatatacactctgtgttatatggtgatagtacaaataggccttgcccttaaggagcttacaatctaaatcatcaagacagattacgtagaaactaggcaatatatagtggttgcatactgtgcttaaagcttgatcggacttctgtagaaattgtgaattttttgttcatgtgggtataagaaacttttacagagaaatgacatttgagttaaaacttgacaaaagtagcattgcgctagtgacagtggaaggaggatatatttggcagagtatagaggatgaagaaagtctcaagaatattaaagtgataattattgtttttactgtagggctgatattcattgatatgaatataagcaaattatattggtttattacaactttatagttttttattactgaagctatattttatctggctagactgcaggtaagttaaaattgttataaatgtttcaattaaaaaattaaatatactatatgctataattaaatatactatacgctataattcaattttacaaaataaaaaaacttcacatacttgctgaaaaatgcatgtgaattttagcctaaaattttgatgaaagttaaattcttaattattgtcacttgattgtcactcatttgcaaaaatataatcgttatacagcagtagacttaattttcaaaggcattgttgcaaaatatctcattgcttcttccagtattattccatggtagagtccttggatgctcattagcttgcacttatttctttgcatgacttgacaaacttgtaggtttatagtaaactcagaagcatctgcatcatgcctcgaaaacctaaacagtgaaactgctgatctgtggaattcccatgatgagacatctggtggacaaatatagcagaagactcaatacagattttgatgatcttttttctaccttgttagagtacatggacattttataggcagaaagtggatccaaattttgaagtttaaacaagaagctgaagcataggcataggtgcctagtggtgaccaattgagaaaatctgttcaaaattttagtttgctgccacccatctagttactataattattttagttaaccagtgtctgtacaagtattcacatctgcaaaatgaaagttgttgataacacaggactacagtacacaagaaagaagaatagttaacaaacaggagggcaacagaaaaaatgactaagtccaattaattagatttgcttccttgtcctttctccaattaaggaggaatagaaactcatgaaattctgctgattaaaactgaagttttatagaatggctatagtaaggaataggttattttatgtaagtagaagtcataagactatcacataaaataccctgacagagctttgatcagaggaagctaccctgcaatcaaaagttatgtaattagcatctgaggtactgaacagagaaatattaatttctttccttgaatccaaaattgtgaagtaaaatccatgacctctgaattaatgatggacatcagagactggcaaacatttcgtaaagggctggatagtaaatattttcagcttttcaggccatatggtttccatcacaactattccactctgctatgataatgggcaagctgccataggcaataaataaatgggcacagctgtgttccaataatactttatttacaaaaacaggtggtagccatattttgcccacaggctgtaatgcattgacctcaaacctacacttttgatatcctattaattcagaaataaaataattacaaagctaaacctcatgggcttactagcaaattaaactcacatgtaaccgttacttgtctatacaaacattaatacattttataagattgaggtaaaatcttattaacagatataatctagcatttgctttaataaactatagaagttataggggagcacacagaataatgttattgaatctagtcagcaagagttccatagagcagcaggtagcatctgagctggattaagaataaggcactagatcttaggaggaaatgaatctcattagatcttattagctcacattcacacaatcaagaatgaccaaagtatttatcagggaggcaatatgatctgatttgtgctttgggagccaattcagttggtgaatctgcagagttcagaaaagagacaattagagaaatgatggtggagaaataaaagagaatttcaaaagacattcttaaggcttaacaatcaatctgacaatgacagcttttcctgtttcccaaacagtgagactacctttgcattgtgacagaatagtcagtgaatcatttggagataatgtaacagagagaggcaaaacactttcattaagataaaaattgcctgggtgacagagtgagatctgttggaaaaaaaaaaaaaaaaagaaaagaaaaaaaaattggacaacggggacaagcaatattttatgaatagtggctagataagaaaaaaaagatacagaaagcttagcctagtttttcttctagggtttttatggttttagctctaacatgtaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgtggcattatttctgagggctctgttctgttccattggtctatatctctgttttggtaccagtaccatgctgttttggttactgtagccttgtacatcattctcagcaaactatcgcaaggacaaaaaaccaaacacctcatgttctcactcataggtgggaattgaacaatgagaacacatggacacaggaagggaaacatcacacaccggggactgttgtggggtggggggagggatagcattaggagatatacctaatgctaaatgatgagttaatgggtgcagcacaccaacatggcacatgtacatatgtaacaaacctgcacattgtgcacatgtaccctaaaacttaaagtataataataataataataagagctttgagactcactcaggaacaacatctgagaagtcagttaacctctttgcatgttagatttcttatctctccaccacaggtttggaatatttacaaggcaaagtttgaggaaatagaatgaatgaaagggagcgtaagaaaacattctgcagattgtgtgtgaagggtaccatttattcagttggacagatagataggaatcagataaggtgctgggtagtactcacaatctctctcataaaagggcagttaagtcaatgaccaatgttcttaagtcaatttaagaaaaagcctgattgatatcaggcagactaatgtagtgcagagtccaggcccaaatttacctcctagtagctttatgaccttggtctgactgggcctcaaaacttttcatctatagaattatgggatcagctggagaactgatttccaaatagtgttttaatggcaatttggaatatttgcaagtgctactgaactgcagagagaagcgaaataaccagcagagaattttactcatttcttcccttttcaacttcaatcagagtaaaatatgtttctcttgtatacataggacttctgtgtaagattatatttggacaaaggattctgattctcagacatatatgtgtgtgtgtatatatatatgtgtgtgtgtgtgtgtatatatatatatatatatatatatatatatatatatatatatatatatatatacacatacacactaggagtatttgctactcatagttgaaagctgttggcttagatgagttcttccattccttttaagtatgttgttttgcttctatgatcccaaactgttatgcctcggtcatttagaatacagtaatgtcacataaaggatgtatgtttgtgagaaggtttgagagaacaaaatggtttgagattagttgtagctgaagggatggtgaaacatcctcatgtttctggtgagcaattagaaaatcagttctgatgatcaggaaaaggtcagaactaaaacatagacttcacaagtaattgtattaatttgaaacagatgggctcacccaagaagagaataagaagcaaagctattactgtccaaggagatgataaaaaaagaagaaactgtgaagcaaatgagaatgactgatcaatggaaatcaaggaaaataagctctctaatttgagtagaaaaaaagaatatccatgcagtggaaagctttttgtatttagagcatcttcacagccttcagtacttcttcaccggcatgaaaataaatgtgaatgattgtatttgtcccagaaaccataatattgatgcataaattttgataatggaagtgagctcttattttcatttaagtgaaaggattgaatatggaaagagtgagggagtgtgacagagaccgacagaatgagacagaggattaagaggaagagaggaaaggagaggggaaaatgggaaggtcaagataagaggtcatcagagtttaaatagagtattttggtatgaagaacatccatcctcagattatgcggcatcttcttaaacaagccacaggtagcattatagacactcatagaaggtgacaattatatgaatcctcttttcaagaagaccatttaaaggagtgaaagggattatttaaaacatcgttagttgcaagttgttttgagaagcataagttatatcaatattttactagttatattttgagggacataaatataaaaatggagagtattctattatttcctgtaattgttcagtaaacattaaacatgtttttctattagaatttttcacataaaattgaatctgtattactatggaaagaacattggatttataatttccctccaattatcaactgaaaatactccaatattttccccaaatatcagaacaaaggtttgactttacaacttattatttaacagtgcttaattagcttttgtctaattactgtcccatgtgtttgggactttcttcatttgataatattaaatactttttcaaattctcaggtgataggaaagcaagagcagatcaaagagaaatgagagagtatacccaatatatacttcctgtgcccttctttcttttctaatgcaagcaatgggaacatagaaactatttgaattttaaacgactggatataaaattctccaatccaatgagggctgaaaataatttttagcttcaaaatttgcatttaaaatgataacagtgagtaatgatgtattagagttaaagaaacacttgtgacagatatctccattcgctgataaagaataaatgcttccaccagatttatagttaacaatggaatgtacattacagcatattattttaaggctataataccaagaccaatcctgaagttttttattagaggagaagatagaggtataggaaatggtatgttcactactaatgtagttatgatcacacttcagatttttatggtcacagatgacactactaacctaccattcacaattggcaaaaagaaaattaaatagcagtatttatgatgattggatccacaggctaacagtttcatcaccattttcttctatgtggtagtgaaagctctagaactctagacctcttagcaacagagagaacagttattaaagtgatttaatttgtatgtggtgtgtttaagtttcattttacagttggaatgtcttaaagctctttctttcaagggttccaaatagctagaactatgattagtgcaaagaacttctcccctcaaatctgcttgccaataaatatcttttcagttttaaaagaacctaattttcataatcttttgattatttttcattcaacattgttagatatcagtgaggtttggaaaagggatgagaaaaatttagaaaaacttgaatttgggttttgatggtgcctttatggaacatgtggtgtgttctaaatatctattcttaatttaaaaagaaaataaaagattactgggacaggtctccacatatttgtttcataaaacaattttaaaagataacctacatgtcttaattattagcacggatttaaaatactgagggcttattgatgacctaatgcctttcattttatagagaaggaaatagaccccagaagcatatatactgtgttcacttccacctgacttgaccttgaaatctcagatttcaaatccagtatgaaagcttgcagcatgccttaaaatcttagattaaatgaatatttccctttattatctcaggcatttcaaatattcagtcatatccctttgacaaaggccttgcaagaaatggtcattgttgacaggtgttgcaatattctagaagtgattcaggtaacattctagttggatcatgtgatgacttattctgttgatcatggggcacaagattatcagagccatattccaaggatgccactccaaaaagtgttaggatgttagagtctccttgccagtcccatatcccgctcccaaaagttgggagagatcttacttattctcaccaatgcaagtatctttaatagtatttatttcaccatggaagaccatattcaacatcatgctacattaaaatttctttagttcagatcaagatgatacttgccttctcctagctgcctgaaaacagtggacccatggtttgggtttctaaattgctatctaactgcaactggagtggatacacatgagtagcattatattaacagcatcactagtatatacaataaaatttacagcacacaaatgaaggtcacattgtttatggtgaattattttttcaactcttatttcagtgtataacagaaacacagaaaaatgcataaattgtaagcatgcagttttgtgaacacccatgtcaacaccaaatttaagatacaaagtgttgccatatgctgaagtatttcaaagtaagttacaagtagacagaaaatctaaggtgtttggaatgcttcttacattctcattgctaggttaaacactttacagttggtatttcactgacgcctcaggacaccatttaagcagattttgtgattatattcattttacgtatgagaagcttaagctgtagaaagcgtaggcctgacttttattgacaccacagttactaagtagtgacatacagtgttgaacataggtgaattctggctgaagaaccttggttctttacacagaacacacagtctttcagtggaatgggctcaagtaatgagattttaggctccagagatacactctgagaaatgtatttttgatgagggaatccattttagaaacctcaaatcacattgtatctgccttctgacctatttgactaaggaattggagcctggcaagtcctgttgggtgaaatttagcccaagaggatgctgaggatcagggccaaaagctttagaaaaggttgcagagcaatgatttgcaggggagggaaagagttgagaacagtggaatcctctccaagtatatgatgggtaaagaaatcagaatttcccaaattttataggtgttctgtcagcaataatgactagaccaaaaatatgtgaaaagagaagactgccactgcacttttgaaaacattctatgcagaatatgaaaggaaatacagtcagccctctatatatagggtttctacatccatgaattcaatcaatcttgaactgtgctcactgtgtgacaggatcattcctaccccagagatcagcatcatggaatatactcatgtaacaaaactgcatatgtaccccttgagtctaaaataaaagtcgaaattataaaaaaatattcagaagaaaaaacaattaaaaatacaacaataaaaattatacaaataaaaactaatatagtactactattaaatagcatttacattgtattagatattataactaatctagagattttttaacatgtgtgggaagatgagataggttatatgcaaatactatgccattttatataagggacttgaaaacctacagattttggtatctgatgtggtctggaaccaataccttcccccacctccatctccatgtcctgtgaatatcaaggaagaattgtatctgtatgctggtaatttaagtatgtgaagtagaaataataaaatgacaagcagtttaaatgtcgatgtctaaaatgcatttggcatgaatgacagtccactgtaaatgaaacgtaagtagtccacttttaccatggctttctaaataatacttgtaaacaaaatagatatagttgacatttaaacagaaatgtcctttcttgggaataaaatgcaatgtaaaaccatatttaaaaaattgtattaaactcttcacacgtattagtccagaatgagttatctatcattccaatcaatcacattatataagtttttatgtggttttaaaattaggtccatatgtttattgtaaacttctgtatacttctacagactagcagaatggtttgtagaatgcaatcatgcttcagtagaatatttgttaataaggccttcatgcagctataagaagacactccttttttaattagttatctattaacggatctgttaattaaacctcatttgctctaaagaacatgtgaccctgatctgttgatggaacattgtgttcactggttgtttcattttgctcttgacaaaagatgagagagccagcttcgttttatgtcaaaatgtttattaaggtggcagtagtgtctatttctacaggataaggcatattcagtggtatacaatcagtggtgtaattagggaatttgtaaaacaggcattgtccagggtgatcatttataagagagctaacaatgtcacatgggttctacaaggagacaaatggcctttttattgcagaagtaataaaattttgattttttctggccattctgcgttgaggattttaccactgtgagcaacagttgctccagaaggtaaaataaattgtgaattactttaaagcatctttctttttcaatgcttttataaaatgcctttgatgtataatttatggcttatcttccttttaatttagaattcctttatccaccagaaagcaataacataattaacatgatcagacagttccttataacttactagtccctggttttcatggcaacaccctgacctttgtaaaaatggacagcactgacattttgttatccttgtaagggaggagtagatgtatatagggatgtccaaaactcgttatttcatagaaatagaatgagagctgagatatctgtattatgtgccattttgttatagtaaccaaacatatagatcaaattattatgtctaatgggagacaaatgcaatcttctttccttggatggctttgggggaatgcctctgactattcagattagaaaaggtttattcctgtcttttctaaaatgtcattttcttcaaatagtatcctcatgtaaaatgcatatgtgtctcctggacaacagacaacagcaataaaatttatttatataggtataaatatatttatatatttgaattatataaacctttgtttgaccgtgtaagtacctatcctcagtactcgagacatcataagtatgaataaaacaaaatctatatagaaatgtatgcataataataaagtatggttattgatacacaacgtacagtgataagaaaacatagtaataactaacatattaatatatggagtgtttactatatgccataccttggcttaagaggttatgagtgttaaaaaatgtgaagtaggtacgattatgctcactttacgtaaactgaaaggtgcagacttgcctactttcccaagtatacccagctagtaggtgatagagctaggaactgaatctaggcagccagacataagccttgctctttacaaatatattacaaaattcaaagtgtttagaggacactttcatgagcattgtgccattttttcattactcattaaattcttattttcatcagcttaatttgcagataagaaaactaaaattaagaaatccctttgccaaggttacacagctagtatgtggattacaacctgagcccaggtcaaatttctaatcttgtaaatttacaagtcttccaaactctccatggttattaaaaaaatcctttaatttggaaataataattagcaaccatcagctacaagaagccttacttcttgtgaagtgtaggtcttgtgaaatataaatatatgttttcacaatatatagtgtaattcttgaagataatgaatagccaaatttatcagtcttgcccctagtcctaggcatatttgtctattgaagggaatcaaaaatgtatattaaaataaattggtattatctctaacattgggtacaaattgtaacatatgtggctctgcttttgttactcccagagtagttgctattaatttaaaggataacgcatttgtgtaaatgtatataagtgtatttggataaatcatggcaccatttctaagagcaagtaggcaaggatgcaaatatattatggaatataagaactgtaggaatttgggaatcgtagttggctttttagctataggatcctcctgcctattattagtagtttgtataataaactgtttggagtgcagtattcaacttttaaggttaaaattctttatcaactgcttatacataaatacagttttccagatttactctgcattattttatttatatttatttatttatttatttatttttattatactttaagttctagggtacatgtgcacaacatgcaggtttgttacatatgtacacatgtgccatgttggtgtgctgcacccattaactcatcatttacattaggtatatccctgatgttttccctcccctctcccccaaccccatgacaggccctggtatgtgatgttcccctacctgtgtccaagtattgtcattgtttaattcccacctatgagtgagaacaactctgcattattttaaaaaataacaaacatgaactaaaacttgattaagaaagttaatttgaggaattggtttctagttctcagaaatggttataggttgactagttcttcatcgaatgacctagccatttcttagtaaatgaatatctcagccctttacttgatgttttgcatcttatcataccccctttcttttatttactttattattattattatcatactttaagttttagggtacatgtgcacaatgtgcaggtttgttacatatgtatacatgtgccatgttggtgtgctgcacccattaactcgtcatttagcattaggtatatcacctaatgctatccctcccccctccccacaccccacaacagtccccggtgtgtgatgttccccctttttttttgagaccgagtctcaccctgttgcccaggctggagtgcagtggcacaatctcggctcattgcaacatctgcctcccaggttcaaatgattctcctgcctcagcctcccaagtagctgtgattacaggcgcccgccaccacgcccggctaatttttgtatttttagtagagacaaggttactgcatgttggccaggctggtctcaaactcctgacctcaggtgatccacccaccttggccttccaaagtgctggaattacaggcgtgaatcactgcgcctgccccccctttcttgttatagcaaatccagtgtttcttttgtagagtccctattccctccaacattctcaatctaatacatatttgttgcttactacaattttgacataattctttaacaagctgaaatatcttgctcctgtttacttagttgtttcagaaaaaaaaagttttccacatgtgagactttatatacttaattagtgtttattatttatttatgtattttagtatgtgagaaacatacaagtcatggaggttaaaaaaagaaagaactatttgcttttattttttttccaaagagtttaggacattctcttaagagatttattttaattattctaaaaaatattttattatatgctcaagttagaaaaccaaattatatgaaaatcataacaattcaagatacttgaaatcttagccaaatcgtaccttagcaaccttagctgaagtcccattcacttatctgttcatgaggcagcaagaatagaacctgtgtttatttgcaactggtcttgtagcttgagtagcagggaaaatatgaatgccatgcagagaatgattttctattttgttctttcatcttacactttgtattctattgaatccctcagagactattcttatgccatagcaacacctgctgggtgagggaagttggaacagccacaactgttgcctgccaaacctgttttcctgattgaatggcactgcatgctccccatctccaataccaaaccttttagagttgctaccctccaggaacctatttctccccatatgtttcaagtaatgaacaatgccgttctaataagatttccccatttctttcaaaaatagtcattatgtatgtgtgtgtatgcgtggacatttccccttagaacttccaaatgcacatgctgtggtattttaacctcatgtttgtttttaatgtgggctttcttcctgttcaattgctagatttgtaaacattgtcaatcctgtttagttagcattttctgatttactatgtgtgaggtacttaaaagtgtgtgtcagtgtgaaaaaaggcagtttttatttacagagtgtgataagagatgtattatgcttattcatattatggacaaaaacggtaggcatactatctggtgtgaagacatatttataaatgcttgtttcacataggaaacatttacacacaggactgcaagtaatacaagtcttagaatatagatccacatggacattctatcatagggccaactagcctttcctttactgctgattgaggaaagtcatggagtggacaaattactcaatattaccaagtgcttccaatattttagtgtattatttctacctccttgcatcattactgtatccaaatcaaagtctagtagatgtactaacattataaaaatctattgttttttggtggatgtttaaaattaaaaaataaaagagttcatatatgaaaaatgatcttgaaatttatatgctttataattaagccttggataatcaagagctgattattaatcaatggttttcttactttggttgcttagtaaccttgatttgtgctctatcaatcaatcaagaacttattaagcaccttgaaaaaaaaaaacctttaaaatgttacatgatgtgggagctactgaagaaatagaaaaaccctgatgcttacatcaggacattttcgttacatatgtaagtgcacatttcgtcatgacatgtacagaataaattgggcatgctctaattcagagacatggaagatgaataaaagatgcagaaatcagaaaagagtaaatagaacaagaaacttaaattggaccttaaagaatgtaacaatcattggttgggaggtcaaactcattcctgaagagaagaaaggaaggaaggtgaggcaatgggaataagtcaagtatgttaagcagttgaaaagaccagcctcaattgaatagagagctttccacagaaacactgtggcttattaaggtttgacaaataagatggaaaacaagcagtgggatttagaccttctgttctggtaaatgggaaactactgtagatattgaaataatatagtgacatgatttttaagaaatagtaattgagaaatggtaaataatattttttagatgaagaagagacattagtcaatcagatcttagtaattcatttaaaaggggaaggacaacccagaaggacatgtaacaatataatattattatatcaacctatggctcagggaagttctgcatattttcaaaccaccaccacacacaaaaaaatttaggtgctgcatattatataactcaacatgttaacttcatatttttatatactaagaattgtttctagtaagtatccaatagcaacctttattcctttaataagaaatgagctgtagtttagccaccttccatcaaaccgtgtgttgcctatcatgatctctaaaaggaagcaaatatcagcaggtccattaataaatgaggaatgtctagcatgttggattttttttgtcatcctgaacatctctcaagcacacattactgtattttaaaaattgacacgcggttataatcatactggaaatgggtcaagcatattagtttaaaaggtattattcagacttggaatggaattatttttgaatagaatgaaattctcaaatttgccttgtatcattatatgaatattttccagtggccactgacaattggtgttcttataaattttgtattttaaggcaattcttctaaatcttagtggtgtgttcacatcatctgtgaggtatatgataattataatatttcaaatattaatgtatggaggttttaaaatacagattagagtcatgacattattctcacttacactgaatgtactttcttgaatgaaagagaaatgagtggagttacaacaagcatactgacaatttcacttaaccagaggcttatcttacttatcctgttgtgagctatcattagtgatgtgccattgacagttgttgcaaacgcaaattatttagttctttgcttctatgtaaaactactttgtgacttctcaaaacttcaaaatccgagtatatccatgtgcatgtctcatgcttatgaagccaatctgtaaatgtgctagcaaagaagagatggaggactgctgacacaaacactgaaacagcactcaagtgtgatagaatatctttcctttaaaactgtgctctgaaatgaagatgttgcttaccttggagtctcaatcagatcaccaaagatgaaactcatcaaatctacagcaatttttttaacccatctcttgttttgaagacacgcacctgcatgcgtgtgcatacacacacacacacacacaaaaaaaaaaaaaaaacatagatttggttcatttggattatttgcatctacaaatttactacttactttagtcctacttttttacatttgtttatatctggtcaggatgagaattattgaattctgttctctaagggtaactttcataaacatagtatctctgaagttttatttatttatatgttaaatatagactatacattctactcgagaacatacatatcttttataaagtacttccctccaaaattcaggtgtaattgaattagtgccatgcttattttaagattcttggaaatatgagtctgattgtcttttggaagaaaattatattatttattactgagcttcttatgattcttatattgaaagaaatatagcttttgtttcaatatctactattaaagtgcactacagtcatatttttaaaccaataattccattaaaagcacattcagatgtctttgtttcagacagcatgatatttttccacatagttcaaatgaactaaacttctgcattcttttaagccattttctaagtaaagaataaagataaaattttctcagctgccttcccaatgaagaaatgaaaatattttctttttctatatttgcttcattttacagtctgtgatcagtggaaaagttgacagaaaagcaatgtgttcaaatcatttgtctatttatttacgtttggaatgagaaactttggtgtcatatcatgtttttccagtttctctgattataacatctcctgcagtagtatttcaggcaaaaaaatatcaagggctgtgtatagactatatacacatatatactgtaacatatatactatatgttagagaatgtatctgcatttttattaggagtgactttttctagcaagtacattgcataaatggggatcttacatggtatagacatttcaaatatttatgctaaatttgatacgttttcattatgagacaatttttttaaataatttgatttaagacctaaaaaccaaatgataaaattaaatttcatgtcttcaaattgcctctttcctctgtttttttaaaaaataattcataacttatctattcaaatatttaaatgaaagaaaaaagagaactggaagagtcttttcttgacttccttaactttttcacacacccacacatctcaagatctgcatcagaagtatattctaacaatatattttgcataagattatgctacttgtaggagctactaattgtagaattactatatttcattattatttatcacatttgttccaaaatatacatgattcatattgattatgtttatctctattatctattattttgatagctttttattttcctatgttcctaccatcttcttctgctctgcctttctttctttctcaattgtttcacaactttcttatctgtgccaaacaggaaagcaagacactagactttagagacagattaaggctctgtgcccttaaggagctgcctggtcagggatataaacatagaagaaaatacaggacaaagtcacaaggacaggttaaatgggtaaaacatacaacgtagtgtgtagtcaggaagagtaagtaaccaggtcagcctggatttacaaagggaataacatttgaactgagtttcaacacatggggcagacagagggtgctagaagacagcaagagccagacactctgaccatggaaaagaactgctcattcaagggctcagaggttaactagttggtgaaacttcagtaaaggagtgttaacaggagttagtgattttggaagagcatttctcagtctatgttttcagaacatcatttccagagtgatacatttgtgttataaaatgtgaagttttcattgaatgagttttgggaaatagattgaattaacattttaaaaatttctgggcttcttgggccctgtaatatgttattatgcactatatatattgtttaatcagtaaaaaaaagagggaaataaagaaaataaaatttatcagtaatcccacactctagagagaaccgctgttagtgttctggtatagttctttctaggatttcttttcctctagacttttccccatgtaagtctcctcttccctgaattagtgcccaattaccttgctatttaatgtatatattaggtgtaaaattttgtactgtgtttctctatgtgagagatggtatgctagatggtaacaatgtaaagacagagcatgtatagcctacccttcaagaagctccctgttaacattcattgaaaatttttttaaaataaattttattgtatatatttgaggattacaacatgatattatgggatacatatggatagtaagatggttgctatagtgaagcaagttaacatattccttatcttgcatagttacttgtgtgtgtgtgtgtgagagagagccaagagagctaatatgtagttatttaatatataaaaattagatacaactgtttatactgaacagtaacatgttttacacactgaataatagtcattatagctatttatactacttgctaacatgcttttcccacttaatataaatgtcttatcaataaatataggtctattacatcatcatttaaaaagactgtgtcatattctattgttcaactgttttatgatttatttaacaactccattaagctgttttcaggttgttgttttttaaattaaaccagtgttgtgacaagcactctcattgaggtttgtagtcttcatactgacatgaacaaaactgtttatgatgataaagcttagggcagcaggaagcctggaagaatgaggctagtgacagagagaccacttaggatgctgtcacaagaagataaaatgatgacttctactgagaaaactgcctatggccatgaaaagaaacaggcagatatgagacatagttttaaataaagaaataacaagatttgatggctgttttgaagtggtggacaagaggaaatggtgaaacaaataatactgtatggttttcaattaatagatggaatctgttgaaattaactattaaccaagtcaagaaataaaatggtgcttaggcttgaaagacttttggaatataaagataggctgcaattatgagccattggaataaagttataatttgttattatcaacacgtaaaacagaagtctatgagaacaaatgagatctctcaacagaaaaaattataagaacaattaagagagttgagtaattcttagagatagaaaatttagtggggacagaaagatagaaaaacatataacaggtttgagaaattatacagtctttttggccaggagagttgtagggaaaggttaaccctgacttctagatttaaaatctatttttttttttttttgagatggagtctcactccgttgcccaggctggagtgcagtggtatgatcttggctcactgcagcctccacctcctgagttcaaacaattctcctgcctgagcccctaagcctccagagtagctaggactccaggcgcccactgccacgcccgactaattttttttttttgtatttttagtagagatggggtttaccgtgttgaccaggatggtcttgatctcctgactttgtgatctgccctcctcggccgcccaaagtactggaattataggcatgagccaccgcatctagcctaggaagagacagatattaaataatcttttagctagattttgctattttgtaaaacctgggctaatttatctaaaaatcaatttttatgttattgagattaaaattgaggtttatatttctgtaactttaattcagcagggaggaaagtttatctaaatacatgaaaaacataaacaaattttaaaagggatatttgaaatatttagcatgataacatttaaaaaaattatagtcaataatctattgtgatttgaacggtctaatgtaataagttgtttaaatatccattttattaagttaggaaataaatactatcttttgacaccacttctctttttaactttttactattcattcttgtaatcagaacatcaataacgttgaggctaataaagtacaaattcttagtttcaaaaatggtaaggctgagcacggtggctcacgcttgtaatctcagcactttgggaggccgaggagggtagatcacctaagatcgggagtttgagaccagcctggtcaacatggtgaaaccctgactctactaaaaatatgaaaaaattagctgggtgtggtggtgcacacctgtaatcccagctactcaggaggctgaggcagaacaatcacttgaacccgggaggcagaggttgcactgagcagagattgcaccactgcaccccagcctgggcaacagagcgagactccatctcaaaacaacaacatcaacaaaaggtaaaattaatacagacggtgttttggttggccaaggtcaggtagcttgtttttggaacagatatggattgtatatttcaagtaataaccctccattagtctttaaagttatacattttttatttattttacacagatttatctaaatttggatatttattttgaggttggtatatcttataagcagttttgacatgtgaaacatattcagatatagatgattgaggtatttatttaagaaatatagatgttggccttatccactgtgatagcaataataaatgactaaagaaatcaataagaggataaaagaaagaaaagataatttgcaaaatacttactgtatactccctcacattcatctctactctttcatatttgaaacagtgaccaagtgacaggcagggattttgtccaatttgtcatgagcaggaagagaggagtctattgctaacgctcaaaagttattaattccagataccattgtttattgaacctgcttcagtattcatatctttacattagctacctgctataagttagtttttgtttgtattctgttcaaattgaagtatttattatctgttattctcaatgttcttaattgtttattttaatattaaatatttggtccttaagattatcaagggggtttaaatgaaagcataaaatccttaattgtgcctgtcacatagtagggggataataaatgttaaatgctgaggttattctgcaccctttcccatggagggtgaataagtgtcacagttccattccaatcccattgtctgagcatgctgcttagattttaattacatcattcacttcaaaaagaacaaatactttgccaaaattatttaattgtttatgtataccagaacaaattacccatttgggtttataaaatggagccgttttaaacatatattttgttaatgtcaatttctaggatgtatatatctacttcaaaatggtggtggtgaatagttcatattgtttaaattctaagacgttatgcattatgtaattagtgttttaaacaataagtgaaggaattaaatgaaaaagtgaattgaagatatttgaataggaagataattgtcatatcactttgaacttgaatttatttgtctctataatgaggaaaacaacatttcaaaattagttgaaaaataattttaaacataattatgtttggttttgtacctgggcagtgggccataatcaaactagaaggaagagtaaaacctttcacttttcattcatgtgcagtactacttccaaagggaacatataacatttatcggaaggatagaattattcatgtttctggttattcgtatttatagcattctatttagcttgtgcttttttgatagatgttctactgcacaaatgcatttgaattcatatacaattgtgtaggaaataagaatcttccagtggaactagtgatgtttgtaagaaagatcgttgtatagtatttccctcatatcacttaatggttttcactaaattctaacataaatatatttcagcacaataaagtaagttacagtaaaatcaatctaacttctcataaatattctctgtaaatcagaaattaactttactcgagaaaaattataattctttttttttttttttttttttttggagacagagtctggctctgtcgcccaggctggagtgcagtggtgcaatctcaactcactgcaagctccgcctcccgggttcacaccattctcctgcctcagccaccccagcagctgggactacaggcgccctccaccatgctgggctaatttttttgtatttttagtagagacggggtttcaccgtgttagccaggatggtctcgatctcctgacctcgtgatcctcctgcctcattatcccaaagtgctgggattacaggcgtgagccaccgcgcaagaccaaaattataatttttatattcgttgaaatatattttgaagatttaattaaaattaattttgtagaaatattggcaatattatggcaaactatttacaatgacatcaaaatattatgaagtgaaataataataaattcaaatatcacaaaaaattaaaagtccaaaaatggagaatagaatggattttcaaattgcttgatttcactcccactaggcaaaaaacaaatcctaaatcttagcaatttggcaagttttaaactagtcaaaacttttgattttagatcagaggtttctctttttccctttctgactacttgcacttattgtgactactgagtctacacagctgaatgctactcttctatgaaatgcaaatgttaaagccccagttaatggctaattattacaggtcattgagaagattattcttatattaaccatttttcaattgaatgccttatttattttgctaatgtttgaagtcctcattttaaaatatacagtgaaaacaattaagaatgattttcagtgagagtatattccatttattcccaaggtttttgatcatccgaattgtcacatttcttcagccagcagaaattgtttccttatgattttctgtatctgaatatgctttaccagtttatactaaccttgaaaaattttctttttcccatttcaagttccacccaatctgactgttccacaggaaaaatcaccattggtcaccagagaaggagacacaatagaactgcaatgtcaagtaactggcaaacctaaaccaatcatcctttggtctagagcggataaagaagttgcaatgcctgatggatcaatgcaaatggagagttatgatggaacactgaggattgtgaatgtatctagggaaatgtcaggaatgtacagatgtcagaccagccaatacaatggatttaacgtgaaaccaagggaagccttggtgcagctcatcgttcagtgtaagtaaattcccttttatgcatttccatatggggacaagggaagaagtgttaccattattctactattaatatgaggtgatttttgtaactagattgaatgaactatttctacatttctacattggattgaatgaactatttctacattctacattaatgatacacaatttaaactataatctaccctaaatgtgctttttgcatgagcttatacacactaatagaaagagttgttttagtgtgtgtgtgtgtgtgtgtgtgtgtgtgtgtgtgtgtgtatgataattatgatggtgttatctggttgatggtgagaaactgtccatgtgcaataagcaaagtggagactggaagtaattgctaattcaggttgtaatacatgtttgttttcacagtccatgtttttacttcaggcaattgcatgtccttttcccaaattatctacctatttcaagcatctctttgcttaaattatggagatctaatcattgaaatgttatatttgcatacctgaagttgtaacagtgaattacgtaattatctagtaatatagtgataattcaggaaagtcttaggtgctgaatttttgcctgatttaatcttagcgggtaattgttttactctgagaattgaataagatacattttaaactatttttatatttttactgaaatcacggttatagttctaattaaaaatgtagatattatggactttacatttgattttatcattaaaaatacctaaatccacacacttaatggtcaataaaatgtaccagtgttactattgtttggtttttacagaatgccctggtaactgggctgcccaatggtaaagacactgctgaaaaagaagaaaactaaacacaatctactcaacctctgatagtgctactgcaaattttaattgacatactatttgttaaatatacaatatcaagttttcattaaacagatgaattaggtgaaaccatgcacttcaataaacgatgtcatttttgtctgactcttttgtaactcaggaaattgaaaatagaatttagtccaagaatgtctatttttatattagacttaaagttgttggcagaatgaatgaactatttcatatttgagagaataattaaagtatgagacaaatgtatttatgcatgagatatgtgagtgtggggtgagagacaaggttctgggtgctgcttaaccattccctgcccctcttctatagaacctcagattccagatatgctatttgtcttataaacacgcaaactgatatttgcaaacaaatgccaaataacctggctgatttctaatcgattatgagttttttctccaaataaggcaggttttagatgtcaggtttcattcagcagtttaatattgcctttttctcactggcctctatactcatgacagtctgttcatgggtatgaggatcatgtgaaaacaggtttcagaaaaaaagaaaagaaagagagtgaaactgcttcccattttctaaaaaatgagatacccttaagtgaccacaaaggaatttgatgtaatttggaacacttcaatcttgttggtaaacacagaattctgagctgcttcgagttatgcacaaagcttcagtgttcctgcagctattagtgcaatcagttttcactctgctcactcctttctgcagaagctgatactagtaaaacctacagaacccaaatggctttagcgaacttcaaattaaagtttcaagaaatcagaatctctgttctccatagaatattcttaactccagaattctattgattaactaaatttcctattttttcctttctcctgcttcttaattagtccgctagaaaataaattcagcataagattttaaaattcaactctataataggaatgacaataaacagtggcacagttgtctctagtgtgacagggatgaacataattgagtaaaaaataccgatagacacaggcaaagtttagttattttaatgtaggtaaaaatgatacaatttgtctgcatcccaaggtgacttcccagagcaggggttataatccaactgcatttcctctcagaggaaaacttccctggcctgcccaggaaggcaactggatgcaggcagtcttgccagctctaggtgaggatcatgttatcatggctttcaaggacctcccttccatatatttccaaatcttctgaagaacttggttatatgtcactatttttcaggtacaaataactggtaacaactccagaatattcctgagtacatcaaaggttcattttccaggcatgtaatctctgccagcagatcttgcctacatgcctatctaaggcttattcttgcaaaactaatagtacaggaattcagataatgtttttaaattgaaaaacagtctaacttttatagtgatttttttaagagacagggtttcactctgttgcccgggctgaactacagtggcacgatcatagcttactgcagctttgttcagtaaaatcgggctcaaccaatgcttccacctcagcttcctgagtagctgggactacaagtgtgcacctccatacctggctaattttttaattttgtgtagagaccgggtcatgctatgttgctcaggcttgtcccaaacacctgacttcaagcaatcttcctgcctcggcctcccaaactgttgagactacaggtacgagccaccatgttcatcctgatttttttttaatttgaaaataatttattttttgcttaacttggatacctgtgctacatgtaagaaatattaatatggactattaaaaactaagttatatcattcatatgtggatatacatatgtatacctctctatatatattttgtatcatccttagcaattaagtccatcattgcagataacaagctatgctttatatattttgtattcccagcataatatattttacatgatagctgttcagtaaatttgttgtgtaaacacacaaaaaaatgcatgcctggtttgttagtctattgttgcactgctataaagaaatacctgagactgggtaatttataaagaaaagaagtttaattggcttacagttttgcaggctgtataggaagcatgatgctgatatctgcttctggagaggcttctggaagcttacaatcatggcagaaggtgaagtgggagcttgcacatcacatggccagagcaggggcaagagggcaacctgggaggtgctacacatttttaaatgaatacgtctcatgagaactcacactatcctatcgcaatggcagtgccaagggggaatggtgcttaacccattcatgagaaatcccacaccaagatccaatcacctaccaccaggcatcacttccaacactgaggattacatttcaatatgacatttgggcagggacacagatccaaaccatatcagctgtttttttattacttaagtatcagggatagctgaggatttgctgcatacagatttcttccataagatgtttattacattgacaaattctggaactgcctattttacacgcaagcacacacatatttatgtataatttcatcttttaagacataaaagaatgtaaaagaggtggcaataataaataagatagaaaaaatccagtattttcaagatatttttacttgcttagttttacttgcgtccaattaaacaataaccactcaaaaaaactaaaggagcacagaatgaattgtatgtaggacatcaatgagtgtagggcgtccatccctaaaaggaaatagtgtgtgtgtgtgtgtatatatatatatatatatttctaaataatgtaaataatggaaccatccacttatagttctaaatatccaaatgaggtttattcttagctaatgttatgtttaaaaggaagcaatataacttacaaaattataatgtttatacaaactttttgaattacttactctcactaattaatgcctcttgttaaaatttgtacataatgagggacagaagcctagagatattttagaccattctatatcctgttaagagtaacatagtcactacaatgaaatagtttgattaattcttgttcacattgctaatttttagaaaacaaaaggctttttctttatgacttttaacttctacaattgccagttaccacacagattatggaccagagtatgaagttgaaaatataagtgttttgaaacaaaagtattttaaaattaaacttaaaaggtttttctgggtaaaactgcaaagtacaatgtaatgttttaataacattaaaaaattttgtccattgtttaatttattcccattttttggaatgataatacaatttttttgaatatttggctcatttttatttgaagcagcattagaatagcataattgaaaataaagatattacatatattaatttattcatagtatttaaaaatcatagtatgtatagagcttactgaacaaaactgaaacaactttcttttttctctttttttttctgagatggagtttcattcttgttgcccaggctggggtgcagtggcgtgatcccagctcaccacaacttccgcctccctggttcaagcaattctcttacttcagcctcccaagtagctgggattacaggcatgtgccaccatgcccagctaattttgtatttttagtagagatggggtttctccattttggtcaggctagtctcgaactcctgacctcaggtgatccaccaacctcagcctcccaaagtgctgggatttgacaggtgtgagtcactgcgcctgaacaactaaaacaactttctaaacaaagtacctgattgtttgaatattaattatataaaagttccattggatttccaaatatatatgttaaataagaaaccaggatatgtgggcggggggtggctcacacctgtaatcccagcgctctgggaggctgaggtgggtggatcacgaggtcaagagattgagaccattctggccaacatggtgaaaccccaactctattaaaaatacaaaaattagctggctgtggtggtgtgcacctgtagtcccagctactcggaaggctgagtcaggagaattgcttgaacccaggaggtagaggttgcagtgacccgagattttgccactgcactcaagcatgagtgacagagcaatactcatctcaaaaaaaaagaaaaacaaaaacaaaacaggatacaggatatgcttattgtcttcctaaaagaaagtattgtttttatatctgtattatataagtatacttacacttataaaattatatgctacaattttaatttgataaactataacattttatttgtaatataagctgtcctttagtttcatctcaaagcgctattaaagtcttttagtaatgtgagtatatttcaaagtatacttccttgaaaattaactggagaatatattgcattgaatgtcacttttgctgttaaatctccaccatgtagatgcacatttgttgtaccttcaactaatgacatgatatttctgttaagcggtataaaatatatactaaaaaccaaagacagatgttagtgttagattgtgttaagtaactgccttttacctaattccaaatctaattaatataccccttataatttgtattttccaaacaaagaaaaattatgaaagaaaataatcagggctattgataaacccatgttcctcacctgtttcagtttcccaagcaagaccaaattaggtgaaggagagagagccagagatcagggttttatttttgaggctttttctcaagaaatctaatgaagagagtatgctagttacttttaatctaaatgaatattcaacaaaagcataatatcatgaacctgacaaagcaaaataaaattaatgatagattggaaagtgctgtaatacatatgttcactattgttagatgagttactgggtaatattctgtagcgttgagatagaattagtgtactgaggtaatataacaattttgtgattttctaaaagcaaaattgttctggaaatatcagtgtgaccagggatttatctaaaactgatatcaaagacaaggtaattattgataaaagaggaaatacaagaggatctaggccaggcaaaaaggctatccaaaaattttataaatgaatgaatgaatttttaatttattaggagggtaataatgactttcagctcagtagcctgaacaagctttacttgtccagctctgtttcttattttctgtaataattcagtccatctcttctcagtcccataagcatgataattcaatgttgcctctctggctaggcttttatgctcctcttctgtttataacaattcttccaatctttttgccatttaagtcctagctaagtcgcaaccctctatactgcctcttggtgatgacgaaagatctttattgatagctccatggacactagcattagtatgtagaagacaatttagagcttcaaagtaaaacttcattttgaagacacacattagatgatatatttctttcaaaatcactaggttttgtttcagtattgcctttctcagaactatcctgtaatattggctatatagatagtttgggaaataattctaatggttgtatatatttacactgaactgttattttctaattggatttatttcttatgccaaaatgacttgattctaacagcctttggtttcctcacataatataaatttatactcaaaatttgaggacttacctttgagattattccaaagactctattagaaacattaatggtaagttcaaagttattttccagatgtttttggtgatgactgcattaagactatatatccattgccactataaggataatgacttcgaagagagctttgacttggaggattttctttgactcatagaatcttagttttaccacttatttacataaatatttctattttacatattccatcatctacctcttctctgtagttaagatcttatcttaaaaaagaagaaacaatgtatatagaaacaatgtattataagataatgtccaatttaaactctgtacaaaataagatctaggattattatttccagtcaacatatatcttactttatctttccatggatttacattactcttgaatatttgaaaactgagcttcccacaaataaacattattttccagaatgtttctaggatgaatatactttagttgaactgctcctgacattctgggcgttttccttgctctctatattttcattcttccagagaacacagcatgatatataactaaggggcaaataaccatctaaggaaattgttcaagaaaatagaaagaaattttcagtctcttaaggactgagtgcattgcatatatatatatatataatatataatatcttcagatagagcaattgactatacattatctgaaaagaagatcagtttatcaagtatgtggctcatgtaaggaaaataagcacatagtttatttttctggtttcttctctgctgctaccttaaagtaagtacaaccataatttaatgtttagataaagtgtatgtattaaaatttttatttttcagcatctatgcaaagaagtgggagagtgaccagctagttttaacagaatgattaaaggtacaaattaagccaggcaagactcatttttattgatattgtcagctaggtacttctgtccaccccaactgtgcaaaaatgaattcaactggataatatcattatatcatttccataataccataaggccgtaaggatattttctccccttgaaacccttcacatatgtgattaagttaaatttattttataggttttttttttccattttttgagacagggtctctgtgttgcccaggctggactgcagtagcacaatcatagcttatatagcctcaactccttggcccaggcgatcctcaacctcccaagtagctgggattacaggtgtgagccaccatgctgggctaatttttacattttttttaagagacagagtcttgctatgttgcccagcctggattcaaactcctggcctcaagcgtccctcccatctcagctttcccaagtgctgggattgaaggtgtgaaccactacgccccactgagttaaattttcaataaaaagtttacatgcctctgttcctgggggcttttttctttcctcccttttttgctttatgcaaatatagtttcttctaagaaaaatgaacataaacacatatataaatatataagtatgactataaaagttctgtgccttcataatctttcttagttaaaaaggaatttgtctttcttccaaaacctaaattctttcttcccaaatacagaatttgggcatttcacacatactatgatcatctcccctgtaacacaaaggtaataataataaatgattataataaatcacacataaaggtgaacaataatatatcatatgaacattcctgtgatattatcaatttattttaaatataccaacaataatatgcttagtgctaagggaaatataaagtgctatcaaattaacttacagagtttaagttaattttttctaatcaaagacccatgccttttggtctttgattagaaaaaaataaattcaaagaacttcagaagttaagcaacaatgtaagaaattgattgtcaaaagagtactttaattaatgcatgataaagccaatctgaaagtgagaaatcaaaggcagtatttgagagaaagacataacttcctctccctccagcaagagatacacatttactagagtgtttaatccacctacaggcagtattcatatagaattttagcttatatgttgttagcaattgtatctttattatcaattgtttgatgtaatatcatattttaatatttagtactagccacacattttttggttttgcatatatcatattacgttgggttatattatgtgacactaataactttactttgtagtaaattcctgtattgaataatctaccaagggtcttagattccactgcttttaaacttgcgggactactagaggcgtatttggtatcaaattcatacacaagggtataagacagaaacaatagcttgccaacatgcccttccactcctattccctgcagatctttgaaaatgtctaaaaacatgttttaattgaatcagtggaggaaaatgaatgctcctggcatctagagagtagagaccatggctactgctaattgtcccaaacacatatggcagtcttccaacacagttttcttgcccaaaatataattttttttttttttgtggtggagaaggaggctctagcttgtttattgtatggtgtttagaggctacttaggcttgtaatctttagattccagtaatatgtccttctcccctatgtcatgacaataaaaactgtctccagacattgccaaatgtccctgactggcaaaatcaccccaggttaagaactgctgcctagatgatgactcatagacaaggagacaaagtctacataatttggggatgggaactctggcagaatcctcagccccacaggagccaaaatctctgttgtaacaaatctataggcagaatttccagggtccttgaagagacatgccagttacaagagccactgcactaagctcaaagccatggcttcctattaagtattaacattcctctcaaatccagaagcaatttaatgtagaaatgtcacctaagattatagttgacattcttcccttgtcaggttatcaggggatcagagctagaattttaaaagaaggtcaaattcttgtacagtagggaaaatgtttattcctttaattgcacctactcttttcatctgccaaactaaactcttagcaattcttttactcttatatttttctgcatttgataataataattatagtttcatatattaagaaagcatgtttccaatatatttttgttttttaacttgccttttgattcatcttttgtgaactgctgtgcctgtattcttccttcataggccttttggctttgtgtctgggtttggcagggagtagctgtatttcatgctgttccatgaaatcatttcaatctaccttgtgagttcctttctcctggcaaatgaatatttccttgaagccttaaatattataataagcaaaaataaaggttcttcaaaaggacacctcaggacttaaactgaccatgcattataacattaaaataaaatctccttgattatataccattaagacattttaaaggtggaaattactctttcttcttaattcaaactattttcttaaagaaagaagtcaaatacttttcttgaaatttaatatgtgtattgttttctttgatattgtttctcattcaatgaaatacgagttttaaaatgtttttctagaaaaagattattatttaacttgagtagcatttctttttaagaagataattacactaaattaatcaagggaggaaactattcaaagctaagcaggaaactgaaatgtatttaagaaacaggaagtattcattcttataagttatttgccttgaaatatatggatgaaatgacagaagcgatcagatgtttcttgagtattctgtttctttgtgcccatcagtttcaacagtttatccagtgtttgaagccatatgttcataaacacaacataattgccttgtgtacaacataaaatgatgaatatagtgctttatagctcagttaaaagatgtaagtaatttcagtacacaaagttttcactttaagtgctcacttgaagctctaagttacaatcaatcattcaatcacagatatacatagatatagaggcagatgatgcagatatttagagagctatgtatgaatgcagtgatgtatccctatctactcatctatccatccacctgtctatctgtctatgtctgtcttatcttcatgcagaggacatatttactgagtgaacactcattcctgctaatgcatttttcttctttgtcttttatgatattgtaaatgctagttccgtttttacttttcaatcttgttttggctgctatttattcttcttctctgtatatcagattttgatcctattgtttccttactctatactctcttgcttggcaatataatgactcaaactgtcattgctaagcagatcttccccaaatttgtatctgaaatattcagctactgcaaaatgtcaacttagtttctgtatgaataacttagtttctgtatgaattctaaaatctaatgtgactaaaattaaaagtatagtaattccttttaattatttttttctcctcttgaattccctgtttcaccaaaaagattcctctcctctctattatcaagagcaaagtcattctgtctttcctttttctagcatacatttcaaattaggatattgtattctgaattaaagacctggtttgaattccagctttgctatgtattcataatttctctaaatattcactttcttatttgccatgatgaaaagaaatcttgttatgatggatttttctgaggattaaattagatgatgcctaaaaagcatttagaccagtgtttgacaatgttagtagtactccttaaggttgcctcttttttccaaaatcctctgaattcttccctgcttttccattccagcgctttttcaaaggtcagacccttttacctcctgcaagagattcctactatttttacaacctttgatctctttcccttggcaacattgctgcattgctgtcagatgaacttttttctttctttctttttctttttttttttttttttttacgagtgggaatactttcggttgcaattgatggaaaattcttgtctaactgttataggcaggaaagtgtagtgggttccaggaatgtaaacattaccatcttctcaactatcaactcagttctttctgtatttgcttcacttagtggttctcatttccagtccacctgaaaaagcttgcccctttgtctctcacccagagattaactacagagacgcgattggtttggcttgggtaaccacactccacagcagaggcataaatgcaagcattgttctatttggaaattctctatggctactcatcacctgtgattcaaagtttggtatcctaaactggcaaatagcattccctaccctttgtgagatcatatttcatgttccagtcaaggtgaacagtttattctcttatgcacatttgaactcaatgctttttgtcatttcattccctatgtcatgaatatccttaaaataatctttatgagcccactctttacaatcttcaagacattactccaatatcatttcccccctgctattccctgaagtctccagccatgtgtaattttttaaaattctaagtctgtacctttttaaaaattttctgaacttagcaatttcagtcttcaactcctaatatacggagacatttttcctgtttctttttttctctgtctctctcataagagattataaactctttccttcatgacataattgcatactgtaaaaatgcctagatcagtaagtgcatacattggtgaattatttgaaatatggttatgtttttcatttatttcattttcaatgtttatttatttgggctgggtgtggtggctcatacctgtaatcccagcactttgggaggccaaggtgggcagattgcttgagtccagaagttcgagacaagcccgggaaacaccccatctctgcaaaaaactacaaaaattagccaggcatggtgatgcacacctacagttccagctacttgggaggctgaggtggaagacttacctgagcctgtggaggtcagggctgcagtgagccgttattgtgtcactgcactccagtctgggagatagagtgaaaccctgtctcgaaaaaaatatattttagattcaattgttttattttcaaatgatttagattatatttttcagttacagtgttgtcagtgaagttataactctacacgtacagttttttgatactgcaattcaacctaggtgacagtaaaataataataaataataaaatgcaaaacaggtttaaccataactataaatacggttacagtctggaataggggcatgataaggaactataaatatggagtatcgattctaagtctggctctggattcaaattctagcagtgccaattttaattgtgtgacttgtgtctgtttctaccatcaaattttctatgcaaataaagggcttagtatgatggtctctaagtaatcttcgagtatggaagttattaccaacaaaattttctgatttatataataatgcatatgtaacagaaaccatactctattaattgtttcagaaatctcctagaaactgcatgcttgaattaaaggatgcatggatgacaaaattgcattgcaacaagttatctgtgttaaaataattcagatatgtgttataatgaaagacaagaataaaaaataagagattgaaggctagaggcatacataattatatatacttggctttgttgcatctagagaaaatgcagtgcatttgcaatcttattaaaagcaattcttgctatatataatgacaaaatttcagtgcccgatgaattaaaattttgaaagtttataaaggatgatgtcttgtgaattttaccttaatctttccctttggttgttttgtggttagcttctgtttagaatgaggatggttgctaggtacactactggatccatatatcatgcatctaaacatatgttattttacaattccttagttttaaagactgtggatctgctaacttatgaaggatactactatattatttcttcttgatgtagccaaacttttacacaaatacaaagaaaaaaatcacaatgcttgataaattgacttaaattattttatttttgtctgcatgtctgtttctttgtagatattctttgcagcttatctgtaaagaagataaattttacaaagcaatggaaaaatatagtagcctggaaattcatatttctctctcaaaagccattttttgtcaaatgcctaatttaaaaattattttctttttcttttattgtcttttttaaaaagcttctaatttttttttttcttcctgaaagtacactgtcataaaggtttgcttccagtgttttacatgtattagttcattcgagtgagaaaaactaatttgttcagcccacacaaatacatttgtctggagttgaaaaacatttgaattgaaatgaccattttgatctttggcaacacacaaagtaacttttaataagtcacgtgacagtgccacagtaggtgtgttaggtttccttcaatagtcttgggaaaatatgattattttcttaggctgcttttgaatattcttagcttcagacagtttttctctctctttcctctcttcctctctctttccatacacacacatacattcatacatacttttaggggattgtaatttgagcctattgctccttgagtgaagatggaacatatctgtcacttgttttaaacaatcagattggttttctctagaattctacataagacattcccgatcttttttcatttttgtacttaagatgggtaccatcctatgaaatatgtttggtcccaaattgtagcttgaccataattatagagttttgacattgatgactaaataaatgtattctagtatttactaagaatcacatctgatcttgatcttacaattctcaaatgtagattccagtaatttcatattttttattttaattagctcatccatagaattccttaacactgatgcgttttcattgttagataaagcggttcccatagttggaaaaagattgaagatccgcatttacattctctttgttgacacttgatcccaaaatgtctgtgccttgaattcgcagctttagttttgagtggggacctgtaaagttgtgcacaatatgtctataaaatgtatgtatgaccctactgaaagtgaagtttctgcattcatccaattacgctgaacctaatacaaatataaatgcatactattttccttttagcaatagtaatgctacacaaatccttttaaatatgatgctgaggttttaaagtgttttatctcctttaccaggtagataattttttttttttttttttgagacggactctcgctctgtcgccccggctggagtggtgcaatctcggctcactgcaagctccgcctcccgggttcacgtcattctcctgcctcagcgtcctgagtagctgggactacaggcgcccgccaccacgcccggctaatttttttgtatttttagtggagacgcggtttcaccgtgttaatcaggatgatctcgatctcctgacctcgtgatccgcccgcctcggccttccaaagtgctgggattacaggcgtgagctaccgcgcccggcctacaccaggtagataatattttgacttgaaatgttgattgttccaaatccctttacacgttgttattaggttggtgagaaagtaattgcggttttggccattacttttaatgtcaaaaaccacaattacttttgcaccaacctaataaaacaacagcaacaacaaaaataacaatgaactgactttttaaaaagccagattacaaaagaacatctgcttatagtgtatcctctgtatctcattattattgttttgtgtacttacgtattcctttaattttgtcaaaattatgatgattcttcctacattatactcaagacatcggcattgttttcattcttggcttagtgatggttactttttaatgcttcattcttttcaaggtaatgaaactatttttcatattttttgactttaatcagtattcaaatttgaaagctgtgaggaattcagtcaataaatatttacttcaattaattcattcaataaatgttaattcagtcaataaatttctctgctagatgaagggaaattcaagtaagaattaaaggtaatctgtatactagaaagattataatctaatgtagaagcagacaaagacttttaaggtaggtttcagaggtgccatgtgaacacagaggacggacggtgtacgctaattatgttttgtcctgacagccatatgtgtctggtgtgtgtttttacatttgagttcaacagcatcaataggtatagatgtgaatgtgtagaaggatttccccctattttcccactttgttttgattctctcaatggagactttttttttttttttttttttttttttttcagtaaaatggcttgagccttacagtttgggaagttgcttggcctgccttcctaatatttctgagaatttctggaaactccaagtctcctgtgaatctcttgctttgaattcttcctgtgttctcagtatctactttgctatcatcctttagcaattataattttcccctcacattacttcatttattagacataatctttttataattttttcaaagcagttttaatctaaggccaagaggcagaacagattattgaagatttctagaagctaagaggaggggaagtaaaagaaagagatactctgaatgaattatcagtgttcccagatagccatcattagcctttttctgcagaagcaacttttctttggtaagccttttgttaattcccatctgagtgagatctttacttctctttatccttagtgctaagccactagcagaaggcacaactcataaacatcctacttatcatgtatagcaatttagttttttcctggtaatgttctcctgtttagactcctgtcacaatctaatggactaataaaggcgtttctttaaaaaaaagaacggggggaaaaaaaaagtcaattaccccagaaaaaaaaattatgatatttccacaacatagggtcaatttggactttaaaacagtacactttttacttctctttatagtgtgtgagtatatatgtttctgcatgtactagtgctcttgtgtctgtaggaaggactatcgaagataaaacaggcagaatgcactgggaaaaagaacagagagcaataaataccagaaatattaagtctaaaattcagcatagtgataaaataaaaatatctaagcaaacagacattttgcatggactcctcttaagggtttgacatcatgttagtttcatttcttgcaatgtgttttagatcattagaagcaatatttagaacacaagatggtagcatagatttatatgggatctctgaaatttgagaacatatatttttcactcactagagcaggaagatagggcctatctgtctaataaatgagggcaattttttttaatctgtatttttcagctttatgtggaattttaaaacaattttcttaagaaatcatgtgaatattttcttgtattttttccccctgaatgttgaagattgcgtatatttatataaatgttcctgctctgatttcagggttggttaaatcctcagactgtgtcatactttgttcctcgactcttctcatttccctttttatggctctatctctttgtagctggacataatatagaattggaatgtattttatttcttattgtatgtatttcctactcagtttaaatatcattcagtggaatattttatatctctcactaaagacagtacaaaaataaaactagatttaaattttcttcttcttttttttttttttcaatgtgggccttgatgaattctttttgaccctctgggtcagaggcccttatggagcaatgcttccctttctagatctaaaataaaacctgtctctatggacagcaaaggagcatgaagtcaggaaaatgttttcctttgataagcttgaaaagtcaatttcaaggataaagcaccttgataaaagtcaatcagactagataaacacaaatggaaaccaagagaaatagagacataaatagatatgcaatatcatatacttttcctaaataggaaaggaggttacacataaaatgcaagtattttgcaagctggaaacacaacaaaacagaaaataagatagaatatggaaaaaaataataaaaatgactacgaataagagatataaaaatattttgagcaaatgttttagaggcttttgcaggtgagttgcataaacgctccataatttcctgttaacttggatctatacgaggtggattaacaaagaaaacagagtttagactattaatttcatttaattttttgattatgaatatatatttacaataaataataaactttgctttaaaacatactcatgttagttatattcattatgaatttgtttggtaaaacattttcacagttccaaaagctgtgtccaagttgcatcatcataggtttcaaattagtagagtaataatgatggttttgagctgtttcctcatatatgcatattcagagtgagtcacggaaattcatatgatcatagctttttcagtgcatttattttttaagtgtatatttggaaatacttttcatataaagttataactttatgttgactatacaaagtgaaacataaagaacaaattgtgaatgataaagaaatgatctcagctagttttctttgttaatcttaaaaacctagcagacttaaggatgtaatataataactgatactacattatttgggaaaatatttgaagtgctattaatgatttaatgtaatttggacctcatgttatgaaggacttactgttactcttcagagcaatcctatgaagaatgcatacctactcaccattttttaaatggctaagccattaaaaaccatgcaaatattgtaactgagttggcaattgaatcaactaaaagagatggaatccacaggacagcttgcagactctttcaacctagatacttgtaaaaaaatacaattaaagaaataagttttaaaatttttaaatatatttttgcctgtattctaataacatagttatgtctctaccaaataaacagacaagcattaccagtaaagtaatgctttactggtgccaccttaatggttagtctgggtaactacttccaaatggtttaccttttgcttgatcattataactctccaaattcttatttcattctttgtttttgttttttacatctgggctccttagatttctgtaattctgcattttgggggtttattttttctcctctctaattttatcagtatctttctcagacttcttatttggaagcatatgttacattcttgttttcacttccaaagtcctagttcagacactccttgggtcttgcttaccctttcttgagtcctgacttcatttttggatattctcttttcttgggattctgtgattctcatcctcttatgaatgaattgcaaatcctttagccttggattattggcacaacttaattggcctcaagccttcccagtcatgacttttccacacctactctccattgcagccatagatagctcagttttcacttccccatgttttcatattgccacctttttgttcatgtctatttgatttacatttctccttcctttttttttttacctgaagatagttaggaatattttgttttattgtcctttacttctttgacctttcacatactgtgttttttataaattgaaggttcgtttccagcaagtctatggtgccattttttttttttttaacagcatgtgctcactttatgtctccatgtcacattttggtaattcttgcaatatttcaaacttttttattattattatatctgtaatggtgatctgtgagcagtgatcttagacattattattttaattgttttgaggtgccatgaaccacacccataaaagatagcaaacttaactgttaaatattgtgttctgactgctttactgactggctgttctcatgtctttcttcctctcctccttgggtctccctattcactgagacacaacaatattacaattaggccagttaataaccctataatgtcttctaagtgttcaagtgaaaggaagagtcttacatctctcttgttaaatcaaaagctaaaaatgattaagcttagtgtggaatgcatgtcaaaagctgagagggtgaaagctaggccttttgcaccagttatccaagttgtggatgcaaaggaaaattcttgaaggaaactaaaagtgctactccagtgaacaccagatgataagaaagcaaaatgctttatttctgatatggagaaggttttagtggtctggatagaagatcaaacctgccacaacattgcattaaaccaaagcttacttgagaacaagaacctaaattctcttcaattctatgaaggctgagagaggtgaagaaactgcagaagaacagtttgaagctaacacatgttggttcatgaggtttaaggtaagaagccatctccataacataaaaagtgcaaggtgaagcagcgagtcctgatgtagaaactgcagcaagttatctggaagacttagctaaaatcattagtgaaggtggctagccctaaacaacagattttcaatgtagacaaaacagccttctattgaaagaaaatgtcagtaggattttcatagcaggacagaaatcaatgactggcttcaaaacttcaaaggataggctgaatcgcttgttaggggctaatgtagctggtgcatttaagttgaagccaatgctcatttgccatttcaaaaatccaagggcctttaagaatcatgctaaatctactctgcctgtgcttcataaatgcaacaacaaagcttggatggcagcacatctatttacagcatagtttatggaatattttaagcccactgatgagacttactgttcaaaatattactgctcactgacaatgcacctggtcactcaataactctgataaagatatacaaggagggccgggggcagtggctcaagcctgtaatctcaacactttgggaggacaaggtgggcagatcacctgaggtcaggagttcaagaccagcctggccaacatggtgaaaccccatctatactaaaaacacaaaattagctaggcgtggtggtgcaggcctgtaatcccaggtacttgggtggctgaggcaggacaatgacttgaacccaggaggcggaggtgcagtgagctgagatcataccattgtactccatactccagcctgggcaaaaagagcaacactctgtcaaaaaaaaaaaggagatatatatatatatatatatacaaggaaattaatgttttcatacctaataacacaacatccattccgcagcccatgaatccaggagtgattttgactttaagtcttattatttaagtaatacattttataaggttataactatcataggtagtggatcttctgatgaatctgggcaaaataaattaaaaacctggaaagaattcaccattctagatgtcattaagaacattcataattcataagaggaggtcaaaatataaacattaataggtgtttggaagaagttgatttcaacccttatggaggagggattcaagattccagtggagaaaataactacagaaatactggaaatagcaagagaactagaattagaagatagagcccgaggatgtgactgaattgctgcaatctcacgaaagaacttcagtggatgaagagttgcttcttgtggataagcaaagaaagtggtttcttgaaatggaatctactgctaatgaagatgctataaacattgttgaaatgacaacaaaagatttacaatattacaaacttcgttgattaagcagtggtagggtttcaaaggattgactccaatttgaaggaagttctaccatgggtaaaatgctatcaaacaccagacatgcttcagagaatcctgaatgaaaagatgagttcattgatgcagcaaacttcattgttttcttattttaagaaatcgccacaggccggtggtggttaacaaccaccatcctgatcagtcagcaaccatcaacatcaaggcaagacacttcagcaaaaagagtacaactcgatgaaggcttagatgatcattagcatttttttgccttagggtatttttaaattaaggcacgtacattgtttttttagactcaatgctgtatagactgcagtatagtgtaaatgtaatttttatatgcacagggaaaccaaaaaaattcgtggcttgctcttctgcaatatttgcttattgcagtgctctggaaatgaactgcagtatctcagaggtatgcttgtacatgccaactctgtcaagatatctgtactgaaacttcccactgaaatatgacctcctgcttctacacccaggttaacaaacataacatcagtaacaatgaaaacagtatttgtggaacactcactttatgctaaacactatagtaagtgctttatatgcactatttggtttaaactttaagtcactctccaaatgtacatgtatttttatttggttttgtgtttatttaagccttctatgttactttcctaacctaggaactaagcttattaagtttgttaaagctaaagtggtgattgatttatctttgtattttctgttatagacagttcagtagttgacactaaattggtatttgaaaatgaactattaataaaaaattactaaatgatataataaatcagtggaaaatgttcactctgagaatgcagcacctgaagtgtatgtttgaactgatttaccatttgcatcatggaggttgattcaactgactattttacagacaagtcaaatcattttatgcaaacaagtatattcagtttatagagaagagatttttcaggagacatatgagtgaatctctatcctttataccaatctttgatttttaaattaattcacttttgcatttttttctctgatcttgtcatcatacactattttaattaatatagtcctgacatacatggagattgaggaaatcatcaaaatcttaatgtaaaaaaatgtaaatgcctaaaagctaacgatgacacaattcaggaaggtgctgatgacaatagcacatactcaactgaacactttgacattatgtttcttctttgctggtgaagactgaaattaagaaaaacagcaaagagagaacctgagaaaaaatgtatacgatttcattatttctacttttacatgacctatgaagtatattattgttttccatgggggatatcagagctatctacatgctgatattctctactttcctttggatctcttaatgtagattgtcctaattgttatatagtatcagaaataaactgtaaaaaataacctgtatatataagaagcagcctattacaaatatgcatttaacagtgtcattttttgtcaacatgtcattaaataaattaaaaaatatatgctagagtgtgaaactaatagactctacatatacagttagtggaatttatgaaaaatttatttctagaactcccagtgtactgctttgaaacatgttttgatgaaacattctatgggtagaatttataggttcaacagaaccacccaactgaacttgttacttttgcttctcaacatatgagcagaaaagagattcattagattatcttataaaagttcacttataaggcatttatttaaattttaaatttaagaacatgcattcacatagaaaataatgtgatgaatggtatgtacattcttacggccaaccacagatttatgtaatgttcatgaattgtagtaagaacaatgttattccaaggtcatagttctaatttcatgctatgtgggaagtcattttttttctccgagctctaattccacagtagagtgagtttttgtgtgtttgtttgtatgtttgtttgcaattgttctacttttcttctgattatctttgcccagctccaaattcacttttccctatgatgctaaaaagttatctactttctttattctccaaagtaaacttctaatcattaaccttaaatactctctgtacataaacataatgtgaagtatgagttaacaaaataaaacgccattctcttactgcaaatggatattaatggaaaataaatctgatctaattaattcatgtccatctgtccatgacttatatttatttaattataatgaggtaccaagtttaattaatacagtatttagttggttaacaaaaggaagctagacattcaaagcactgaatgagttagatgaagacatttctatgcaattgtttatattcaatgactagaaaaacttaaatttcacattgtgttaattacataggtggggacacttacccatgtcattaatgcaatgcaaaaaattaatgacattttgtggggacacttaggcgagtcaacaatacaatgcaaaatttatgtgttttgcattgtgttaatgactcccctaaatgttcccaccaaatatttaaagtggggtaggagacaaaactgggaaataaagatatagttatgaatttaaataatcagttttataataggcataattaaagaaaaaaatgattactttattggaatatgtcagaaaggtgaataaggtacccatatgttaaccaggtaagtccactaatattttacgtcagagtgtatacattcagctttaataaattagaattttatgttatttttttatatctatttttttcctaagatcttaaatccttatctgattacctttaagctagcacttagattatctctaagatttctttggatcagttcaaaaagcatctattgactatttgcatgccagcaattggactaagtgctgaggatccaaagattattatgatctaatttctatccttacacaatttccaactgtccaggaagtcagaaatatacatggatcatttccatgccagtcagtaaaggcaaagatgccacagggacttgatgttacaagatcattaatggaggaagattcaatcctacatagtagaaggagtaatcagaactcttccgtaaggtgttgtctaaattgagttttgaaagatgatcagacttaataggttgggaaaggggggtaagggacagagaaaccagcatgcatgaagattcagagggctagaaatagcatgatgtatatggatgacagagataggctgatcatttgtagaatgaaaattaaagatagaaaaggcacagctcggacgcaaggggtgtgtagggatcaagttacggaatgctaaagtgttgtctgtctcttcctgctgctgccctctttccctgagaaactaaaagttcaaaattcttacctacatctaatctgattcagtaagtatgtccaattgaggaaattaaatgcactgcctcactgggagaagacagaatgacaatttagtgttgtatacatagtgttcattcattgtgtcacattgaccataaaaaagtaattctcacatcctagttgctatagatctgcctttttcccctttgagtttgtattgctgatagaacttaaatgtgcttggttagagaaaagtggatactgattaaattttaataattgggaaccagagggctaggccagatagcatgtcaggattccataattaggtaatgaggtaaaaaagtttcaggtaatctgatttgcaaagagttgtcaaattgaaatcagctgcatttatgttttattctcataatagttatcttaggagaaactatagcatattaaattggctaacttttttagaacatctaatcactgtatttgagtatttctatcatgtattattgctttaatgtttattccagagagtagaataaatttatatataagcaaaaaacttattgtagtaccaacttgatttatgtggaaaatgtgaactaaactataggactatttggagtgctatactgtaccattttatttatctatcgaatgagtgctacattacattgcactgcttaattaaatatcgtaaacctggtgatactcactaggaacaaatacacattattttatttatgagttgggcaatgggaatattttcttgtacttccatgctcttattttaaaaatagaaagaaaggataatcacttaatttgctgagtaagatttaatgattgaacagctaagatgtgctcagggagaaataaacatttgaatgaattttttaaataaggaccttacctatttttaaatagcataaatattattgcaaaaataaataaaaatactggagtgtgagatctgatagaatgattgttaattatatgtataaagcattttaatttttaaaaacccctccaagcacattattttaactgtacttccagggcagatattttatagacaatgacgttatagcttaaaagtttaagtgacttaactaaatcacacacctgattagtgacagaactggggccaaaatttctagagcagtgccatttcatcccattctgtcaaatcccataaaggatttaaatatttaagtctgtctaaaatagctttgctgggcagaaatgtaaaatatatcatgcttcttaactgtagaaaccaagggatatcagtcttagaaattgcagcttatttagcaaggtggtccagggaatatttggtttcaaagacttactgccttatgccagatatattgtttagctgcttgtatgagccaattaggagaacaataacattaggcattggcttgttctgccaacactacctgttaggaatcgttttatccacctttagctttgaaattgtatttaccctttatgcttttgtttttctcatagtatctttgcccttcttcatatttactcggaggacctctgaaacgttttttgtttctctaacatacacatttctaaaacataggtcccctggtccacataatttatatatagaatgagactcagtatatatttatccattatggaatattcaaactcatggttatccagtagttcactactggttaccatttgatgcttagtaaactcaaaagtagaattgtagaaacaaataaaggtcacaaatgaaacaaatgcatttggaaattgcatgctttccaaaataatttttatcattacgatacactctgtgctcattttattttcttagatcataattggaaatgaatatacttgagtattttagaatttgttccactcaaatttaatataattctagcaaaggaaacaactcatggcattaaaatgagtatcgcttacatgagaggcaaaacaatctgatacacatttatatcagtaaacagataattgagggacaagagaaatgattgggtgatcattgaaaagtatcagtacttttgcactgtatttaattttcctacctatcttctttaattttctaatcttggaggaaaaacaaattgaccttctctaatcattgttacattctaaacaggctacgtaaagttttattccttacttctcaaagtagcaaggtcatgttcacggtgtcttcatttagttatctgtgttcatctcacacctaaggagatacggtaaaattttaatgtatactaaaatagcctttatgagtaggtgtatggtgagcactttccaacaatcagactcgttcttgttaccttcacttaccagatgcatgaaaccctacagcaaacatatcaagccatggtggacacccaacatgaaatctcaaacttcaattcattaagtagaatcaatgtgaaaaattgtagggcagcaatttatgactgaatgtttggatttttttccttaagcatttgtatttgatatttattactctgcttgttcaatacataacattattcaccatcaggtatctctgttcattagtccatcatttctctaaaaatcttgacccagaagtggagattaaaccacaagaccagattatcactcttatatgatacaaattccatatgaagtcctcaatgtatcctccatggatgttaccacagtttatcagttacctggaacttggaacttttaaaacgaaatattcttaaagtttcttggtatgtacataaatttgtggaggtaatgagttgcaatgagaaagaacattgcttaaattagctttcaaaaagtttatctaagtctccagcctgctccaggacaataatagtctgttaatactattctccgagaataatgcatacttttctgttttacatctacctagctaaaatgagagacctagggggttattttatgacacaggaactctgtttaaagatcagtttgcatcttgccttttaaaggaaaaaagcaaattttaaatggaattcttatagcttaaaaaataatagaaaataaaagttcaatgtccatttcctcatcagctggtactccaaacaagtcaatgctgagaaagaactaaataatagacatcatcagcttccctaatatggaggattaaaggcattttccttttcttattgtacacttgatttatattatttaagttatctgatatgatataatagttgactgggtgctcacaaattcacattttatattcaaactggaattctgttcactctttatgttattaatgatattttatatattttaaaattataattataattaaaacatatacatataatataattataaatataattttaattatataattataattataatatttttaatatatgttgtagtgaaccacttttacatctgtttttgtgaaatggagacaacgttatttcaaatttagctactgtaaacattaataccacaagattctgaaaacaacatgagacaaaatgaattgcatcttgacagctgaaagatacctgagattaactgaccataatagtccttgcaatgtatgctcaacacttgaaataaaataattattattaacaaaatttttttgaaaacaattcctaatcatacatttcaaattggtaaacagaggtgaaatagttgaacttactgttatgttccaggaacaaccatgtttactgatgaccacaacataggactccagataaactagtggttctcagaaaacattctgaaaagtgtaatcctctgacaatcagcttaaagtgccgacagcatccatttataattgcagaatattataatacagttgttaatttttaaaaaaattttaacaatagatttgcatagttttaaaaatactacacgtggcttataaaacatacaatcaatgtttaagtatacaaataaaaatatagacaaagcatcataattcttaccacccagcagttagtatcaatagcattagattggtatcaatatacatatagggagatgaaaaatagaaaaataactgtataaaattttaatatcaaaattaggtcatattatacacattttttcagaaaaccaaagtgtagagagtacttcccaaatcattcaattatgccaacattattcagatatataaaaaagtaaataaccatacaagaatgtaaaaaaatccctaccaaccaaaatccttcatgaacatggacatgaaaattctaaacaaaactttagtaactgaatcaagcaatatataaaaatgataatacattatgatgatgcagagtttatgctgagaatatgaagttggtttaacactcaacagttaagcaatataattcatcatgttaataaactgaagaaaaaaatccgtatgcttctttcaataagtgcccccaaaatttgttgaaatccaacaacagttcctggagaacaaaaacaacaacaaaaacctcttagataactagacatagaagggaacttgctaagcctgataaaactaaataccaaaatcctagttaacatcatattctatgataaaagactgaatgctttcatctaagttaggaaaaggcaaggatgtcttcccttattatttctattcattaacctactagaggttctagctattacaataagacaaggaaaaaacataaatcgcatcaatattgcaaagaaataaactgtctttattcacagatgatcttatcatctatgtaaataatacaatggaatctacaaaagatactagagctaataaatgagttcaacaaggttgcagaataagatatcaatatacaaaaattaattgtaattcaccccatatcttctgtttatcttctatatatgaccaaagaataaacagaatttagaattaggaaagaataccattttaaaaacatttaaaatgtgatgctgtatgattgtcagggaaaaatctgtgaaaagatgtgaaagacctgcacactaaaagctataaaatactgctgagagaaaaacattaacaaagacctaaataaatggagagatatgagttattcgcaaattgtgatattcaatattgtttttaatactcctcaattgaatctatattttcaaaacaagctcatttgaaattctagaagttttctttgtgtttttggattttggtgtggcaaaagttgacaagttaattctaaaatttagatggaaatataagggaacaactatggccagagtaatttggaaaggaacaacaaagttgggtgactaacactatctgatggcttattgcaaaaatagaatgtggtcttggaatagatggacttagattaatggaacagaatagagatccataaataaacccatatatatgtggatatatatggttattacaaaaaatgctaaggcaatttagctgagaaaggatagtgttttaaacaaattatacaataacagttggatttccatacaccaaaaagtgaactttggtccacctattgatctatatacaaaagttgacacaaaatttatcattaatttgtatttctctgatgactaataatgttgagtatcttccgtgtaattattagttatccatatatctttattggttaagtgtcaattcaaattttatctatttttaagccattgtttcattatgcagttctgaaacacctttacatattctgaatatatatctttcattaaatgtatactttgcaaatgttttctcacagtctgtagcttgtattttcattcttctaagtgtctttcaacagaagttgttttatttttaattttgatacagtctaatttatcatttcttttataaattctgttttgggcattgtatctaagaaatctttgcttaatctgaggtcacaaatattttcttctataagctttatgatttcataatttcttaaatgtagcacccaaaatgcaatccacaaaagaaataaataataaattagacactacagaataaatgccataaacttctgctgtttgaaagatactgataaaagaatgaaaagacaagccatggtttggaataaaatatttgcaaatttagaatatgtaaagaattttcaaaactcagtgatgagaaaattataaaaaaaatgagcaatatagacacttcatcagagaagatatatggatggcaaataatcaccagaatgagtactcaacattattactcatcagagaaatgcaattcaaaccacagtgagataccactacccgcttattaggatggctgatattaaaaagactagccatactaagtcctggagggtatgaataggcgatggaacttaacatgctctgctgttgaagaatgtaaaagggtacaaaccattgtggcaaacagtgtggtaggttttttttttcattttgttttggaattaaacattcacttattataatccacatctaggtatttaccagtgaaaaatgaagccataagtctacttaacaacttacacacaaaggtacatagcatctttggttgtgatagtcaaaagctggcaacaactcaaatgtccacaaatagatgaaggaaacaaacttcaatcatggacacacgcaacaacacatatgaatctcaaaatagttattcttcatggaagaagccagctttttttagaaaagtacatatggtctgattcaagttgcattaattctagaaaatgcaaactaatgtacggtgagagagagtagatcatttcttgtctggggacaaggtgaggaggaaggattgaaaggaatggattaccaaggagcatgaagaaacttggggttgatggacatgttctctaacttaattgtggtgatagcttcacaggtttgtcaaagtatatgtcagtaattatcaaattacacacttacatatgtgtagtttattttttgtcaattatacctcaacaaagctaagacagacttacacaaaatgcatatatttatctaaaaatatcattaatttatcaaatatgttaaattcaagtataaataaattaaatttttttttttagatagagtcttgctctgttgcctaggctggagtgcaacggtgtaatctcgactcactgcaacctccacctcctgggttcaagcaattctcctacctcagcctcccaagtagctgggattacagacatgcaccacaatgcctggctaattttttttctgtttattagagacagggttttgccatattggtcaggctggtcttgaactcctgacctcaggtgatccacccaccttggcctcccaaagtgctgggattacaggcgtgagccactgtgcctggcctaaaaatttttaatgtaagagataagttattgaatttcttaatccatcaggaatatttatttcccacaacagatattttgtcctaaaccatttctctaaacttaaaaaaagaaattatgagaaaaattaagacacataaaccattatatatttttaacagtatataggacttcagaccatattcatgaatttaagccttcttattctttattcaatctgattttctatccttgtttttgtaagttttgttactagttttacattgggaaggtttatgaaatttacattgttttataattattattttttaaatttagtgttagtctaatatttgcattacattaatttagtgcccaccagtcctgtttactcagcacctctccattcccagcatcttcaattcagttgcccccactccacaacctggagataacagatacaatatattttgcctttaaaaatatgtagttgagaatcttaattcttgctttcatagcttagcaacattttggctggagatctctcttgcctgtgctctccctctccctccccactccattgattattgctgtgaaaatgtctagaatgtatataccaccactgctgctaccaatacttctcccaggcaatttattctgtccgtgtgaattgctgaagaactatgtcttataaccttgcatttcagtaacctaaccaggatatgtaccagtgttgagtattatacatcattttgtttttctcttggggtaatgtggattctttattttaagaaaaaaaattacattttgtgtagtttgcagtttcatttgttcaggtcactacctcaggaatactttatttttgtattgaatagtgtttgatttctccatttattagttcctttcttatttgaaaagtctctttcttttcctatatgcatgtatcctggttacatcaaatctttctaccatgttagtaacaactttcagccacataagttttgttcccttttgtttctaatttatcttcttggttgttttggtcctcgaattgttttcatagtgcttagtgtttcttttcatcctgttttgttgctttaactcctcgtttatgaacacctattttacagaactcaatttcttattaagatatcctatttcacagagcacttatgtaaaattttcttccattccttcaattgtgatttttttttattcagctggatttcttgtctatatttgtacgtcatattccttttctttttaaaatttgcttatattttgtattcctaacctggctgcataaatggcttgaaattttttccatcttgttcctgatttgacaggttaaaagagacaatttacttgctgtgatataatgcaattgacttcctgactgtagttccactgtttcctcccctagtttagtgttcgaagtctgagtattttatgttctgtccacatcttgggctgatgatgtagtatttttttctcacctaaaatactttgataagctaacctattttctttgtgtgtcatattgaaataatatgtagttttcttagttttagaatcaaactatgcttactttaataatcaaagaattacttaggttttaaatggtattattttcttctctatgttgatacttgaaggaacattatctctgaaaagtcaaatattcaaagtgtagcttcctttgcatgctaaaacaccacgattatgaatctaagctattcagttctcttcccaggtctgctgcaaccttaggcaatttacttaactgccctatacctaatatttgaacttatggattacaaaggcctaaaagatctcaaaaacttttgttttatattggatcctaaaactttataatcattctatgccatttgcttataaatttgggagttaaacttcctcttatatttaaatatcatgatataatagccaacaatgcacagttagcaatttaacttacaaagttcttgcaacctgttatacatatatatatttatatatatatttatatgtatatatatttatatgtgtatatatataaatatatatttatatataaatatatatatataaatatatatatacatatatatgtgtgtgtatatatatatatataaatatatatatatactcacagctgtctggaacctaagcaagaaagctattattatccttagagcagttacatgctttgaagtcaggctttctaccctttaaattccttgtgtattaaatagatataattatgtctaactcacagtgttgtgagaattaaatatatctggcatatagtaagtatcagataaatggcaaccactaatattcatgtaactttttagctataatatttttatttttatacatataattgcagttttttttaggcaagataactaaaagttgtaaagggtaaatgacttgtaaaatgtgtgcagctatcaaaggacaatgctggtatttcaatccaggtgattcacttcaaacttcaccataattaaatactatgtgttacatctaatgagcatgtatcattcttgtgaaagccaaccccttagacatgtgtgaaggtagacagagcagatgatcttacatgtcctaatttgttaggtatgtgtgcccttccaggctatttcttcatcaattgaaatattagtcaggatgattcaaaatttcagaatgaagtttgatacccacaaagataatccagagaaaagggggtggaggagtgccttctttttggtttccaagctgtcagacgagggaagatatggctgcccttgtttccttacagcccccttctttcttagtcaatactttaaatatttaaataatgatggattcatgtttattcagttatacttatgacagtaagtttacctcactgcaaatacatctatcaataaattgcaaagaggaatatcaggggaaaattttttctactcttcaattacagtgcaaaaaatatattttctttttgagatattgcacttcatttagaatctagtaattttgtgcctatttgggctagtaatgatgaatctagttttgcaatacctttccaaacacttgaccttaatttaaaaaccaatcaatagtgtctgcaaatactgcttttttgctagtgcttatgatctcaagaattggaaaaaaagatttttttttaaatttattaccttaattacattttttagcattatattgtaaaataggtggactgcattgctttacagcttttttttttacctgctgtgacaacagtagaatttttgccttctgattccacaatttatacttaaatcgtattttaaggtgctgtattttaaatttgactaaaaaagtcaacactattgattggtgaataaaaataataatagccagtgtatgccagagataatatttttcatctactgtattccattctgcatttctatttcactttatcattttattgacaagtaatttagtgaacagtggattgtttcctactgggaagggtaggttcctgagatttcttatgatagaacaatttgtagttgaacaacttaacattatataggaaaaacagagcaagggaaattaaggttagaaatgaaggcatcaaattccttgtccaatttgtaagtaccttgaataagataaaagttgacccactaattaagattatataaataaaatcatacacatatttagttaataatgatgggtagtggataattagtgttcatttagtattcacaattggcaacataaactttaaaattctctgagaggtttgaaaaatgattttaattatttttattttgcaaagaatagctatactaaaaagaattttgtacgagtatcagactttccacgagcttttctcattttgttactcagtcttattggctttcaacttctggatctcatactggattcagaaatgcaaaagagcttgatattggagttttaaaattaaatacagaagtttatgtaacctttatttagcctacttagctttattaaacatgtccagataatatatttctaaactttcctctaatacgtatgtttatataaccctaggtttctcaagatagcttcattagctccacccttcttacagttgacttggtttcctcactcttcatagacagataaattattattttttcttttcatctgtttttatagagactggatctcaccatgttgcccaggctagtctcaaactcgtgggatcaagcaatcctcctgccttggcctcccaaagttctggaattttaggtgtgagccaccatgcctggtctagataaattattttctaagccctatgatatttcacttcatttcccttttcttcttcagggctcttcaaaaataactcttttttccttctcttccatctatttctttgtctaaatgtctgactcttgtttcttattttttttctgatgatattcaataaggattattcaaaagtcttcaaataacaaaatcaccattggcctttaaacttaaagtgtctacagaagttttgattgttgatgattttgaaatcagtcacacacaaaacttgttcactctacttccttcccattataatagaatttcattagtaatactcataaatttaacaaacattttatcttctcttttgcatttttttacaatacaacagttttattaagcatgtgaatgcacttatttggtacaaaatgtagtcacatttcttcctctcctctgccccttgaggccacctctccagaaccttatgttcctataaatgcatttttggcagcagtaacaacaaaaaagtgaaagaaaatgcaattctgacagtaatgctaaataaccaaagtgggaaacacaaataggcaggggttagtgggtttcttagctagctctttaaccacgggccttagtactgctcattttaaggaaacattttaagaataacaaacccccaaatgttatttaagtaatactgcttacctctgttggtggcacttttcttccatctaacctgatgttataacaagcttatttgtaatttcttcgggaaattctgccctagtatatacatctctatcaatctcctttgagcttaaaaaagtcaagaagcaaaaacagaagactaggcaatttcataaggatgccaactgaaactttcatgagacctacttcttagaagtcaactggccaaatatatacacagctgtagccaatggattctgaaaacagatcctgctggaaaatatctccaatacccaattaaatctagttatttgtgtctatagattttaaatgatcatcattcacagtgggataaatgtatccctgtattctaagaaaaattcacagcttcctttattgaggctacagatgtgttggagctgtttcttaagatcctgaaagctcaatctttcaaaccttgggcaaaccttaatcaaatccaacacctagtttttggccactgtaaagctatttcctggcatgaagctattcccaccaaagttccctacttcacccattcctgggttgctgctaggtgctctcccttgctgttagatttgctcagtatcatatgcattggctacttccagaatatgtgtggaaagctcattcatatccttgaggggcatgatgttaaaagctactaggctctttttgttctgaaaagatctcagatggccatcactttcccatatgtttttgaaggaaccacagtgtggttaccactgacactgtctgcattaaatcactggtgagcccctattgatgcaactgttgtgtcatccatttcatcaacaatattggctggagtcctctctgcaatatctaattatctccacagtattgatttgagaaatctcagcattccaaattttgaatatttcaccaacaagaatggcaaaaagacgctgagatctggtacagagtacaatgttctgggcttgggctcttgattttttttctgagacgacgtcagtgttccaaagccccagaggactctgcacaaccactggctcttccatagctggagtagccatggatttccaatgcactattccacatcttggttgtggttccctcaggaaagaggcccagaaggcttaggtctggtgggtttccaagacacctcagaaccctgttgctcctgcagcagtctacctttcactggttttccttggcattttggatacgaacaatgttgagtagagatttagaaagataattcaagtatgtaagaatttaatttcctatcagcagaaatttagtgctctttgaaagcaatggcaaaacttagacaataaaaagcttttcctaaaacctataaaaatagtggcacttatctcatatctcccaggatgctgcttaaggactttacaaaactcttaacataaacttaccattttcctccttttatgaccacaggcttagaagtgagtagacactggatggatatagaccactggatatagaccagtgcttttttttaaatgtaaaaaatgaaatgcggtcttcatttttttcaaccaactgaattaaacatgtcacctttacacaaaatatattatataatatacagaatttaagaaatttgttgtttaacttgctttaattctaaatatttttatcctgttagacgaataagaaataattttatattaaagaaatgaatataaatgtttattattgtattacaaacatttgataattttcttatactaatcttttccttattttaagtgtgtgaactgatttttcatatttataaaagtatattgaagaagtttctgctgaaaatactttgatataaatattatcaaatgaaacattaaaacattcagaacaactggcaagacttattttcttataatggattcagcaaaatgtatagtcaaaaaaaaagcaatggttatgaaatagtttaaacacattgattacctgtcaaaaatgacaaattaatttagaaattgtaattcattaacttcctaaaatgtaattaatttaaattctgccatatttatttaacacaaagcagtgtgctaggtccagtctttcaacctttaatttatattatcagtagttcttaaactttggtctgcaacagtactatctaggagcttgttaaaatgcagaaactcaggattctgcccagtctatcaatttgggatagcatgaattaggatctgaaaatcaaaaaactccctaattggttctaatggacattgatgtgatagccagtaatagtaatttagtataacaaaatggaattaaggtaaatagaaataatttttgttttgttttacttaaattgttttttgatgcctcaaatccttttcataaaatatttatcgccatctctgatcagagaaatgctattttactcattaaattttagatgtatgattttactctgtactaaacaagataaacttagaattcagaattccaaattttttattttaatattggtattgaccaatatgggtgtatccacaagaatgatacttgtggataaagtaatgagcaaggtctgaaaatgatgtcttcagaaaactgattaaaggagctatcctttgtgttttaaaaaaggaacacagtataaggaattatatttaattgcatttccactaccctatgttattaccttttcatcaagacaaacaattaatgatttaatattttcaattttagaagctttatacttaagggtgttttgctcttatatttaaggctgttttgcatcaacacttgaattgactattaaaatccatttatagtgcaagaggcatgagaggaagtaacgtggcactgacagtaagttattaaaatatatttattaatctacggtttggtctgttgatgttcatttttatgtgtggactgagtttctgtgtttatgtatttgagtgttttgagtgtgtgtgtgtgtgtgtgtgtgtgtgtttgtatgtgtgcatgtttgccttttagttaatttgtcatccaagcacttctgcccaggagttagtccagctgcaaagcttgaggacacaatcctttgcagactgtcttcactcctgacaccaattgcagtcctgaaggtcactgttaggtttgataacttgttagaaggactcagaattcattgaaagcaactgtacttaaagttacagattattgtagggaagaatacagactaaaatcagccaaaggaagagtcatatagggcagagcttggtagggttccgagtgtgaggcttccatcctttttctggtggaagcaggatgggcattaccttccgagcactgatttgtgacaatatgcgcagagtattgccaacaagtaaaacttattcaagcctctgtgttcagatatttctttaaaggtccattatataggtatgattgattgatcgattaccccgtggttgaactcaggtcaactgatatggtctgacccaaagcctcctccctaaatcacatggatggttcttctggcatgtctgtgctacaacctaagattgttgggtgtgaccagttcccaacctaagcaaagacacttgtatcacgtataacatggacacctcccagaagctgaatacaaaggcaatacctttctttgggcaagacaaaatcttatactacatagttttataaagcagaaagattaaataaaaagatagccagtatggatcctagtatataagaacaacataggggccaggtgcagtggctcacgcctgtaatccgaacactctgggaggccgagattggcggatcggttgagaccaggagttcaagaccagcctggccaacatggtgaaacccgtctctactgaaaatacaaaaattagctgggcgtggtggcatgcacctgtaatcccagatactcgggaggctgatgcaagagaatctcttgaactcgggaggcataggttgtagtgaactgagattacaccactgcactccagcctgggccacagagcaacactctgtgtcagaaaaaaaaaagtcccccccaaaaaaatagaaaaaaagtgataattttgtaaaatgtataataagtattatttatcatcagtggtgtaaatgttcaggatttataaatagttattaattatgaacaattgagaaccaaactaaatttgaaaccaaattaggaagtaaataacctttctggaagtaaaatgttgatagagaaggcaaattgcttccaggtgttttcaagcaatctctgttcaattatgaataatggataaaatgtgcttaataaacaatgctattttattaaaagcatacctcgcatcatcataatgctagaataataaaatgtatttatatttctaataatctgttaacattttttcatcagaggttactttcctagtgtatgagaagaatttttttttttaaggataactatttacaatgaataactaaagagccaagtaaagctcaagattgtataagttatagttattggggaatgaagtatacaatttcagtacttttggttgaaaatgttttcacatcactcattttcacttgtcaatattaaatgatatgtaagcgattaggtttagtcgaggcatattgctatgctattaatcaacttcatgcaagcctcaggaatcatcaggggagacatggatgctatttttgctcacaattcattttgtagcactgagctcaaaatttaatttctctgcatatcaaagtgaaacaatttacacagctgtgctcattttataggagcttttggcaaagtgcaaataagtatatgattactggagaactccggtctctatcaaattactatgaagtagtaccaacaaatgatctgaatgatagaatattctattcttgagtgaaaaacattatacaaataaaagtcactacattatactattctaatgcataataaatttaagcataaatgatttctaccaactgttacagtatataaattactagttaattgttctgaagcatttcattgtaacaaacatggagctgccaataattgtccccttatgggaagaagaaaactgagatttaaaaaaaaattgttcaaaacttaactaatcacttgaatggtgaatagtcctgaacgtcttctggtaacattggtagattttaatctacattttatttttgcttttgaataaaaatatagatttaattttactgtggacattttaacaatttagccacctccaaatttaaaattccaaattagatttactacagattattatcactcgtttctttcttttgcttatgttcatattgtggatagattttaattgagaatttcttaagcagtgtcagtggaagcagttttattgtcgtgttgtgtacctcaactattgaaagtatctgctagttttgatcttttgacagaaagagtgtattgttaggcgtagcttttattactaaatcatgaaattatgagttggaagccattattctcctcctagtgagaccatacaactgtgcaattttctgagtccatgacaaaatgctaacctataatcaagtctctttttgtatttcaacctttggatgggatccaagagagtcttatcctgaattctgtgttattacagatagtgatctagctaagttctagccaagtgatctagctagtgtattgaaggcacaaaatatttgaacattaacttttaattttaggagtttattataaaacacagttgtattaactattttgtttctcttgcaaacattagggaaaatgaccaagttttagtttcagtgaatgaaggaatttcatatttttcccttagaaacattccagtatgagaggagaaaaactgattaactattgttgtaagttgggaaatgttctcacagacatcattaactttttccataaaaagtattgttttcatgtgtaccatttagtagatataaaatttccaaataatttaaatgtccaagccatagatgactaaactttgctgctttgactcttaagacacaaatgacaaaaagatgatactagagactattaaggcaaattatccagtgacagctggtattgctctttaataagtgttctctttgataatagaatggacaagtcagtacttaaaaataaaagttgttttctaagtcccaagatgagcataatatttcttttctttctgaaaactataagatcttctttacattctataaaagatttaaataatcctcaggaaatgacctttctaaggcagaggatgtcttcacttttattattctgtatcttgatgctcctgtcaaactatgtgacatttccacagaactttaaatagaaatatgaaaggacagaaaaggaagtacattcataataataaaaaatgtctggccatatgaccccaataagacaagttaaatatattaccactacttatttcatattgaaggaccagatggtagccagacaaaatcattgaggataaagcctaattcagagtgtgtgttctgatacttgcactgtaatcccataatcctttaaagaaacaatcaatgatctcttgcttctgtattttctagctgtgtcttacgcggggtgtgtgtgtgtgtgtgtgtgtgtgtgtgtgtgtgggtgtgtgtgtgttctaatccatatatgattattcaataactagaagcttgatgtttatacctttttgtgtttaatcagattagtaagcacattgctataaccagcaaagtaacatttgacatattatccaagaaaaatttgtattttattatctatctggatctaggagccttactataaattatttttaatctttgatcttgctttttaataaatcacacaatgttcaaagactcctattttctaatgtgtaactagacattagcagaacctcaaaaataaaaggagataaaaggagtggttaacaattttttgaaaatgtgtaacaaatgttaacatgtttctttacctgtttcctgtatatgtttgcaatacttctcagaacatttttttcttgttaaagaatatcatggattttcaagaggagaatagaaactgtagcagaatttttaaacaaattttactatgaagattttagttttcattaaatgctcatgatttatatctagtaatttatttaagaaatactaaatgagtacttgaatttctatagtaaacaaagctttacaagtcctactctcacagtaaactagtctcttatgactaatattccatagaaactttgtaatagctgagagggagtaagggactataataagtgcttcatatatgatatctcatttaattttcaagacaaacctaagagttaagcactgttatcctcattgaaattgaaacctaagggaaatgaagttaacacatttcaaggtcacatgtctaacaagtgataaagtctggatttgaacctatgaactcttaggaacattgtattatatagaagagtattctttagtgacagcctgtcctataaaagacaaaagcaaatactttgttgtatacataaaaattggggctgttattttaatttcataatatggataaattgaatgctgggatactagtaccagaaatttcagttcaactaaatgggctgttgaagtgctagcctcctctattgttctttcaaattctgagaattctttttgattttatgaaatattcatgattcacttggtggtccctgccagctgtctcctctgccatctggtttggtcctgcctagatagctaattgtgtagaatatatataagtgcctgtatatagttcaatctgaaaaaaacacaatctatatggaagtcattttagaagtagaagcaatccattatctcatattgtctacatattttcctttcccactggcaaattactcagtagtttactggatctttattgagtagctattgccaacagaagattaaagttgatgtaatatttagtctttcctatgatagtactagcattgtataattctagccatgaagaaaaagatggattagtcacatattgtcacctgccaagatgaaaaattatgagctttccactttgtgtttaaatgtacctggagttcactctgatgagaaatcatgttacccaaggcaagtcttttttattgtcttcacaaggataccccccttttttttttccagtgcagctatccttttctgatatgtgtggggggagttccattttccttccactatcttgcaagtattcctagcccatataaatggagcaagccactaagagctgctagcagaattggggaaaactacatagacacagaaagtggaagtttgaaatggtattagaactcagagttgtgtggacagatacaaagaaaagtgataaccaagcagagaattatgagtgcatgtaatgagtaattttttgttcatgtaaagtactaaaatctgtgacttggtttgtttatgtagatataaatgaaaagagattattgcaaatttgagcttatgccatggatatgctttctttaaaatgaaggatggagtttactctagcagtccagaaactgtactttgcacagtcttttaaaatccttctctctagtctgagaacacatgggattctgttgcgcatgctactattttccaagcgtcatggtggagaaacagttgaaaattactcttctcaaagaatctattctgaaatacatctcattcctgctggtagaatcattatagaacacaaatttcaattctacctgagaagagatagataaatgacatctccctaagattccttaaagctctactccatccatccctctttccagctcacacagggcatcctcactgatgcatatgaaagctgcacttatttattctcttcattaagatttggttttccgtgagtccttctgccactcattagcttcttcctgaccataatatgcctaccctggtgtccaaccgctacactaaatcttctgaaaactgaaacacagctgtcaccatgccccacgtcagcagcttcctatcagcaaacatgtcagaatctaacctttgcttccctggtgtttcagtttttattaagttgcttatgttcaaattaaactttatggcaacagctgtctcagttgtcgaatcaaaattatgctactcttatttgattttttccatcaacccttcttgtttctatccagtctgtaaagtaaatataaattcttagtaactctgcttctttttatttgactctagttttctatttccttcttcataatttatggaataatcagcatgattctcccattttgaatctgaggacacaataataaaccagagagaagaaaaaaaaatacaacccttctcatacattcatatatggcactgctagctagtaccatcctaagaagccatgttctccactctttactactattttactttaataatattaatttcaatattatattactcatttttcctttcaccataacatactatactctgtactttacataatagtaacatacttctacagcaaattacaacatacacacacgcgcgcacccccccccaccccagaatattcagtcccaacactttttggcatatatagttcccttaccctactaaatatagcagtttattagtaaggaagatgtccccttctgaggcccttaacagttttatattattatattttgaattaacttaatccaggttaaattgctttgcacatagaagcaacatagtagttgcctttcacatagttgtaagtttcactgtcattcccttcccttcaagatcagggaggcattgttctaactttttgttagtcttatgcatatttaggagcttaattaaacaaaaacggtgagatacaggagtgttgctccttaaaatgattttctattttcgtatcaccaaggtaaattccttctcaatatttcaatgtggtgagtgacgcgtggctgcatctgacttcagaaaaactcagaacacaggccttctgccctctgcataaaggaggaatacctataaagctgctccgtggtttctgataaagagtagctcttgtggatatcatgaataaatagtgaataacaacattctgtacattagacatttttgtgtcgaattctcagttatgctctggcagggcaaatcacaaaatattttgtgacagtgcttcagcattaaccaagaggactcattcatcacatggacaaacaaaccagtgatgaaaatcccagccctgtttgcttgaccagtgtgatcccaaagagtcaccgtgggcatattagtgttcatcatttacttgagagaactgtcatttgaaaataagttttctgtcaataaatttattaaaataagtggaggtaaatgcacattctatgttacgtgttttagtgtcactatcatgaactgttattactaccaatatgcagacacatacatacacacatgcatacctacatgcctacctacataaaactggtacagagttgtgagtgtcactgtaatgacatgaaattgagctagggccactttgaataaatgtgaaaagttgccttcatgagttataaagtccatctctcagaatggtcatgaaaatcaataagcattgttaaccaagctttctaagtaatttctgatagaaaatcagacacacttggcaggttatgctaaaaagtgtagaataagttactcagttctactgacttcaataattaaatcagtcctaggcaataaaatatagcttactcttgatgctttgggacaaacaatttgccagtgtgtttataagacagcatgctaagcagctagttgtgtcttttgggtagttgatttctgttgaaactaatttccttaagacatttatcttttggaaatttcatcaatagcctgtttgagactatctggaatccagcagagttaattatgaatttaatcagcctgtacatgagaatcagaaagatcttacatcagtattttgggggaatatgattgggatattctgggatcagtgttggcagatgcccaggttgtcagccttcaatattgttttcccatttcatgtggtctttagtgttgagcaaatcaccctggtgctttataattaaagggagtagctttacctcagaaagaattcctgaagaggctttgttggtataaataataaaggcacagatgtagaggtagctgataaaacttcttgtacaaagggcttctgtatccatatgtgcataattgagttctgcgtgtgacactgttcttgaattgagaacaattgatatatttgtgccatctgttatgttgtgtctgtgccaagtgccaacactataagcaaaaaaacagtggtctgtgagcactgtagtatactagttactaccttcccttggaacttgatattttagcaagattcctcaggctgtcaaggctaacaaactacaatggcacttttttggtaggcaaagataacactccttatgtttgcctcttgctgaatcacattcttacagcaacctttgaaaccttagaagtcttgaggttttgtgtctttttcctagaaaaaaaatgactcagttgtaaatcgctaatggtgactctcaataaggtgaataaggcattattaatgcaggaagaaaagttgaagaggtctgtgattcttaacattcttttcacttgattaacctgttcattgaaattatgtaaggtccgtaaaagtgttctttgactttgctttgtgttattttcatgatcagtagatgttaccgtcctgaatgtgcaactcactaatgctcgactttatcagctccacagtaaaccattcaagcaaaggtttgctcagttgtcaggataagtgccatattctattgcttaattttgagagcagatttttctactgttgtttggattctttttaagtacgtaatatctttttgacagcacagtatttggggtagcagtaactcaggtaagaaataagtatgcccccacaaaatttactcttctccaaaaaattgataaagcaattcagcatcccatgggacataaaaacttacatgtatgattacatataaatgtgtaatccactaggttcggttcagttcttttcaacagactcctacatatacttaagtacttgtgctggattccttacacagatgaaacaaattagtagtagaaaacaaaattgatactactagattatcccttgccaaggtattattttatatttttatcacttctttctagtcactttcacgttatttcatttaatctttataagaactcattgataaagacaggagaaatctaaatctaagattcacaaaatgcaaactaggaattgaatcccacagaaggtcagtagtttggtcctagtaactgaagctatcagcttgagcaatgggaggagagttctctttccatgtctgtagctctactctattcttcttttactgctgtctaattctcttctgaagatttaagggagaaaatgaatatgaaaaaaatgtactgatatttaaagaacaattactagttaaaagtattttaagggaaattcagcaagtgcctacttagaaatttcaggattaagtataatttagaatgactgttattaggtccaagcttaagttttgccactgttagcaaaactaggtgttaaatatgaaagggcaaagtggaaaattaagtataaattttgtattttttcttaacagaaaattagaacgtggaagtaattgttaattcttttgcaaattggcaattccaactaactattcatctatcagtactttgatatgattaccagaacacatctagttaaatagttaaggacaaactgtagtactataaatccattgtgtaagattataactgtggaattgatggacaaggtaagtattcttgagaaatgtaatggggacagctggatacaagaatccactggaaaccactatcatgattttgatataattgcactgattttctagttagagatggtgtgagcagaaagcatctattttctaattggaaatagtatgggtgctttgattatataaaatataatcaaaaatagaattacataaaatatacaaaatataattgaaacactcataatatttccaattagaaaatactttctgcccacacacaagtaaaaataaaatgaatgcttccgtatttgtatgacaaataggaatacttctactgaacattattaaggaagaggaagtgaagcagtttgaggaagtagaaatttacaccagatactcatttggaataccaggaaaatgaaatactgagtatatgattttctgtgtttgataacataagtaaagaagcaagactgatgatgcagatgtagagactggtacatatgccctgggggttggaatctagagttctgagatatccagtggaatcatgtaaaatatttgacgtatctttattcaagtaatataactatgttttattactaatatacttacagcactatatttgcacttgtaacatcaatcagattagttataattaatatataaatatacttgtaatattctattcatgttaattataatattaattctatgcacttaaataaatattcaaactaattttattgagagtcccaataagtattaggaggttagcagtttgtcagatggagaagagaattaatcaaaattctcactgtctcccatctgttttgaatggcaaagacaagaaatatgttagtgaaaagttaccacacagctgaaactattctcttttaatgtgtgaagtgccaaaaaatttaaattttgacactttcagcaccttgatattactgaaaaccaggtctgcaaccaggaagatattgaaattcatccctacagagcaaggagactaaacaaattaaacaagttctcaaatgtatgtcatttaatttttaattctccagtggcacttgggatatctcaacttttggtaggaatttttttgatgatgctttgctggaagcacacttaaaggcattattttattaatagaatatttcggttgacagagaaaagccaattgaagattctgttaatttcaaatttataagtcataaaatataactgtgaagaaaatttcagaaaattttatttaaaaattaaaaataatatgaccacattagaaaatatatttatcagaaaaatattaatgagaatattagagagattcagctaagccactgaataaggtacatgattatttgccaaaaacagttttgtttattttatttgtaatgctcctttaaccaatacaatgtaatttagaatatttctttaggagtgtgcatagatatgggctatattttactctttgaaaatatttttgcatcagtttttttatcaataaacgtaatccagcatattaacagaaccaaagacaaaaaccacatgattatctcaatagatgcagaaaaggcctttgacaaaattcaacaacccttcatgctaaaaactctcaataaattaggtattgatgggacgtatctcaaaataataagagctatctacaacaaacccacagccaatatcatactgaatgggcaaaaactagaagcattccctttgaaaactggcacaagacacggatgccctctctgaccactcctattcaacatagtgttggaagttctggccagggcaatcaggcaggagaaggaaataaagggtattcaattaggaaaaggggaagtcaaattgtccctggttgcagatgacatgatttttttttttttttttttttttttttttttgatggagtctccctctgtcaccaggctggagtgcagtggcgtgatctcggctcattgcaacctccacctcccaggttcaagtgattctcctgtctcagcctcccaagtagctggaattacaagcatgtgccaccacacccagctaatttttatatttttagcggagacggggtttcaccatgttggccaggatggtctctatctcctgacctcgtgatctgcctgcctcagccccacaaagtactgggattacaggcatgagccaccatgcccagccagcatttgttttttaaaggaactaatttttggttataccaatatattaaaactaatttgtccatctgtaaataaatatttttattttaatatataccattttaataatactacttttacaccattttaatcatagtataatactattttaataatttatggacctcctttacacagtttggaagataaattatacggttaccatactagtcttttcatgttagtactcgtatgatatggtgtcttttattgtggtcacttgtgtacatagctgaaacactgaggaaaattgaaaagttcttgttacaacacttgtatgtgacatcactcaaatactatgtctgaaagagtatttaatatttaggtgatgctcaaatacttatgaatgtatgattggactcataaatccgattatatgcatatcacatattgctcaacttctgaagctctaagttgaactgatgatatcctcctatccatcacttctgtcagtatgcttttggtttgtcaccctgtgattttgtttgtagaatcattcacctctgtggccagtccatatcttttagttaaccaagacccatgtatattaaaaatgcagactcagaaagtgtacagtgctctgatttttagtcccagcccctctctactgtgaatgctaccttctcacaattttctcgacttctttctctctgtgtgatcaaaagcttgtttacaaaacaggtcatgataacctggatcacttcatcttacagtgatgcgctcttcttgtgaaaacttacagtactggaactctatatcactcttttcacacctaccacttgacattcttaaactattaaacttatctattgtattatttaaaggttcatatatttacgccttatcttctttaacttagccataagccctatgaaaagagggactttgtattatttctcaaaatgcctgaaatgctgacttgcatacagtagtaataaaagcataaatttatattttatatcctagtacagacttttttttttcttggagatggagtctccctctgtcacccaggctggagtgcagtggtgctatctctgctcactgcaacctctgccttctgggttcaagtgattctcctacctcagcctcctgagtagctgggattacaggcgcataccaccacagccagctagtttttgtatttttagtagagacggggtttcaccatgttggtcaggctagcctcgaactcctgacctcatgatccgccccccccttggcctcccaaagtgctgggattacaggcatgagccaccgcgccaggcccagactcttaaaaagtctcttgaaaggagtcttcaatctcaatagatatttatttattgtcataaatatatgctgttatccagagacaaataataaaggctttttaaagtcaaagatggtcaaaagtcagaatttgaaacacaggtattcctcaaagatattgggagttcagttccagactactgcaataaagcaaattctgaaatgaggcaagtcacacaattttttggtttcctagtgaatattaaatttatagttacattatattgttgtctattaagtgtgcaatagcattatgtctaaaaagtgtacatagctgaactaaaaatactttattgttaaaaaatgtttgcaatcatctgaacctttagtgagtcatagtatttttgctggtggagggtcttgccttgatgtttatggctgctgactcaatgcggtggtggttactgaaggctgtggcaatttcttaagataaaacaacagtgaagtttgccacattgattaactcatcatttcatttcatgaaagatttatctgtagcatgtcatgatgtttgatagcattttgcccacagtaaaacttctttcaaaattggagtcaatcctctcaaaccctgccactgctttatcaatgaacattatgtaatgttctaaatccttcgtggtaatttcaacaatgttcacggcatcttcactagaagtagattctatctcaagaaaccactatctttgcttctccataaaaaacaactcttcatccactgaaattattctgtgagattgcagcagttcagtcacatcttcaggctccacttctaattttagttatcttgctatttccagcacatctgcagtgatttcctcaactgaagtcttgatcctctctaagttttccatgagtgttgggatcaactttttccaaactcctgttagtgttgatattttgacctcctcctattaatcacaaatgtagattgtagcataattcataatgttgatttagcataattcttaagggccctaggattttggaatggcaattgagcattgacttacacttacactaatgcacttaaaccagctacagtagcccctaacagtataatcaatctgtaatttgaaggtttgaagccatgcattgacttctcctctttagctatgaaaggtttaaatggcatcttcttccaatagaaggctgtttcatctacattgaaaatctgttgtttggtgtagccacctttatcaataaccttacctagatcttccggataacttgctgcagcttctacatcagcacttgctgcttcatcttgcacttttaagttatcatgatggcttcttacctttaacaccatcaatcaacctttgatagcttcaaacttttcttctgcagcttcctcacatctgtcatccttgataccattaaagaaagttaggaccctgctgtaaattagggtttgggttaagggcatattgtggctggtttgatctattcagactgctaaaattttctccatatcagcaataaagttgctttgcctttttatcatttttgtgttccctggagtagcacttttaattttcttcatgaactttttctttgctttcacaagtgggcgatttggagcaaaaggcttagctattggcttatctcagctttcaatatgatttccttagtaagtttaatcattttaatcttttgatttaaagtgagagatgtgtaactcttcctttcatgtgaacacttaaaggccattgtagggttgttaattggcctaatttcaacactgttgtgtctcagggaagaggaaggcttaaggagaaggagaatatgagagacggggaagcagctggttggtagagcagtcagaacacacacaacacatattaagtttgtcatatgtgcgcagttcccggtattccaaaacaataatagaaataacaatagtaagatcactgaaaaaaaggttactattttggatataataataaagaaaaagttggaaatattttaagaatgaccaaaatgtcacacagagacacaaagtgagtactatgctgttggaaaaatggcactaataaatttgctcaatgcagggttggcacagatcttcaatttgtaaaaaattcattgtctgtgaaacacaataaagtgtagcacaataaaacaaggtatgtttttacatagttacaatgttgaatagcaacctgtgtttacatgagcagtcaattcatctatatattgaaagtctatgaaatgacctttttgcaaactcagtatctaagaaaaatgtagttaccataatactgaatgtgaatggagatataaatattatcttgcctctctgagtcattcaggaaagatttagcattttttataatagggattctatagtattttctcaatgtgtctaaatgcagcaactatgacttggcagaggcaatgataacagtctttttcctgttaacaacaataatctccaaaagctgaaacttcatatttacagttatttgatataaaggaatttatggcacattaaaaagtgcattgcttcttctctcagtacctgtatgtgaaatatagtgaaaatatatatttttatagttgttgactattttgaagtatatcatgagagcatccactataatgcctggtaattaatatcagcagcaaaacacattactgtctaaattaatgcccatattctttatttcatttcttcatttaattcagcacttcaatattagcatatatgttaaatatcttccttaaattataataaatgaagaagccaattttgaaacctaattacagtgatgtattaaaacattttctaaatatgaatggttcctaacatatttttcatctgaatgtttatctttgttataatagacaaaagagtaaattaagacaatgtgatcactatgcttgatatgacacaattttacagctactggaattataatcattttagttttattttcttgctttgttttgttttgtttgttgttttgttgaaactattatacctagaacataatgaatgtctttaatcctcaagaaaaataaaatgagaaacatacttgttcaatataaagatactctgaaaaaaactgttaagccataagcaaaaactggaaagaaaacaacctctactcactctcatttttggagatgaaatttatttttatagtcccttactactgagactaaagcaacacattatctacttttttggcctaagatgagccttcacaatttctccagcaagattttcaaggatattttttttaccgagtccccctacattatctccccaatttctgctgttgtgaaaaaattctttatttctgaaaagttttatacctactaagtttactaccatgttattgatcaatattatatctgtaactggtttataaaagatgatcaatttatattgcatttgtcaaactatttgtcttcttaagtaaaattctgacttaattagaactatcagcatataaaatggttagttataatagacttcctggtgcaaacggcaacattttaactacatttctgggaggccaatatttgcctaattgtggctattatcaaatgaccatttcatatttggatgtaaaaatgtggacaataataaaatagattgtctaattgtgattacttactaatatagttagggttacttattctagaaaatgaagtctctgttttcatcttttattttttttcttgcattaatgtttgtcagtccttgtgacaggaaaaaaatattagaaatttaacctcttcttatttcaacccctcccattcatatcatcctttaagaaaaaagtgagggccttgaatcctagaatgactagtgaaagtgttttaaaaaaaaagagaagaaatttgaaaatcggctttttttctgatatgaaatttctagagttaatttttaatcttggagcttgatgatacatatgtcatatagtcatgtgtactctaatatggtatatttttttatgaagcataactgtaaatatctattttataaagcaaaactgtaaataataaagaattgagaatttggtctccatgtcattagtaacataatttggataaacaatcttttttgacttctgtcttaaattccatgagaatgatgaagtttgaataatataaaatggtatgtttacattccaaggcatgaacttgttaaaattacaattaatctgcaattatctactcattagtttcaataatggtgcatataatttgagagcagatgagtaagaaaagcacagttcctttctatctgtgagattatattcctgaagactcaattctagaagaattacttttagaaaaatatgagaaaaaaagtatgttaaataactgaagaagtgtctgaacgaatgaacgatcttgacagtcattaaataaaacaatgaagacagcaaactcaattcaatatcaaattaataacgttatatgtaccaataacggatatgatagcttcattttgggatcaacctttttatattttcaaagaattattcatagattggtttttatgcatgctagataatgtaaaataaaagcaaatttctgcctgaatgtctaactaactgttagaaaaaacagctctaaccaagctgttttcttatttcctgattcacaagtatgaagtcacatcaaatagtatcatttgttctagaggtaaagaatgatgtctctgtcctttttcagttctattttttaaactttacagtaatgttggttcaatttctgtaacagtggttcattgatgttctgttttgttcttttttgttttgttctaagccactgtgtttttgttttttgtttgttttaagccactgacttcatttttgttattgtggtaaaatacacataatataaaatttgccatctcaaatatttttaagcatatggtttagtggaattaatacattcctaatgttgtgtatccaacactgtcatccatcttcataacacttttcatcttgtagaactgaaactctcaatatattaaacaataactctccattttctctgaaaattattccaccattttctctgaaaataaatcaccattttctctgaaaataaaccaccaacgtggttaggtattagaaggttgatccttttgggaggtggttaggtcatgaggtcagagctgtaaagaatcggattagtgcctgtataaaagaggttcaagattgttgtcttgctccttccacatgcgaggacatagcaagaagccttatgtctgaaccaggaaactggcccccctcagacactgaatctgctggtttcctgatcttgaacttccctgcctttagaactctgagaaataaatatttataagccactcaatttatggtattttttaatagtaactcaaacgtactaagatatctcctcccccagcctctggcaaccactattttatttttgtctctaaaagtttaacttctctaagtactctatgtgagtgaaatcataaagtatttgtctttttgttactagtttatgtcacctagcataatgtcctcaaagttcatccatgttgtagcatatgtcagaatttcattccccttaaaagctgattgatattctattgtatgcatagacctcattttgcttatccattcatctgttgatgaatacttgctttgatcccatcttttaggtgttgtgaataatgccgatatgaacctggctgtacaaatatatctttgagactctgcttgcaattagatatacacttagaagtagaatccctggatcatgtagtaattcgttttttaaaattgtgagaaacaactatactgttttccacagtggctgtaccattttgcattccctccaacagtgcttaagggttctaatttctctacattctcaccaacatttgttattttctttttttaaaaagtagtagctcttctaatggatattaaatggcatctcattgtagttttaattagcatttttctaatgactagtgatgttgagcatctttatgtgcttattggccatttgagtatcactggagaaatatctgttcaagttctttgcccatttttgaattgagctattgcttttttgttgagttttaggagtttttatccattctccatactaattgcttatcataaatctgagttgcaaatattttctttcattctgtgggttacatttttactctgttgctactttaatgcacaacttgaaaaaaaatacgaattccatttgttttctgttgtcatccatgcctttagtgtcatacccaaaaaattactgccaaattccatgtcatgaagtttttgtcccatgttttcttctaagagttttatatttttgaatcttacatttaggcctttgacccattttaaattaatttctgtacatagtgatctaacttaattcttttgcatgtgaatatccagttttcacaacaccatttgttgaaaagactatctattccccattgaatgaccttgcctcttttgtacaaaataattttaccatatatgcaaggggtacttctgggttctccattctgtttgattgatctatatgtctatttttatgccagtaccacgctgttttgattgctggagctctgtagtgacttttgaaatcaagaagtgcgagtcttccagctttgttttgtttttcaagatttgttgtggctattcagggtctcttgagattcatatgaattttagaatgggtttttctatttctgccaaaaaaaatgccattgggattttgatagggattgcgttgaatctgcatacgtctttgggtagttttgacgtattaacaatattaggtcttccaattaatgaatatgtgatgtattttcatttatttatgtcttgtttctttcagaaatgttctgtagtttccattgcacatgtcctttaattccttggttaaattaactcctaagtatttaaatgaattcttacatattttactacttttgatactattataaatggattttttttgtaatttctttttcaaaatgtttattgttagtgtatagaaatgcagctgattagctgggtgtggtggcttatgcctgtcattccagcgttttgggaggctgaggcaggaggatcacttaagtccaggagtcagaggctgcagtgagctgtaatcatgaataaaactgtatctccaaaaaaaaaaaaataacaataatttaaaaaggaagaaatgcaactgatttagtatgttgattttgttgcttttttacttttctgatttcatttatttgttataacagctatttaacatggaatcttcagggttttctgcatggttttctatcatctgcaaacagaggtaattttagtttgttctttacaatttggatgccattagattggggtttgtttcattgtacctgaaacgtctttagctgaaacattcttttgccttttagaaaaagctgcctacgtttcactgatacctacatttttaaatgcatatattctaaatctccattcattttttttatttcaaagcaggctgggtcctgtcatgacagttttgccttccatacagaccttcctgcattgtctgttaaacattgaccaattatttgattaaggcatggagtccaggtcagtgtttctcaaaggggctgatctgcaagctttatgtataagctgcacaataggattatgttgtttgtattaaaatgtaagttgatgcactacttcctttattgaaaaagtcttcctcaaaaaaattaccagctgaacttaactgcactgtcatgttggttgttttttgtaaacataagttttcaactcctttgagtaaatactaaggtctatgattgctggatcacatggtaagaatatgtatacttttgtaagaaactgccaaaatattttccaaagtggctgtgccattttgcatttccaccagcaacgaatgaaaattcacattgctctacatccttgccagcatttagtggtgtcagtcttccagattttgggcattctagtagccgtatcatggtattttattgttttaatttgcatttccttgatgacatcatgcacagcatctcctcataaacataatttccatctgtcttctttggtgaggtgtctgttaaggtctttggcccattttaaaaatcaggtcatttattttcttattattgagtttttagagtttttgtatgttttcagtaacaatcatttattagtatgtcttggcaaatattttctcccagtctgtagtttttcttttcattttcttgactgtgtctttgcagaacaatgaaaaaataatttcaatagagtcccgcttaaaagttacttctttcaataattatgccattggtgttgtatctaaaaagctatcaccaagcccaaggtcatctagctttttttctatgttagtttgtaggagttgtgtagctttggactttgatgtcatgtgatttggatttggatctaaacctgttatctggaatgtgtgggttgcttgaaaatgtaacttctcagatttaatttccttatctataaaaaggagatagtgataatactttacacatttgttataaatattaaatgaagtaataagtatatgaaatgtgctagcacaattatatactgagttaacctaaaaaatgttggccatctcaatccttttttcttctatatacattcagacagatcctacaaatggctcaatatcttttctcaagtagatgatttccatatagttctctactgaataaattggatttatttaaaaacttgattggcagttcttttgttctttctgacaccaaatacctggtgtgttttccacatcaattctccaattctccagcactaactgggtattcaacaattcagtttaattctcacagtaaatatcctgagttagcatacatcctacaagttaaaggactcagccccactagattggccccatttcaaatgccagttacaaatccctgtttgccatccatacttctaacctaccagctatagattctgaggttcccatgataacccctgccacctcaggtttgatagttgactagatgaactcatggaacacaagaaaacattttaattacatttacaggtttattatacagtaggttttactttccattgtttcaacaacccaaagtcaacagtgttccaaaaatactacaggatttaaaacaattgtactgataacaatatattttacatatttatgaggtacatgtgaggatgtgttacatgcatagaaggtggaatgatcaagtcagggtatctgggctatccattaccctgaatatttatcatttctatacatagctcttttagctatttttagctattttttaactgtttacctctttaactatatacctgtcttttagctatttttattatataatacattgttgctaactatactctctctaatctgctatcaagtattggggtttatgtcttctatctaactgtatatttgtacccactaatcaacatatctttatcccctcctcccacccatacaccttccaagcctctgatatctatctatactctatctccataagatctaattttttaatctctcacatatgaaagagaatatgtggtatttgtctttctgtgactgtcttatctcacttaagataatgtcctccagtttcatccatgctactgcatgacatgatttcattcattttaattgctgaatattactccattgtgtacatatgctactttacccattcatccattggtggacacataggttgattctatatctttgctattgtgaatcatgctgtgataaatgtgcaaattcaggtacgtatccctttgatatatacatttcttttcctttggataaatatccagtggaattggtagattgtgatagttctatttttattttttttgagtaattgtcataatgatttctgtagtgggtatactaatttacttgcccactagcagtgtatgaattgtcttttctctgcatcctcaccagtatctgtttttttgtgtttttgttttgttttgttttttgtctttttagtaatagccattctaactggggtaaggtaattggtaaggtaattgtggttttgatttgcattttcctaatgattagtgatgttgagcagtttttcagatacctgttggccattttttatgtcttcttttgagaaatatctatttatgtctttaggccacttttaatgagatttttaaaaaattattgagttatttgggttctttgtatattctagatattatcctttgtcagattaatagtttgaaaatattttatcccattcagcaggttgtcagttcattctgttgtttcccttgctgtgcagatgcttttaaatttaatatagtcccatttgtctatttttgttatagtagccggtgatttcaatgtcttagccattaactctttgcctagactgatgtcttaaagtgtttcccctatgttgttttctagttggctttatagttttaaattttacatataagtctttattccatcttgggtttgtacatgggtagagataggcatccagttttcttcttctgcatatgggtattcagttttcccagcaccatttattgaagatagtatcttttccccattgtatgttcttggcactatacaaattgtcagttggctgaaaatatgtggatttatgtctggactcattactccattccattgatctaagtctgtttttatacgactgctatactgttattgttaccatggccttgtattatattatattttgaagttaggtaatatgatgcctttaactttctttttgcttaggattgctttggctattctggctcttttttggtttcatacaaattccaggattgtttttttctaattctgtgaaaaatgatattgacatttttgtaaggactgctttgaatctatagattgctttgggcagtagaatcattttaatgacatcaattcttcttattcatgaaaatggaatgtctttccaattgtttgtgtcctctttaatttatttcatcagttctgtagttgcccttgcagagatcttttacttcctttgttaaatttattccatatatatatatatatatatatatatatatatatatatatatatggaatactttaagttctaaggtacatgtgcacaacgtgcaggtttttaacataggtatacatgtgccatgttggtgtgctgcacccattaactcatcatttacattaggtatatctcctaatgctatccctcccccttccccctaccccacaacgggccccggtgtgtgatgttccccttcctgtgtccaagtgttctccttgttcaattccctaccatcagagtgaacaggcaacctacagaatgggagaaaatttttgcgatctacttatctgacaaagggctaatatccagaatctacaatgaactcaaacaaatttacaagaaaaaaacaaacaaccccatcaacaagtgggtgaaggatatgaacagacacttctcaaaagaagacatttatgcagccaacagacacatgaaacaatgctcatcatcactggccatcagagaaatgcaaatcaaaaccacaatgagatatcatctcacaccagttagcatggtgatcattaaaaagtcaagaaacaacaggtgctggagaggatgtggagaaataggaacacttttacactgttggtgggactgtaaactagttcaacccttgtggaagtcagtgtggcgattcctctgggatctagaactggaaataccatttgacccagccatcccattactgggtatatagccaaaggaatataaatcatgctgctataaagacacatgcacatgcatgtttattgcggcaatagtcacaatagcaaagacttggaaccaacccaaatgtccaacaatgatagactggattaagaaaatgtggcacatatacaccatggaataccatgcagccataaaaaataatgagttcatgtcctttgtagggacatggatgaaactggaaaccatcattctcagcaaactattccaaggacaatttattcctatattttttctagctattgcaagtgggattgttttcttgattttttctcagctagttcattattggtatatagaaacactactgatttttttgttttgattttgtatcctgcaacgttactgaatttatttatcaaatctaggatttgttttttttttttttttagacagagtcttgctctgtttcctaggctggagtgcagtggcacgatctcagctcactgcaacctctgcctcccaggtttaagcaattctcttgtctcagcctcccaagtagctgggactacaggcacacaccaccatacccaactaattttttttttgtatttttagtagagatggggtttcaccatgttggccaagctggtcttgaactcctgactttgtgatccacccaccttggcttcccaaagtgccgggattacaggtgtgagtcactgtgcccggcccaaatctaggaattttttaaatgaagtctttatatttttctagatgtaagatcatgtcatcagcaaagagggacactttgacttcatttttttaatgtagatgctttttatttctttttcttgcctaattgctctgcctcggacatccagtactatgttgatgtgctgctgaattctatgtggttatatttttttgggatttttgcatctaccttcagggattttggcctgctgcactgtaagcctgtctctggagagggtggaaccactgtcagtgggagcagcttaggcaggcacctgtggaacaggtgatctccccttgtcttggtcccataatagcctgcagcatcagcatcagggagatttgtcttcagggtgtgtgaaagtgcccagcctcctgccctccaccttggccagctgcaccagagatggtgttagccccagggcaggtcacagttctggagcaattcctctacataatatctaggcagctttctgtgttagtctggaggcccccagagagtcaagcggttttctcatgcttcggattattgaagtcattggtggggttgtgaagccctgggggtcagtcactcactctttcccggcatctgcagcttctttccttattatagtattttaagagagaagaggagggactatatttacatcacttttattactgtatattattataatcattcttttattattagttattgctgtccatctcttactgtgcttaattaataaatgaaaatttatcataggtatgtatgcatgtataagaaaaaaacagtaaatatagtgttcagtactatctgcaagttctgtcatttgctggggatcttggaatgtatcttgcatggataaggggggacaactgtagtgaatacaactcaggaacagccaaatagaaaagatgcagtgggtaaggattgatgaaggtgaagtatagatcttccatgctgtcttcaggcacaccaccctgccaacacttctatgtgttcatggagagagaggttgtcatatattaattgtagcaattcaactcttcttaatgggcaatggaagaatttaattccctgacctaatactctaactcctagattttcttttataaatattgcatttataaataattatgagcacaattttccttaaatgactttaatcccaacaaagaaccagacaacaagtatttggttgggcatgcttttgacttgggaagatgtggctcgagaggaaatcactctaatgagtacatatttctcagtgctcctccaatggttaaataattaagattgtacttatacgaagtcctccaaatagacaggactgtttcaactcctctttcaactgtacgtgattgaagacagcccatgcatatttaacgtccattgtctcacactcccttaaatatttaaaaacaggttatattaatattttttaatattcatttgaaggttctattatttatttaaacatcttttattgtttttaaaattaaaaaaattgctttgcttacagttctggtactcattgaaactgtcattttttttcaagaaataaatgcaaaattttattcatgctgtcaaaaaaatgcatgaactacttactctctcatccccttattaagaaatacacacaaataaacattttcctataatctggtattttcatgcattattcttcccaaataaggtagatatctctatatggatttaaatattagaactaagtatttagaaaccttgctggacatcttgagccagtagatacaaaaagaaaatgctaaaatcattaatcttgggcacttgttacttaatgactttattacaactaaaatccttaattactttgaaaggttacacttttaccttcagacatttaatattctacaaacacttgtatagattataatatatgggtaataccaaaattaatttacatgaagtacattgccatataaactgcagtttgaatttgattcaaaattctgtaacatttttctttaaattagtagttttgttgtaatactttgatgctttccacaaagcatgacttttcttcattgcctttgcaaggctgtgaattttaaatgatggtgtgagtaggtcaacctctattttaattgataactttaaataaccagtaaggcaagattttcgaagtcctcttttagggagagagctaattcatgaaccactggtagtatctgcaattggaaataatgtgacataggctgtttttaagagcatgcattctgaaatcagattgccttgtttgattccttagtctgctactttttagctgggtgacttgcttaatttttctgttcgtcttttctttttcttctataaatgggttattgttataaaaagataatctgtgtgaatatcttaacacagtatctagcatttagtaaatattcagtgtcaagaaatataatctttatttttataatcatccttcagtatacatgtagtgtggtagtttcataaatagactttttaaccaactatcttagtataagtgaaaaaacttgtataatataataatataagagtcatatattttaattgaacaaaacacaggcacctacttttcttaagaaatcctacttttaagcatttcagaatatgctaagtagatttttctcataatattcctatatatttcatttccttcatgttgaatacttcataaaaacattctgaataaattttatgccataaaaaactgattctatcacaatagtgagctctaacttttttttaacacctgaagatttctttcatcatattcgaaattttcacactatacatttcatcataactgcaaaggcctatccttctcaccggatattccaaagaatgaaatgtccaactattaatagctagtatgcttaaaatgaaccatctatcaggagaaattttccattgacagacttgagtgcactataatgagtgcgcttggtttaatattatttagcttttttgcggtgaagaaaccaccctggaatcaaagtagtgtgggcagtcttttaaataaaaggccttttaaatagcctttaatttagggatgctttgcaactcagactctattaaactttatgaaaatagactatgtttgaagaattttaacccaacattatcattcttccttacaggccattgaaaattgaatgggctgaatctttcaggtgtgggcaaatgacattcatatatagagagagtctagaaaaacccccattgctggtaataattcattaagtcggatactttcaaagaattctcacaaaaatcatctataaaaaagtaaatataggccgggcgcggtggctcgcgcctgtaatcccagcactttgggaggccgaggcgggcggatcacgaggtcaggagatcgagaccatcctggctaacacggtgaaaccccgtctctactaaaaatgcaaaaaattagccgggcgtggtggcgggcgcctgtagtcccagctgctcgggaggctgaggcaggagaatggcgtgaacccgggaggcggagcttgcagtgagccgagatcgtgccactgcactccagcctggacgacagagcgagactctgtctcaaaaaaaaaaaaaaaaaaaaaagtaaatatatatttggggatattttcccattaggtataatgaattacactgacaacctcttccacttaaaaggaaatttctccttttgtaagaagaaaaaaaatagctacaaacacgttaactttgctaggcaaatacaaatataacttgacagcaaagactgtattcacttaacttattagtatttgactgtagtatcattaatctccacttcagtattacattccaacggtcatatctttgattttgtaatcattccaaacttctctacctgtgagctattaaattgcaacaatatgctgttcattaactgaaacgttctggctcccggatacctttgtcctcaatgtatttgcttttcaagttttcaagttgttctagcaaatcagtctgttggctgtcttcccctatgagtttccttctgaattctttccttcctgaaccagcttagactgtcccttaaactatgccttaatgttttgcctccttgtccttttgactccactcatagtgtcagactcttgacttttgaaggatagaaggcatctgtttcagttatttcttgctatgtaacaaactactccaatacttcagagcttaaaagaaccacattttattatatctaatcatagtaattctaacagtggatagctgatctggtctctaatgtccaagatggtttcttgtgtctggaaccttggaagggacaagtggaagtctaagctaaactctgccctctccttctccatattgtctctgggcctcttcacatggtttttgcagaggagaggttgaagttttacatggggttcagcacttccagagtgggtgcttcaaaagataggaagtggaactgccagacacttgtgtcctggtcccagaaattggcacagcatcacttctgctctgtgttctaatagtgaaaataatcacagagcccatccagacttaatgaaatgaacataaactccaggtcttgatgggaggaattttgaagagaatgtgtacatctttactcttttaacaccactcaagtattcatttatttaatgaataatgatatatcaccaattataatgacagatactgtaatagacacataggatgcaacaatgattggagaattttaggtccctttgtaatggagcttacataaacaagatatgaacaaagagtgaacatatgcagaaaatatatgcaatgataaataaaaattaaccaagggagaagttactttactaacttgtcatcaaagatgggcttcctaaagaggtaaaatctgaatgatgagaatgagccagctattgaaagaccaaaggaaagaacatctcaggcagaaagaacaaattagaggtctaaagtctacaaaagacttgtcatgtagaaacaagaagaaaacttatgtgtttgggacatagtcatcaagacaagaatagttgagaatatggccagagccagaacttgcaggaccttgaagtcctgaatagcaaacaagggtgagtccataaagtttttcgaacaggaaagtaacatgagctgatttttctgttaaacacgcatttgacaaatctcagaagaatgagagaacaaaagaagtacattgacctattacaggtatactgcagggaatttgttgtagtccatgtgagaaataatagtagtggtagtggatatagtgacaaatgtataagctcctaatatattttaaggtagaatcatcataaataattatcttttaaaatcatggacagtgttcttgaacagttatcactcattatttctacagtttaaccatcaattcacataccccaaacccaaattatatataatacacagaaaaaatgcttcactatattccttaatggtactaaacttgtcaaagaaaaaatatatattttacatatcttcagtcttaacttgttttttgatagcatttggtacttttgaccactcttgttctctaaaacatgcagctcctttaatttttgtaacacaacactctagatccccacatctcactgattgtttatgattattctcctttaaaagcttttatttttctctaaccccataagtgattatattcaagagtaaagttcatatttggcattttacttatttttgtctatactcactctgagctatcttaataactgtaaccttcagtcagccctttcttctgagtttaagatccattttttcccttgacaatcagatacatgtttctaggcatgtaatagacaaaatattatgtaaaatctctccaatgtaaacaactaaaatctggacaatattgtaaaattaatattaaaaacatttaaaatgtttatttgaaaaatactttgtcaaatttaatgaaagaagtacaatgaagttacatttgccttgagggtatttgctgaatatggacaaatttgagcttcaattctgatggcatctttgggcaaggggtgcagaacttcaaacccagaatattcactaggggagggatctgttggtagaactgtctcccaagaagttggatctcaaaggattatatctgtagggtaggagtaaagcagaagtaaacccaatctacacattcccactcccaagggagtgcaggaaatgtgtgactttgaaatgaacaggatgggatgatgtggttatccattcttgaaattatagttacaagttgacctttatatggatttttaactcaaattcaagtcacttgataattcaaatcagcctcaagtcatgcacttaaatgtgatcctagacagtgatgtctatagttgcccgtggacacaaattttctctggagaaagaaaccatcattttagtcatcagcatatcctataaatatttttaaagggcaacaaatagcatagaatcaaattgatcaaaattaatcaagaacacacaggaagacagtactttgaaagaaaaccaacagaaaaacttcctcaaaacttcaattgaaattatcaggcagtggcccggtgcggtggctcacgcctgtaatcccagtgctttgggaggccaaggcaggtggatcacgaggtcaggagatcgagaccatcttggctaacatggtgaaaccccgtctctactaaaaatacaaaaaattagccaggtgtggtggcaggtgcctgtagtcccagctactcgggaggctgaggcaggagaatggcgtgaacctgagaggtggaggttgcagtgagctgagattgcgccactgcactccagcctgggtgacagagtgagactccatctcaaaaaaaaaaaaaattatcaggcagtataaaacaattactttgtttaaagaaatggaagataagcttaactactttttcaggtagtggaaacatacaaaaaagtggtgtgcaggtatacaaaataactatacagaaaaagaataaatgaagtatacgttattggaattaatacacaatatatattttgcagattaagtaggattggagaaagaattaagaactgaattagctcagacgaatttattcataatgcagtacagaaaaaccaacaagtgcaaaatttgaaaaggggttaaaagacatcaaaagcagaatgaacaggatcatctaatgaggctataaagaaggaaatagaggtgttatttaaacagctaatgatgagaattttccaaaattacctcagatgaaagacaccaaacttaacagatctaagaagcccaacaaatttcaaacccataagtaaaaagaaactcatcactaggaaccgtatattgaaactgcagaacagcaatgacaaaggtatttcgaaagtggctggaggaaaaaaaagacattcacgtcaaagtgtgagactttgagttgacctctttacaccaacaatggccatctgaagacagtggaattatataatgatgcgctgaaagaacaaagcctgccaacctacaaggaaaataccttttaatgttttatgtgtgtgtgtgtgtgtgtgtatatatatatacgcatacacatatatgtatatataaaacattaaatatatatacatatatgtatatataaaacatgtgtatatataaaatattaaaatatatatgtattttaacttatatgtacacatatgtatatgtgtatacatatgtataattctatatatgtataatatgtacacaaattctacatatgtgtgcatatacacatatacatataaaatgaaaattatatttcatgtacatatatgtgtatatatacacatatgtatgtatatgtgtgtgtatatatataacataaaaatgtatacacacacatacatacagacatacatatactttgagacctttatttacttccccacatcactaatcatggattattgcctgcttacgagtggctaagtcttggatctccttaggaaaacatagcactatttcgtgtgtatggtgtcctataaagaacttcagtctttgggtatagcattaagagctcttggtttcccagcccacaaactaaaatatattttttagaaaatcatgatcaaaaagttcactaaagatatgatagatctaaatgataacttcagacacaaggaaagtcatcacagatggaaagtctacaatgaaagaaggaatgaagggcaaataagctagcaaatatctggacattttaaaaaatactataggtataccatattatactataatgtacaatataattttttttttgaggcagagtccagctctgtttcccaggctggagtgcagcggtgcaatctcggctcaccacaacctctgcctcctgggttcaagcgattcccctgcctcagcctcccaagtagctggggctacagccacacgccacatgcccggctaatttttgtatttttggtagagacggggtttcactatgttgcccaggctggtctcgaagtcctgacctcgtgatccgccctcctcagcctcccaaagtgctgagattacaggtgtgagccaccacgcccaactatgtacaacagactttttattaaaaaaagaggattgaaattcatgacacagtaacacgttagaatgagaataaaaggaacaaattatccttagattattgtgttcttcagtagtataataagggtattgattgatgtttttggataacttaagtatgcatgttgcaagctttgagacaatcggagtagtagaaacagagtaaataaatcttcaagtagtagtggcaaaaagatcagaatgataatgtaatccatccatctaaaagaaggcaataaagagtagcagaaaacaaatagtacaaaataatgttacagtaaatttaatacaaaaatgtaataaaataaaagtacaaaataagtagttacagtaaatgtcaatgaataaagtgctaagtgctctgggttaaaaaaagattgacagacttaaaaaaaatcctaaaaaataaagcataagctcatgatgtttaaaagaggtgcttgtaaaatttaaagatactgaaagtataagaataaaaatacttataaagatattaaaagtataagattaaaaggatggaaaaatatcacatgcaaatactaacataataaatgccaatgtagccatgataatgttagactatatatatatatgtatgtatccacacacacacacacacacacacacacacacacacacacacacacacacacatatatagcattgctggagataaaagagattatagtgataaatattcaatattcaactcatggacaacataaaacaattctaaattcatatatacttaatagcataacctcaaaacaggtaaagcaaaaaggaggcagaactacaaggagaattttttaaattagatatctaaaacttttaactttttttagaggagtttaacatactcttatgaattaattcaactggaataagtaggcaaaaaataaatgaataaacaaccatatagatgatttggacaactcctcgatattagagttggcccaatagatacatatcaatcacacttcaaaagtgcagactattccttcttagtgggcacacccagaacagaaatctattatatattgtgtcatacagcaagtgttaacaaattcagaggattgaaaacatgtggactattttatctgactacaattcagttaagcaaaaaatcaaaagcaaagagaaaataaaacattacccatatgtttggaaatgaagaaacactgcttctggatgtaattgacaggtgcatgaaatggacacattcaacacacaccaatctacctctccttttcctcactgtcttcatgactgacactgttatccacttcattgcctaaggcatcatttttggtcccactgacctcaccttagttcaggctttcaccagtgatttaatttttttgcaacttgtctcttccctctgtggtttatgcttttcctgtctaccacagtgtttttccaaagaaaaaaattatttgatcatataaatcctttatttaaaaattttagaagacctcctcaataccaagaaaatgcattccttgaatagagtctctttcttttcatctttatttccccccaagcgcttatggtcttcttttgtgcatcagctatgctaatccatctgcatttctctgaacatcccttcctcttcagattttgtacctttgtatgtacccattcctctacctggaatgccttctcttactgcttactcacctgaccatctcctatacattctggaagacacagctgagcattatttttgtagcatacttgcctggtcaactctcatagtgtcattcacttcttatttacttagcactgtagaattatttttcatacagttttgtaaattagctttttaaatagctgccttcagtatcagaccatgaagtaaatgaagaaaggaatcttttcattgcataataaaaaaagaattcttaccacttttagacaaaggaccccaaacaaacaaaaaaggaatatattgataatattagaattaataggaaagtttaaaaatatttgctgaaagaggtacgaaggatcagtcagctctagtagtttcacctgcaaatgcatttgtaaagcaaggaggctcatttacttcctaccctcaggaaatcacatttcccaacccaagctaaaatttctgggcttaaatatgttcttcattcacctcctacactcctcctctattgctgcatgtgttactgcaaatggcttcttctaataagagtagcttttggcttattgcaagtcacatctttcatctgtttttacatatcttttctacagatccccctgcagtggaaccagcattcttggaaatccggcaaggacaggatcgaagtgtcactatgagttgcagagtactgagagcctatccaatacgggtgctgacctatgagtggcgcttgggcaataaattattacggacgggtcaatttgactctcaggaatacacagagtacgctgtgaagagtctttccaatgaaaactatggggtttataactgtagcatcataaatgaagctggagctgggagatgcagctttcttgttacaggtaggattccagatattttctttttatacattttgttttattagaccaagagatcttagacctatgtcaatataagaatgaaaacatttgtaaatcaatggagcatagaacagcttgactcctcaagttagagtttctacaaatttatttttaagtcaaatttattttaatagttaaaagaatgcacaggcctacaaaattacatagaaggttatctgaattctagtagagttagtgaggaggaaattggttattatattagtcaattctcacagtgctataaagaactacctgagactgggtaatttatgaagaaaagaggtttaactgactcagttctacaagctaaacaggaagcatgactgggaagcctcaggaaacttacagtcatggcaaaaggcaaaggggaagcaaggacctacttcacatggtggcagcaaagagagagagagtgaagggggaagtgtcacacacttttaaactatcagatctcatgggaactgactcaccatcacgagaacagcaagggggaaatccacccccatgatccaattacctcccactagagccctcccctgagaagtggggattacaattccacatgagatttaggtgaggacacagagccaaaccatatcagttattttgagtgtttcaataataataagacatactgtagtgttggctggctttaattagatcaagttgcaaacatttttttttttctattcaaatctcatgtgaatagataattgctctggttttcttattaccagaattttttttcttttgtttatttgcttatttatatatgtatttatttactacctggcaatatatggtgactttcaattttgtctttgactggccatatgtttacaaatattccaagaaaaagcagtagagttgtatctgacagatagtaaattagggagaagtattgactctttatgtcattgtgttttaaacattccctctgtattatgtcttatgtaattatttacgttatttttataatctatatactgtacattatttatgagtgacaaattaggaatgcattaaaagaaaatactcctcattttctttgtcataggtaaagttagttgtaatagttgaaatgttcatggtagtaaaaaaaagaaactggacattatgtgttatctaaaaagaagtcataaaaatgattaaaatgttccagacttaaaacttattaatagcataaattctaagtggtaatttctaactcatgagggaactctctaattatgaactgcctttcgccatttttgctttctgaaatgtaatattagctagtctaatctaggaaagcatatcagatgtctggatgaaactttgaaacaccaattagttcatttactaaaacatatcaggattagtattccttatgaatttctcatgactcgaaactttgaatctaacgtaagagagtcagggaatagaagtatacaaagatccatatatttttaatgcacaaagcaaatctttcaagataatgctgtttacttctgagactcaaccaaaaacattttaaattttattttttcaattattttactcttccacttaccatgaattttgtatagtcatcccaaagtacacttgatctacctatacaccgaaatgtacggaattgaactaaaatgcaatgacgtctatacctgtattagctcacaggaaatcttaaaagattattcctcttttctttcttcttttaaaattctatgtttatgatgtatgttagagtaaggggctaagagaataccgttgtgttcacttaaatgtcagaaggggtgtgaaaatagtttcctgctaggaaaaagaacaaagtaagcaaaggtattttggaaactgtgatgagcctagcttgtagtatattatccatgttaaagataattaactataatactaaaaaatactttgcatttgcatatattttatttactcgtattttaatggtgaagtcatagcagttttatgaggtttaagtgagcttcatgagctttagtagaaacccagatgccatttttcatcttctatgatgggctattttttacaagttctaaaggttaaggtagcatattgatttattagaataagcccatttgtaaatttgaaattccaagtattatctatattacttatatattaatatgtagacataaatagttctattttaatagttctgtaatattatagcacaggatttaactggagcatgcatttcagtttatcaaagattcaaaatgtctcaatatttaactctggaaaaacatatacttcaatacttcaaaatatctgggcttattttttcatggcatgactgaatatcattctatgttataccccattatgtcccatcacatttcttgatctagaaaagaaaaccagtaaatctagagtgattaaatagatggaggatgaacaaaagagttaatgattcagtgaaagaaaatttctgaaaataatttttaaatgagaaaaaagtgaatacagagagggtaaaaggatggcttaagttgaaaataaatcatatatattttaggaagctagctagtgccctctgaaaaagataagtctatgttctaatccctggaacctgtggatattaacttatatggcaacatatgtaattaagttaaggattttgagagaaggaacttatcttgaattatctgggtgggcctcaaatgcaatagcatgtattcttataagagagaggcagggggagttttgagagagaagaggaggcaatgtgagtgtgcagtaatgcaaccacaatctgaagaacccctggagccacaagaagctggaagagccaaggaatatattctcccctggagtctctacagaagtaggaagtagggtcctgccaagaccttggtttcagactcctggccttcagacttgtgagaagatagtttttgtttgtttgtttgtttaagccacccagtttgtggctgtttgtcgtggcagtcttagataacaaatacactttacaactcactatttcaaagaaccctgctgttaaaaattatacgagatgaatagaacagttttgtcaactgtcctcagttttatcacactaagcaagctagaccctggagacatgggtgcacgtgtcttacaactcagcaaagttgtgagaaggggttgcttttgccacctaaagggctaactggaataagcttacaactgcaagaagcagtcaatgaggaaaatcaacctgcgaggtttcaggtcacctacatcagtagactgtgtaggtttaagctacacattggcttaaaccaaccccaagggatgcttcaacattgaaatgttatgcccattacacaatatagcagagaaaagatgtttccagcagcttgattatataggaaaccagatgacagaatctactggtagattcggttgacagcaccagagattaatgaagatgcacttttattctttttttgaacgtgaagatacaggcaatctgcagcaaaatgcagcatttatttataaagttttaaattatctatgtctttcaaattgttctaattgatattcctaaatatttagcaatcaagatgttagttctaagctattctaattatgttcccactaactacactttcttcatatttctttactttaacagacttgtttctgacattatgtttttactgaaatgtttatgggcatcgggagactaatatttcttgacaagtcaggcaagacaataatgtgaaaaaaagcatagtttttatatttagcttttttgttttgtctagttgcttaaatgcaatagtctaagcatatgcatttattacatggttttagatcaaagaaaataagaggaaaataaaatggtaatcaatgttccctatataatccaggagataaaagtagaatgcccttctaacttccagaaagtgcatgtacacagttatatatacttagagttgtaaaatatttaggaattttatcaatggagacattttaagattcttttaaatgaaagatactaaaggggtggtgtttttttttcaaaagttaacagtgtatatatataatagattttttattgcataaccataaattataattgagtataaaaccaccaatatgtactctcaactgattttttttacagtcaggaatgtatttaacaagtatttactctctacttactaagtgtgaggtacaagattaaacatcagaaagagaacaataaaaactttctctgaaaaactttgccagttttacatttgcatagtatcttgaagtaattttggttttatatctattgcacttcttaagccttatattctcttctgggatactgcagtttccttttatctgatctctgaaattttcatattgttgggctttattttcctagaaaacctagcttatcttaagtgagaaaggttgattctgttcattgcctataggatgatatgcaaattcttcattgtcataattcttcaaagcattcattaatatttaaaataaaatatatagcataatctctatttcagttctaccagttattccaaattcaattcaaatttgactatgctgccttcccccaaatcatcacacatttgtgggactctgcctttcttcacatgttactttattctgaaatactagctttttgtatatctctatgctacagttatggtgacttttgtatatgactttaccagggttatgttaatcattattcttcagccaaatagaaaggtgcaggctgtgataatattttatgattcacaaattaatgattactgctgtaaatgcttttctctgaacatgtaaataaactccaaataaccaggatttaaatatggcttaaccattatttaaacagtctagaaaattatttcactcaggttaagtgatgtatcatttcagaaagtaacacgatggttctgttccacaaagtccttgggaattcaggcttcttccatcttaatcctcaaccaccatcaataaatggtacatcttataaccctgactacttaaactccagctattaattccacatttcctccaaaagtaaagcatgcttcttctttttgaggagacttcccaataattttagacactttttttttctgcttggatttcattgaaaataactttattgtattgcttcaccgtcaattaatgttgtgggtatagattttattttaagaagattaaattgcatttattatatatttaagtttcctttattgaaaatactgcaatgaaattaaaatgagattgccaaggaaaatccttgaactatggttttatctctgtaaactatgcaccattactattgtatccctttttcagagccacggacatttagtctcagaataatttcaaaagatagatgatatgaggtttaattattgactcaagatattttaatgctaaacataataaaattgatggtgctgtgttggttattatttctgcataaagaattacattatacaaagtcaaaagctttaaataacatatttattgtctcacagtttctatgtgtcaggattccaagcatggcttagctagatcctctgttctgggtctcacaaggctgcagtcagactgttggttgggctgtgttcttatctagacgctcaactggggaaaagtcccttccaagcttattcaagttatgtgaagaattaatttctttgtgttgtatgatagaggccctggtatttgctggttatttgctggagctaccctgagaccctagaatatgcctgcaggtcctagaagctacctgcaatagtttgtcccatgggcttctcaaaagtgactacttatttcaaacccacaagaagaatctctagctccagtctgctaaaatggaatcttatgtacataatacgatcacagaagtgacattctgtaacattttttaggttctgttaatcagaaagaagtcacggtttttccctgacactgaaggaattacacaaatatatgaaaaacaagagacaggaatcattgggagtcatcttagggtctttctgccacagcatttcctgccactaggagtcctttttgaacatagcctacataagaatgaaactgctgtatctattgaaatattaactaaataaatccttcatagtttaatccctttccttaatcctgccaaatagggttttacaaagcaaaattttgcctgtaactgctactctcacctctagtttggaaatatttgagctaggatttcacatcctgtattttccttttggcatattacaatattcatattgacatattggaactaccagtttctccatgttcagtatataaagaaattaaaaatgactgaggactttaatatcacctaaaacaagatgttaaaggaatatagcatttcttattcctgaagaataaatgggaagaaacaactactaaagcagatttgactccacatcaaaataaagtattttatcttttttttttaaatttggactgaattaacagtgaccagatagaaaatatattttagtctctggcaatgtttttatttacttatttatttatttattgctattcagctagatacttctttcttaataatgtctaaaaacaagcaacataatattgttaaaaatcattaataactatcagaagtaagagcagtctaaacatactttgaaaatgaaaaataattgccagtaaaattgtgataactctaaaaggcaagaaatttcaatgtcaaatcaaagtttctcaaggccagaattttgctaaatttattagaattttatttatgatgataacagatggactagtggatcccagtattttagccagcttatgagttgcagctgtactgaaaaataactttaagcagaaaatgatatcacttctatgtacagccttctgtaatatacgaagtgattccatacatatccttatcatctccaacaaccctactacatgtgcagaagagatggtatcaccctcctttgacagataaactaacagaggtccagtaagccaataataacatagttcaaactctttttgacacatatcagtgactcttttagtagtgatgataaaggaatatttgaataatcaatctagataaaatataggggaatccatgcgaaatctgaaaaattaggaataaaaatgtaagtatcacttaatgaagttaatgctatcacttattactaaaatatataccttaatattcaatttaaattcatataattttttaaacagttatttttctccagtaaacatataatgaggaatttatatttcatatcatacttaaataaaaacttcaattaaaattttcattatttttacagcagtttgatggctccttaaattatttgcattactcattttcttcattataaaatcatttaatttctccaataaaagattcagagcaatgttgctatcaaaaatctactatttaaagtgccactagcattcaaccctgccatcccactactgagtatctacccaaaggaaaagaaataattatataaaaaagacacctcaactcctatgtttattgcagcactatttacaatagcaaagtcatggaatccaactaagtatcaattaataggtgacttaattaaaaaatgtggtatatatatgaggaatactatatagccataaaaattaatgaaatcatgtcctttgtagcaacatggatggagctggaagccattattctaagtgaaatcactcagaaacagaaaatcaaaactcagtgttctcatctataaatgggacctaaacaatggatacacatggacataaagatggaaataatagactctggggattccaaaattggagaagagaaagggaggtgagggttaaacaattacacattggtaagcatttcaatgctcgctatttggatgatgggtacactagaagcccaaacctcagcattatgcaatatagccatgtaaaaaactacacatatgccccaaaaatcttaaaaaataataaaaaagaaatcacagtatcaaattacagcatggagcaaattacgtgaactcctctagtccacatggaactcttctggatgatgtactgtgggtatgactgtgttttattcttggtcagtatgtaaagaaagttctcccatgaatggaagattttaacatcttctaacagattagctctgtgcaagccatttaattctttgtggccttgcttcctctatctgtaaaatgggagatgataaatctgcttcccatggctcacataattttaggattatcaaataagctaatcagtttgaaagtgttttaaaaacaaagcagtatgatcatagaaaaataagatgagaagatttccagatatacccataggtaagctactttctgcctgagtaacacaacattgaaaatgcccctccaaaaaggcagagatggagaggatgactgatgtcagagataaagtaagtaatcaatgcacaattgagctttggttggaaaagaagtgtggtaagaatattaggctggaaccaatgaggccagtgacaatattttgtggcttgtctgagagatagctttgcattttaggtgagctttttcccctctgtatattattctgggtggcttattgcctgacattaccaaggagcagaaaagcagcaattctaacttgaaatattaggagaaacgttgagagagaatcagagctggaagggacagtgtatagaaatgagggcaacagggtggttggctctcagagtttctactgttcttcctctcctcacatctccatccacactccctcaagctagaccacacccaagaggcaggccaacttagggtaagagcagtgcctggacctagagtatttcaaactgagagaactggagggagaaaactgaagagtagagggaagagaagatagagaatggtaaaaatgatactgcaaccagatctctccgtcctgaagcactccttccctttacctaaggaacacaagcaagagcctaggtcatccttactctcatagacagtactggtcaagatatttagggatctcacaggaataaaatatgcaaaatcatgagcaaaacaattatgaaagcaagaagacaaatggaataatctattccacattaggtaggagtattaataatcagaaaataagatttttaaatacataaaatttcatcctcaaagaaagcagggaggatataagaaacatgatgaagaaaaaagagcattgcagaaaagaaatttatgacaatgggtataaaaatgtaacagttgatataaataactatattactagactaaattgcagaataggcacaaggcaggcataagtagtttgaaagatgtcatagaggaactctcccagtagaggacacaaaggtaagtaaagtcttaagaggtgtgaaggacaaaataataagtatctgcttagcaggaaacccataaagaagtaaaagaccaaatgcagaaataaaattaaatgaaaaaaataataactgagattttttttttaaattagaaagtaaaaaggacgactgtattagtctgttttcacactcctaataaagacacactcgagactaagaaatttacaaaagaaaagggtttcattggacttacagttccgtagctggggaagcctcacagtcatggtggaaggcaaggaggagcaagtcatgtcttacatggatggcagcaggcaaagagagagagggagcttgtgcaggggaactcctcttttttaaaaccatccgatctcatgagactcacggaaagagcatgggaaagacttgcccccatgattcagttacctcccaccagatccctcccacaacacatgggaattcaagatgagatttgggtggggacacagccaaaccatattggctagacttctgagtgatgtggctcatggagtgacagcaacaatatgttggggggaaaatttacatgctctgataaatttaaatgaattttaaaatatcaagtacaaaaatgtttgaaaagttatttatagagataaagcagataatttatacaggatttagaattatatagacattaaactttgtgcaacttgacatgcagagagataatggagttatgtcttcaaaatattaaagaaaaagtaattgaaaaagaattttgcatgcaaataaatgtacaattaattgcgaggacacaatgaaaatattcctattctaaaagtttatcttacaaagataattttaaaaagaattcttgtttgttggaattaagcaagaaagagatggatctgagggaaaagaatggaatatgagaaagaagaaagaatgagtaaaaacctaatcaagtctgttttttgtaaacaagtaatgtttaaaatattttattcataatcattcagtattaagacttgagtcaatgccaatatgacataaggggcaggtcttatgaggatataaggggaaggacctggcatccttcctacgacctgtcagtcatggtagggagttgttgacactgaaaaatcagtgtttcactgtactgtcagttttccctgggcctgtggtgtaagtaaggtggctggaggaacttaggggtaaaagagaaaattctagttttggaatcctcttctctggtcttggtatgactagctctttctttttctacaagtcttaatatatgtcatctctcagagactgtcttcagaatattgtcaaacccagaaattatgtaactgtttgttgactacatccacatcataatgtatgttccataggagcaaacatcagtccatttattgaatgaatatttcaggccattaatatttctcttaacaagcacttattcctgcttgttagcctttcatttactgctgtattggcaacacaactcaagtgcaatatcagttcacaagcaaatgcattcattcatttcaaagtacagaaacctttgaaaaggtcattttttttttgcaggcacattaatagattgttttgtgagtaaacaagggagaatacaccaagtttcaataattatcatataaattggcattacagctgtaaaatcaagcaataaagttatatcatattgagctcactgcctacaatctcccctccaatatctgtaggaattcctcatatatagagcactactaatgaatacttattcaatgagtgaagctataggaagagaaaggaaatttagaagtttagatctcataccttaatttttattcagattaaattaaaacatcatttagagttttaaagatttttgtccactttttgactcagtttatctgtgttatagcatattatttgtttttttctttgtgctaattttctttgatttttaatttaagcaacactatctacttaaccatatttgttaaccatgtatttaaaatacatgcattatacaactcatgtcttccttaaaatcttttgaatattgtgttgtagctttgctaaaatcttggaagttatctggaaaatactaatggagccagcctttctactacaaacgaccataaaattggacaaactacatgaggttacaattttaaggaataaaaacagacagtgcaaggctgcatttcctgtgagagggaaacccatgaagtgagccccatgattattctagctctccatttgggggaatttgctgtatatgagcatagcaaggtagattccaagccgagcatggatttctggctaagtttaagaaacatatattaaaactcaaagcagcaaaagcatctatctgcaggacaaaatactgtatagtaaaaaactctgtagaagaagggtcataggagttagtgtggatccttacctaaggatcagactctacaaggatgaggtgatttaccattttcttctctatgggatttttgtgagtagaaaattgataatagagttctagcaatgcttaaaggaagccagaatttcagctcatcaggtagattatacctccttaaattctaaacatcctgatgagactccaaaaggattaaatcagaggaacaaaaaccatgtcagagtaaagacttattctaggtactccttaacaaagactaacaccaagctctgctaaaatttagagggaggcggaattttaacggtgagtcccaccaagttagaagagtttaggaacatccttggatttccacagatttcatcactttttacattaaacgtaaatggcaaacaaaggttcaaaagggacagcaggtaattgaactgtctactaaactaaaacttggcactctttacagggtgaaagagagcacagtccagttatttatcatatattcttcataatgttcattaaacaataaaaaattacctgacatgaaaagaaaataggaaaatgttacttttggtccagaataatagtagtttattaaaaactaaccttaaggtaggccagatgttggatttagcaaaaagcttcaggtagctattatgaatattttcaaagtattatgggaaaatatgttcaaataattaaagaaaaatgcagattttgtgagcaaatgagtaagaaattttagcatacaaaaaaccctaaaaaacaactagatgcaaattgaacaactaaaactgcacaataattgaaagaaaaattctatgggtgggcttaatagtatattggaaaaggcaagaggactggtaaaattgaaaacaaattgaaagagctgatacaacctgatagatcaaaaaatagagggattgaagaataaagagaagggacctaagaacatggggcacaatataaaatagttgaaaacaggtgcacttgaagttctgaaatagagtgagaatggggcagaaaaaatggctgaaattttccacaaatttacgaagcaaacccacagatccaagcatatcatggtgcacaaggcaagaaaaatacaagaaaaccacacgtaagaataccatagtccaattgtggaaaactaatgataaagagaaaattttcaaagcagccagaaaaaaaaatgatattctgatgatatgtatgacaattactttctcattagaaacaatacagcttagaagaaagtgggacatctttaaatctttaaatatcttttgaaaatactgtcaatttatattttatgtctagtgaaaatatactttaaaaattagagtcaaataaatatatatattctgaaaaaagccagagaattggtagtctgtgaaactgcagtacaaaaatatgctaaacggtgatctttatacttaagggaaaggctatcagtgaagaccaggatctataaaaataaatgaagaggattaggtatagtaaataagtgggtaaagataaaagactaagtttcttttatctttcaatttccctaataaacatctatataaatggggtcaacaaatagcagcctgaggtcagcaaactgttttttgtaaatgaagtttaattggaacacacctttcctgatttgtttatgtattgtctaaagctgctttcatgctacagccacagaggtgagtagttgcaacaatgaccatatggctcaagccaagaatatttactgtctcaccctttacaaataagtctgccaatcaatctccagtttgaagaaaaaataacaacattgtaatttagggttcacagcatatttagagctaaaacatgccaatagcacaagcgatggaattaatttgaattatactgttgtaaatttattacatttgtgatgtgggaagtgagaagtaaatagggacctcagagaatcatgaagtatggaatgtgatatgttaactggtacaatattgactctaagtagaatcagtaagtgaatgttgcatactttaagccatataaaaatccttcaaaagttttttgaatttagtcaaaatacaccaagtaacagatgaaggaaatattgaagagacaaaacaaagagcaagatggtagactttaactcagtcatgttaataattacagtaaatgtaaatgagtttaagattccaattagctgtcagaaatggtagaactggactgagaaaaaaaaatgcactatctacaagatacacactgttttctaccaaaaacgcacttcaaatacaaagacacaaaaagactgaaaggaaatgggggaatacatagcattcaaacagcagacataaaaatgctggcatggctgtactattaccagaaaaagtagacttcaagatagagtaattacgagagttaaagaggaacacaataatactacaacaggaatttatagggaagacataacggttcaaattatgtgaacatctattaatagagccttaaaattcctaaataaaaaatactacaaggagtaacacactattccataattatagttcaagattttaatacccatttattcgtgattgatagaatatggagataaaaaacactaatattttagaagattttaagcatactattaagtaaattaatttacccaacagaaatgaaagcacatgtatacacaaagacttatgcacaaactttaatatcagcttcatttgtaatagcctcaaactagaaacaatccaaatatccatcaacagatgaacaacttgtgatctattcacgaaatggaattttactcagtgttaaaaatggaaagaactactgatacatgcaagtggatggatttcaaaaacaatgtcgagtgaaaagaaccaaatacagaaagtgcatattttatgatttcatttatatgaatttcctgaataggaaaaactaatctttagtaatgaaaagtggatttttgtttgcctgggtcaagggtggaggtgactaattacgaaggggcaggaggtaactttctgcagagatgggaatctatatcttgattatggtggtgattacatagcaatatatatttttccaaacccatcaataatcacatttaaaatttatgaagtttattatatgtaaattatatctgaataaggtactattgtgttgtaaatgaataaaacatctgctagctaaggtaggcttcagaataggaagtgtttcataatgtgaatgacatttgttccatgtaatgttataatgtatgtaatttttctaatgcatattgtagtaacatatgcaaagtaatttagcaaaattaatttttcctcaagaatgatttgttcctttttctcctccactagccttcaaaattattttagttggggaagctaaaatggttattctgcacagtatttcccctctccatatcaatgtttctctcttatatttcttgcattaagagacagcgaatgttacatcaaaaatatagaaagacccaatttgttggtagcaaaagtcatatataaaagttaaatcagaaagatatcagtcaggtttggagtattaccattttgtaagcagagacagtcactgctgtgtaaaataatggaaagacagagatatcagtctcgaacaagctagggtgtagggttgcaaaactgtgtcttacagcttgctcacattacttttgagtctgcattagatctaatttgtaaataataagaaacagtctaaaaattcaaacagtttcctctgagagaaaagaaactttctaatatgtactgacaccagagaagaatagaacaaagaaaactgaatacagaaaagcacatctatgtatattaatatcctatgtttagtactgctattcttaagggcctatttacctcttagcacatttagattttccggtagaaattgaatggtaataaaaccaatctgtgaaggaatcacagaactttttagttcagtggaatcaaagccatctctcaaacctcccggtgtctgtttaagcacctggcctctgtccttcaccctgaaggaatgattaatggatgagaacagtgcagagtgtgttccaagggcatgcctgaaactaagagtggtcaggagagagaatccacagatgatagcccacagcctgatctggcatcttttatcaagagagattttgtgacagggctctaagttgagaaagtcaatagacgttttcttgttacaaattctgtcaaggattcagaccagaggttataaccacagtcttataatttcacattacttaagtgagcattacttaagaaatctccttctcttatcattctaatgactttgtctattttaaaagaatgtatgacaaagacagttactaggagcctcgggatccaactgcaggcagatagatacctgctttgcagtcagatccagtccagtgattccttgcaaggtgataagagcagttatttgtgctctattctttttcttgttctaggattcaaattcaaaacttttagttattcctggagaggcacagtgatgcaggttcaataaccggtttcctttattcacatctaaatctactttattaactcaagttatatgttttgcagaaaataaatgttcctagaagataaacagcataccttctgggcttctctccaactcacttgaacacctcttgctccttgcccaaatgatattcagcacattcatattcagcgatggaccacccacatgtgcagcagcagcacttgccaagaagttaatgtggtctataagtacaccattgaacattcagttctttcagcctgggagtcgctggatcagttcatccatctgttcccctccacgcacacactcaaccaatggtcctttaaatgaatacaaggcttttagatattttggaactattaagttcaacttttttttttttttgagacagtctcgctctgtcacccaggctgtagtgcaatggcatgatcttagctcactgcagcctccaccccccgggttcgagcaattcttccacttcaacctcctgagtagctgggattacaggcgcccgccatcatgcctggccagtttttatgtttttgtagagaccaggtttcaccatgttggccaggctggtcttgaatccctgacctcaggtgatccaccctcctcagactcccaacgtgctgggattacaggcgtgagccaccgcgcctggccggaactattaggttttaaggaaagatatagctttagtcaagactaaatacatttatatgcagcttatagtatatttattattcttgagttaaatatttaacaaagtacttgtagttcttattctagagatttagtcaatccttatctttgtaaattcctgagtcgacaatactttcaaatagtgatatagcaaatatgattgagtcctagggataaacttgtagtttaagtttccatactcacagaggcaaagtggagacccttttgcaataagtcctccatcctatcagaaagtccactagcctatacaataactctgtaaattaggaggagagaaaagctcctttcttgaagtagatgtagttcctataccagggtaagagtcgtagcaagagtaatacagcctggatttcagcctcagtcatgctttcagcaaggcatgcacttggttgtgagcaaccatacccaaaggtattggaaattagtgtaaaatggactttggacagcctgagttcaaaatgtagcttcgtgacttgatggttgcttactatagggaaagtggcttaagatctctaatcttcactttagtctgtgaaaggacaaaatgataaggatattgccatcttgcatgagactgtgaatattaaaaaacatatgtatgcaagttgattagcatggtgcctgacaaatacagcaactaacaacaaaagtgccttaaaacattttgttctgtctgggagagattaaacaccaattcttccttaggcctagaaataattgttttatcaaagattaagcttccaaataatgctttagaaactgctatttttagtattttctatgaacagtgttctgtggtagaacactggaagcaggtttacaaggtcatgaatagaaagatctcagtggaaagcatttcatgagaatcttgttaaaaactttttaagtgacttataataattttacttatttatgggttccaaagcaatgttttgatacatacaatatgtagtgatcaaatcatagtaattagcatatctactatctcaaacatttattatttcattgtgttggaaacattcaatatcccgtctactagctactagaaaatatataatatattgtaaactatagtcatcctacagtgctatagaacactacaatttatccctcctatctgtaattttgtattctctcaaaaatcttgccctattctctccttctcaactacccccccaccaggctctggtaacctctgttctaccctttacatttatgagatcaacctttttagcttccataaatgcatgagatcatgaaatgttcaacttcctgctccttgcttatttcgcttaacataatgccctccaggcttatccatgttgttgcaaatgacagaatttcatacttttttatggccaaatagtatttcattgtgtatatatactacattttatctttcaagtcatcccttaatggatactaaggttgatttcatattctgactattgtgaatagtactacaataaatatgcgagtgtaagtatctctgtactgtactgatttccttccctttggataaatatcagtagagggattgttgaatcctatggtactttcatttgtagttttttgaggaacctccatacttttctctgtagtggctatattaatttacattcccaccaacaatgtttgagttcccctttcttgcaatcttcaccagcatttgtcatattttggctttttcataatagctgttctaattggggtcagatgatgtctcttttttttttttttttttttgagatggattttcgttcttgttgcccaagctggagtacaatggcatgatcttggctcactgcaacctccacctccagggtttaggcgattcttctgcctcagccctcccgagtagctgggattataggctcccgccactacacccagctaatttttttatttttagtagagaaggggttttaccatgttggtcaggctggtcttgaactcctgacctcaggtgatccacccacctaggcctcccaaagtgctgggattacaggcatgagccaccatgcccagccggatgatatcttactgtggttctgatttgcatttccctgatgattagtgatgttgagcattttttcaaatattttttggccatttatatgtcttctttgataaatgtctattcagatcattagcccatttaaaaaattagattgtatatttttgtgctagagatgtttgagatcattgtattttctggatagtaattccctgtaatatgaatagtttgcaaatattttctgccattctgcattgtcttttcagtctcttgattgcttcttttgatgttcacaagctttttggtttaatgtaatcccatttgtttattattgcttttgttgcctgtgtttttgaagtcttattcataaaatcttttctcagcccagtgttctgaagcatttcccctatgttttcttctaatagttttataattccagatcttacatttaagcctttaatctgtttggaattaatttttatatagagtaagagatagatgtctagtttcattgttctgcatatggatatctagttttcctagcatcattattgaacagactgtcctttcccaaaggaatgttcttggcacctttgtcaaaaatcagttggctgtggaaatgtcaattaatttcagggttctgtattctagtccattcgtctatgtgccagcaccatactgttttggttattatagctttgtagtatattttgaaattggtagtataacgccttcagctttgtttcttttgctcaagattgttttggctatttagaatcttttgtggttccatgcaaattttaggattttttttctatttctgtgaagaatgtcattggtactttgattagtaattgacagcaattgcattgaatctatatattgcttttgtgtgtggtcattgtaacagtattcttccagaccattaacatgggatgtctttccacttcttggtgtcttcctcaattttttttaaccagtattttatagttttccttataaagatcttttacttcctttgttaaatttgtttcaggtatttgtgttggggggggtgtcgggggagcggtgtgcctgttgtaaatggcattgtttgctttatttctttttcagactgttcactccaggcatatgtaaatgctactgatttgtgtaagctgatattgtgtcctgcaactttattaaatttatttttcagttctaagagtttttttggtagagtctttaggtttttctgcgtataaaagtatgccatcagcaaacagggacaatttgacctcttttccaatttggatgccttttacttttttctcttgcctaattgctctggctaggacatctagtactgcgttgaataagagtggtaagagtgggcatccttgtcttgttccagttctttgaaaaaaacatgtttagcttttcttcattcagtatgatgttagctgtgggtttgtcctatatagacattattgtgttgaagttccttgtgttatgggccttctatacctaatttattgagagcttttggttttttttttatgaaggaatgttcaattttatcaaatgcttcttctgtgtctattgagatgatcatatggtttttgtcctttatcctgttgatgtgatatttggaagctatccataccacagtatatgacgggaagagaaaagtccttcagtatctgatattacagagatgaacaaaaataaattaaatttctaatatattgtaagtgagatttttcccttgtttggttatatatgctatttcagattttgtatgttggtattttttcacatattattttacttatacaattcaaattcatataacatctccctacatgtaccaatatacatggacctccattcccataaataaagatattttatttaataatgggaggtgaaaaatagcagttcctcatgggagaagagaaggcccagcagaagagcaaagatgatgtaagggaaaggtgtatatctgttctctgattgtccctttgcttctggtttgcccctatcttatgggctggtgtcagaagctgacagaacttttcaagaacgaaattgtagacatgaacaggagctcaagtgattgactggcagggacaaattatgacttttaaccataggcacctttgtctttgtggaccacttccttcattaaaaaataaagtaatacatcaaaatttaaaattatatatgtatgactgtatttatataaataggatctacaatcccaattattattatttatttagtattattatgttcatttttcttccaattttaaaatgaattaaatttaaaacattttcttggacctctgaattatcataggtcctaggtgctgtgactcctgtgcctaatgaataaatcagttctgtcaagtaaaatggaagtgtcgcaacttctcccaactctccatgtcaacccaaacactttctgccataccgatccctgcattccacactcaaggaagtgttggaagcctctggagatagaatacctggtagtggtggtgatggtgaaggtgaagacagtggttagctttgtctagctagctttgtgggcatttatcatggactggtggaagatggagcaagaaaggaagggcaggaaaacctaatgttaagtggctttgtgattacatgtgagaaatctcttggggattcccagaaagaggcaggaaaaggttttggggcttgtaagaatgtgggttctaataaataatcacagttttgggttattttacatattggcttataaatgcttttgtatatcttgtgtatttaggaggagtacagataacatttatgcttcttttatggcccacatgcaaataagcaattgagtttctatatgattgactagatactttagggattgagtcttcagcagggaatcaagtagtatttcttaggtgcgggatatgtagggtgagctggattggtaagagaactaaagtgtgctcacggtgcctataacatgggagatttgtaacaaaggtgcactcactacaaaatgggcgatttgtgctgatctcaggaattgggcataatgtacattaatcattttctgcttccatctcattaaataacatccgtggaatttcttctgcactcctgataatatctgtgctctccatgccaccaattcacatactctacagttgtttcagtaaaacatatggttgtgagatttgaaataagtggcataactctttttttttttaaattctgacactatccacctggagatgaagtggcataactcttgaagcagtagtttggagagtattatgtacaagcaaaagagaatcgcaaaattgacccagagccttaactgtgacaaaagccaaatgcagcatgtcatagctattttgaccttgtgctttcctcacccactgacaaaaaagtagtaatgacaattgacatacaccgtgtattaatgaaatgatttttttaatataaaattaagcaaaagtaggtttgtgttctttctgcgttcttacagcatttgctgtaatatttccataaggagggatttctgattgtttcattttaccctaacattcctaatataatataccttaaggaaggtagacacagaacctctcagtttgaatgccagctttctttgtatgtttaggtgaattatgcaacttctcttccttctgacaaaatatccatttggatctttttgaggtaagatttgcagaccagacaaggacagtagtacgtgtcagttcagtaattatgatagtcttattaacttttaagatttgcagttcaagccaagaaatatgcctctgtgtatttgacctccctcagctctgtgaagactgaactaagttaatatttgtgaaagttctttgtgagctgtaaattcctatataaaactgagataccattttcatttatcaaggtttttcttgctccataagtccatgtttttagttgtaaattataaaagaataatttataaacagcagtgcaggaccataattctggtatgtgtcttaaatacttgctagagtagtggtgaatgaaggccccttggaaatctctataatagacaaacaagaggatagataatttgaagattccaagtataacataaatgaaaatatagtttttatttcccaacattttttgagtcctaggcaatttcctacttgcatgccaagtgtaaaaactatcgtttcagcaaatttaagtaatccttttgaatttttggataagattcttaactaaacttattttgagaaaaaatttgacatgtattactcatatttttcatcatttttttgcaaagtgtatccaggattttagagtcaaggagttattcatttaagttgaaacagtatttatctgttaaatgcaggaatttattttatattgtccaagaaaagtatatatatatatatatatatatatatatatatatatatatatatatatatatttgttacataaaccagtagaactttgtatagttctgtaggacaatgtcaaaaagaagccatgggtgacataattgtgttgaaataatgcctctttaaagtttcaagaaaataaatgcaaactcatttaaaattgtctaattaattttcaaattccctcaaattctgtatatgttaacaataatcaaattaacttatggaaatcttcccaaagaatgttatttgatttgattttcttttgttgttggggtggcaagggaagtgtagtgggagattaacatttattaaacacttatattttgcccaatgttctgataggtatattatatagactaatcagataattttaaaaataataatttgtgtattatgatccttttggatcttcagatatgtctttttattctagcccaattcataaagtacttgtcattttgagaaccaaaaaaaaatttttttaaagacttcttgctagtaatgaaatcaatctattgctattattattttgctgattacctatatttattaattaattttgtgagtaaagtctcttgattttctatgacagaactctactcaaatgacatgaacttttctggaacgtgtcttaaactgggggagaaattttacaatgggaaatatatcaggttagcattcaactgatgtggagtatgtgtggagtgaacatttgatggtttggtaaaacagatatgttttcacctacaagtactgtgggggttttgttagatttatgcctaagcattttatatttttaatgaacataaattatattgtattgttaattttaatgtccatatgtttattgttgatacattcaaatacaattgattttcctttgtttatcttattgcttacaaccttactgaactaacttattagttctagaaatctttttatatatttctcgtgattatctgtgctgataatcgtgtcatttgcaaataaagacagtttaatttcaaaaaaaaaaagacataatgttgtaaggatgaagtaattactaaaccatgttatttctgaaaacccaagtagtttgcccacctatttcagtctgagtgacttgtttcctaataaccaatggcaggattcttggtgaattatacagtcttgggatctgatcatcatttttctagtttctaattcttagcagtaagcctggagggcatcatcgtgggccttattttaattatctttgcctttctagtggttataaaatattaatacaggaagatgattttaggaaaggttataaaactagatttatgttcatcctatatttaaaatattgaagaaaaatgatttttaaatttagatcattttaactcattatacttaaataacttttcaagtatatatttttataaacatacattctgtgaatatctaaacatttaaaaagtatctaaaggaaattagtttatataatgtaatattatattcatgtgaacttacattattgaagcaaattataaaaagactaagttacaagttttcatacaagtctaaagatcttcctttctttttttttaatttaggaaaagaaaattgaagttgccataattttaattactatcgttctttatgctatcgttctttatgctaacacatattaatagctatcgttctttatgctaacacatattaataaaggaaatgaactgtatatcatgagaatcctgctatatggcattttctttaaatgcatctctgaagattgagtactgtaaaaaacataaagcttaattggaatttgtcgaattatgggttatgtacacacacattattccattttgctctatattacttattgttattccatcgatatttttgatattctatggattactccagtcatttttatttacttaaataaaaatttaatgaaaaatttaaaaatgtttttattcatatgactacaattaaattgattacatttctcaattatagtaacaaaagtaggctgggtgcagtggctcatgcctgtaatctcaactctttgggaggccgaggctggtggatcacctgaggtcaggagttcaagaccaacctggccaacatggcgaaaccccgtctctactaaaaatacaaaaattagctgagtgtggtggctcatgcctctagtccccgctactcaggaggctgaggcaggagaatcactggaacccaggaggcagaggttgcagtgagttgagatggcaccactgcaatccagcctgggtgacagagctagactccatctcaaaaaaaaaaaaaaagcaaaaataaactaaaagcaattggaatgaaacacattttttttctaaattataactaaaaattataaaagaaattgtcctccaaagttctactgaaaaacgtggtacatatttgagtgctttattcaggggagatattttccctgataatattaacaaatttaaaaatattctttcaattgacaaaatttaacatatttctgataacaactctgtaagaagtaagtacctgaattactccttctttcctaccagctgcaaaagactatctcaataaaaagattttgagttttttttttttttttttttttgagatgtagtctcactctgtcacccatgctggagtgtagtggcgcgatcttggctcactgtaaccacctcctccctggttcaagcgattctcctacctcagcctgctgggtagctgggattacaggtgcgtgccaccatgccctgctaatttttgtatttttagtagagacgatgtttcaccatgttagtcagactggtcttgaactcttgacctcgtgatccgcccgcctcggcctcccaaagcattaggattacaggcgtgagccactgcgcctggcccagattttgagatttttaaaaagagttttattttaagtacaattgatttcctttcagatcctcaaccgatgggacaatatatgaagaagagatatttgccatctggagcttataatttatttaaaaaacaggaagataaattaagacaattaactattgaaagggtgataaaatataatgtggtcatttcatggaggtattgtatttagtaacagcagtcgctttatcaaaatgaaggtagttataaggatagggattttatgaataatcctaaggaaagaaaagatttgccagagtgattaactctttctcatttcaagtacacgtgataaatagaatcttcttagtcattatttgtcattaaaccggtcttatataagattatttaagcaaggaaaataagcacttattttagctgaagttttcttctaagggtttttaagtttgtgatttttaaaacgtccattaaatgttctaaatattactgtttttatttaccaaagtttgttttttttactgatgttggtatatgaaagaataatgcatagaataccaaaaaggatatgagagtaatttggcttttaaaaaaaatatgctgatgacatcttaaatctcttttaatttgttctagagaaatttaaaaaggattgcttgtactgcatctacaaagtgcaattgggactaagttttaattatctatctgtgggagacaaattctgttaaactttattaaactttgttaaacttattaaacttttgccaacatttgggtattacatgttagaaatattgaacttctcaatcttttcagtttttttttcttctttgggtgttgcatactcatgaaataaatagttttcagttgtaaattaatacttacaattggaatgacatggtcaattccgaaaataataaaaataggagcacaaataacctgtcaactcattgcatgattaggtaacttttgcatttgtcaccctctcaaattatataatcatgggccgggcgcagtggctcatgcttgtaatcccacactttgagaggctgaggaaggtggatcacctgaggtcaggagttccagaccagcctggccaacgtggcaaaaacctgtctctactaaaaatacaaaaattagatggatgtgtaatcccagctaccctggaggctgaagtaggaaaatcacttgaatctggaaggtggatgttgcagtgagccaagatcgcaccattgcactccggcctgggagacagagtgagagtccatctcgaaaaaaaaaaaaaaaaaatgtatatatatatatatatatatatatatatatatatatatatatatacacacacacacacacacacacgtatatatacttgatatatatacatttgccctaccaaataaattctgttgtcaaaaccagatcacataaatcataggcctttcataaccttcaccttgaggaataattagcaaagtttccaagcaagtaattccatagacccagtattcacatttaggaggtaccaaatctatcagatgtaacttcctaatattcattttccctttttaggggtttgatgtaacataaatgttaaatatacatcattcaaattagcacagggaatctaggcttggggtctttcaagttttatactttgctagttagagattctatgtggctaactttcactcttcaccaaagctatggttcatacatatataaatggcatatttgtttaaaataacaattcgtcagacaggtcaagcctaagaaagacactttttagatgtaaacttagcatattctgaactctcagataagaacctagtaacaatacactgcaaactgtaacatcctgaaataatttagaacagagtttagcaatcatgtgaccccagagccaaattcagctggccaactgtgtgtatatggcccatgagctaagaatgatttttacattttaaatagtgtggttgctttgtattgttcagtaccctctactggcttcaactatattatgtctaaatctgggaaaggacctcaacaagaaataaaaatgattttatagaaaacattttccagaattcttacatattgggataaaattatgatatgtttttgtaattaaatgctaagtactatgatgtaaataattatcatagaacaaagagttactaaaggaaggaaggatagtcatgattttggtattaaaagatagataacaattggaaagcagagaggaactgcaggaggaaagtattttagtttatgggatcaaggtgtgtgaagatgaaactggggctttagaaacattcagttattggcatgctgagtcactagaaagtggataggagaagtgaaatcatgtggaaagttcattgattgatttattcaataaatactgagttacaaagcttttgttggtgtgaagtgataagagtgagattcaatgttattagaataaactctaatagttacaaagaagaggcaatctaaaagatgaatctataaatgcaagagaggaatcagaaaaagatgactgggcaagacttccttttataagtgaattcagccataaattccataaagcttgttcccagtttcacttggtatatgttcatcataaaaatgctttagacatattattacaaatttatcagttcataaattcatatattggctgaatgtattgtttttgtgactgaatttttttaaaataatgctaaaattgattttcataaaaaagttttccagattaataataggaagactaacttgatacagaatgttttaaataaaatcatttctgggaaatgagacatttattttttcagcagatttattttgaagaggcataacctacaagagaaatcataatattgtaaccaaagcaattgtaccttatgcccaagcagatttaaaggctttctttaaagatcccagtgatttgtaaagactgacaatgtatcaatagttttattatttaactaatcagtaaacctgctttccagggctataaattcttaggaagctcttgagtgctgaagtgtggtcgcagggtagtctgccttaatgtgatgtgtacagctctgcctcgagcagaagaaaatgaattcaagtaagggatgaatacaccagctatattgcaatttaaaaataatgttgtgataatgactagtcattgaaaaatatatttgctgttactaaatgggaagacatagttttgataaacacttctctgtctcaagtacaaacgcgctttacctaaatgatttagttggattataaattgttacacacatcttgcattcattttaaaaatgaatcttcaactgagagatgttgtcattgacttcactgttgtattaattagttgttatgtttttatttcctgcatacatattgacaagttatcactgttgaacaaactattaatgacattgagttttattgctgctatgacattcatcttaattccaagatatggttttaaaatcaaatacaattgtttaatttcttaagtattgcttgtatgtttaacatttttaaattccctcttcatattaatttagtatctttcaagccaatgaaataggtagaacccatcaaattggtaataattcctgtattacttacttttaatatgataagacctaatattaaataccctacaaataaatgccaaatatagataacagcgatgagtatattgctattttttagaattttcttttgacttgacagaattaaatcttactttcctcaaagtattctttatgctcccaatttcatgacacatacttttatatggctttgaatctaaaacaataagccttcagaaggacagaatctcaagaggtaatgaaatttttgactccttttccaggatgagatactcacagtcattttccctctcagttagagacgctagtgaccattcttctctcaagactgaaaatttaggagtctacgctcaggatccggtcagaagacacatgttgatcagcagtatgcgcaatcacttttgaattcatcagcttttcttattttctcaaatcacatatctttttttttatataggcagtatttttttactagtttcctgcctaaggtttctcactcattcaatccattagcttctttcccagcagttattgttgtaaaacataaaataaatttatatcatttccctgattaaacatttagaaaaatgcctgtttctgtagcaacatttttttctctcttcttttctaattaatttactcaagattcattaatttgaagataatgtaattttggttccaataattgcatgttctgttttgccctatggaggaatgacagagagctgcgtatatttttattgtgtattttacctaacattttaacacataacccactgccttagccagtctatgtatgtgaacactatatgactttgattctcaaatcgtttggctatatgtattagcttctagagctgtgatttctgatttttagaaggcttttttttttttcaaatcagtgcatcattggcgtttaagttcaccttggatttcagtatacatttaaattaggttttaaatgagaagttttaaattaggttttattatttttgatactttgcaagtgtgtcttttgtggaattctttccttaccgccatttaaattatttggttcctatccaattatttgccatcactcagttttcacactaaaaaaatgaaaattagtggattcactataaaatcttttctcccattttcatgaggactggttaaagtcatttcagaataactggactttagagtaaatattcaacatcttatatcactaagatgcttcacaagttagcactgacatatttttcctgtattctgcaagcacatggattacgtcagccatagtggtgagagctgatgataccatccctgttcttgagaagtgcacagtttggtaggaaaggtgggcactgaatgttataacagtaccatatcctacagtagtttctaaagtatctataacatattcatttttctccacctaaggacatgctttatttcttctctttttttatcccttcatgaaccaaccttttctgtctgagagatttgattttttcttctttaagatcagttaaaatgccagacattcctcttgtgaagcctttctttggtcccagtagacagtatcaattattctttcatagaatgttccatggtgttcgtttatatttttctattgtatgacttcagtcttattaagtatacttataaattctatttcctttttttttttttttttttttgaggtagagtcttgctttgtcttccaggctggagtgtagttgggcaatctcggctcactacaacctctgcctcccgtattcaagtgattcccctgcctcagcctcccgaatagctgggattactggtgcctgccaccactcccagttgatttttgtatttttagtagagatggggtttcaacatgtttgccaggctggtcttgaactcctgacctcaagtgatcctcccaccttgacctcccaaagtgctgggattacaggcgtgagcctctgtgcccagcctaaattctattttatttttctattatcttaagtctaatcttactatttatttaccttgttagtctctcacagtggaacgttttcttgtgtatttgtgtattcaaaatgtttgtgaatttataatcattgggatttagaggaattctctgcgctttaagttgacagcatgtctttcaagatcaatttgtcattggctcttttcaagcactccagcagtatcaaaagtcaaaaaaattttatggtaacataaatatttttgtcatcttcctatactggtgagagtcaaatgttttctagcatatcctatgtctgaaactataacttttctagattttagtcataggtggtggcctcattaccaacttctcttcttgcagtagtctattaaccttatctcccatgggcctgaaaatccatctcccaatggtaaaaaagaccaacagcactctatttttctccccaaactcttattaaatggcttgttttcagcagtgttttttgatccctagagacttctttttcttgcttgcaaacatacatctaaaaagaggtttggcataatttcatctagcatttctagatgaaagaaagaaatttgttcttgttttgagtcaattatgccaccaactgtatcagaatttgttgtctgtatgagttttttttttctgagattgtgcaatctgataataaaatgggctcattttatttatctagattttctcagcacctcgtaggaaagcaatatgtattagctatgtattgtctgttttacaaagtgaaaaattgatagatatccctaaatttgcaaacatgtcctataaacctgtgtaattcttttaagtttatattcatacagtctattttccaaaatgtgaattattttcaaaagcaagatatgtgtggtcttgatcagtattatataccttattttgtttttatttcaaaatctgtattgactttactgaaatcagttcctttatccgagcacattttaagtgttcatagtgggaataataattgtttttaatttatgtttgaactttatgcataaaattatattttgcaatctcaatgtaatcatttttcaaaaccattttgcaaaatgaaataccagtatttctatataaatctataaaaattttcaaaaacaaattttttctatatagatattttagggatattttttaaatccaagatttatatataatcatacatgatgattccaaaatttacctcccagttcagttaatgaatatagttctaggttagttaatctgaaaatatttagattggaacaacattgtataagaataaaactagaatgtgaaaagttagattggaacaacatagtataggaataaaactagaatgtgacagagtaagaaaattttcttggtatgcttattggaagaattaaaatgcctgaggcattaaaaatatatatatttatgaattctttccctgttcaaccagtagatgtcatgtttggatgtcaaagcccaagattattataaggatatttctttggttttactgtgtctttcttatgaatgaatatataagcataaagtataattggctctgaaattagaggagaaaattaagtgtgtctcatttcaaaaaatttaagatgcccttttccaataaaatcaggaagcatttttccttttaaagcttttccacagtaggctcagtagaaagtatgctgtgaggcataagtaagcatgcctatatttaatcgtaacaactgaaaattatttctcattagcaattacttattactaatcattactatttatgcaccatctaaaaacgttttttacctttaattccaagtaatatgattattcaactaaaaaaaactttattttctaatctcatgattctaagtaaaaaaagtaacggatcttattgtatttgattatttatttgtataacctttcatatgttatccccatctccattctgcaccttcatttatttatctataatatgagatattgaaataatctctaaagtattttctaatctaatgctccatgaaaaaatattacctgtgatttacccaatacagataaagcatttaaaaaaatacattggaaagtctttgtgagagcatgcaattaaatataaagataacgttttatagtgaaatttgatatatttgcaatattttaatgggttagattggagcttaattttttactaccttgaaaatggatcttggtaaacaaattcatattactcacaagatcatgaggatctgtttttcaacttcagggtaaaactatttcagtaacttcaaaagtgttcatttagataaataatgttcctagaataatggcaatttgtattcatggcatgcagccagttatcctcgtggtagtcaacaaaagtcaactataataagatagctacttcctgaaatgcttcgaatatttcctgttattattctatcctacttcgctccatccgcattatctgatgtctctcagtcttgccccagagagatcctggctgttggatcaggcatgctgctgccagtctcagaggaggaagaagaccaaagagatgtttcttatgactttaggataagtttttacatcttttgttatatagacctggaggtaatttcagagagaaatttcagcctctttaaagcattccaaattgtaaggtctgtatttcgttgcatcagaataacctagggtatttgagaatgtctggattcctggtcaccaccttagagatgaattcatccttatgaatactatatttggaaagaccttattctttttaataaatatggcctttcaagaggaacttttttaatgttatgagataattttgaagtgccagttcctccgtatttaaaccatatttaatctaaaattagttaacatatcaaatccagtttgacaggcaaatgttttatagcagcctacacagttcagtttcgggactgaaagttaatttaaatgaccatcttgtgggcagctacccatctcagtcctgctaaatggctgtttaagtgttgactaaatacctcgaataaagggaaatttatagtctactgaggtaggccattccatattcaaaggtcattggtagaacatttctaagtcaaaatatttaccattttattcggaaatcactggtattcatcttatttcatgtatctgttaacatttattctgattttttctgtgatctatttcaactcctaaaaattctgtttgcccccccgcctttttatccatgctaaaaaaaacccctagttgtccctgtattctcttcttgattctctttgaatgaattgtttattttattaagaatgggctacttagaactgaatcaatcacccttaggtttcttccttgattaaataacagaagcaacccctcagtcctcatagaaaagaaacactagacttttacctccccaattcaatctagataccactctgtaatgaaaacactctaggtttatgttactcatctaagcagctcattacttctttagtaaatttgtaggtattggatgtgtatttttaattaaaacctctagctgtctaactcagctactactaaattcacctcctttatttcattttgaaaaattttgtttcaaatacaaattatcaagaatgttttgcttgttgattccttcactcagtatgttgttttcctctcatttgagacttttcttttttttcttttctttttttttttttgacagggcctggctctgtcccccaggctggagtgcagtggcacaatcttggctcactgcaacctctgcctccctagactcaggtgatcctcccaccacagcaagtaggtcttcctgagtagctgagaccataggtacactccaccacacctggctctttttttttttctttttctggtagagacattattttgctatgttgctcaggttggtgggtctttaacaactaggttcaagagatccgagcacctctgctgcccaaagtgttgggattataggcacgagccctacagctggcctaatctaattaaaagaaagaaaaaaagaaaagatgttaaatgagtgatgataaaaatacagcttttaacttattaagaattgcgaagctacatgaaaagtctggaaaaaaaatgtaattaatttccatgaatgaggaggccatacctgattcattgtgttcttaatacgtaggacaatattttgcattgaataggttctcattaaatattgttgtattattaaataaatatgttatttgtaatagaaaaaattatacttcagaatattgggaaggtggatctataattccaaatggtgtgtaaacttttcattttggcaattaagaaaaactgagatggtttgtatgtggtatatacactatacgtaattcacatttctttaaaaatctaaatataagctaaatattgaccagatcttttattaattaattgttttaagttttattaagttcactttattgatgaaagctgcaggtaatacaaacacaaattttcatttccactaattgttttctacacagtggatcactcacttcccgaaatacctcttttgacctctaggataccacatttttagttttccccaaatttaggttgttccctctcaggcatcggtgtggtttttatctcctcccataactcttaaccttggattgccccagtgtcagactttcaccttctctatctactcacacttccttggtaatatccgtctcttggctttaaatttaaattctatctgcatgcctatggttagcaagattatatctccagtcttgatctctcttgtattccagactagttatatcctactgcatacttggtgtatccatttagatcactcaaattatttaaaaatgactttgatcttctttctccagatttcatcctcccatggatttccattttggttgatgaaaatcccattcctccaatcacttaggccaaatgctttgtgttcttccttcttttctcacactgcccatccaatcaaccaggaaatctcacatctgttctcaaaacatatccagaaaattgattggattttataattactaatgaaaaatatagtagaaatggtaaaagggccaaagggaataagtatgcttacactacaatatgtcatcattcaaatttaagcacactttctgttttcaggaaaggcctatgctccagaattctattatgatacctacaatccagtatggcagaacagacaccgtgtttattcttacagtctacagtggacacagatgaatcctgatgcagtggatcggattgttgcataccggttgggcatcaggcaggtgagaaatctaactgatgtccttttttctttgtggtcctctgtgaagaccttgttgttatcatttttctaagagttttgcatgaattccaaaatatattttatgtatatgtgtttctgtatatagatagacagatagatatgttttcaccctatgtatattactccacataaactgttccgacttacttgaaaaatctttgaaattacatatttttcactatgacagcagacatactaaagtgacagcctttgagccttctaaaatccttcatcactagataagagagataaattacatggtataacttcataaaaggaacttatttcagatgtgctcacactcacctatactgcataatcatttgtcttgattcctaagaagccagaagttgtacatatttttgctttaggggttcaagacatatacagaatgttgcataagctaatttaatatgtctgagaaatagaaatacttttgtaaaatgaaaagaaattaaagtatgatagtttcttaagggagctgaagatcaagggttatgtggaaaaaactgtatctttttcaaagggttaaaatgttaaattcacgtatcctttgtttaaatgatatttttgaaatttaagtggaggtctttacattgtttcttcttagcatattatctggatgaatttcagcataacaaaacatttttgaagatttatttgatcaccacataatcttttagctctctcccaaaaccttgtattatccctagattggcaaagtgcatgttccacttccttaactgtatcacagaaaaatcttttgaattgggatggtagagagaataaaattttcatcgagtaagactgatcaacctccaacgattcattcagctattctatcataaaaccattgtgttttacaataaaatacttgtgtgacacattactcacattaagatacactgtggccgggcgcggtggctcacgcctgtaatcccagcactttaggaggccgaggcgggcgaatcacgaggtcaggagattgagaccatcctggctaacacggtgaaaccccgtctctactaaaaatacaaaaaaattagccgggcatgttgacgggcgcctgtagtcccagctactcgggaggctgaggcaggagaatggcgtgaacctgggaggcggagtttgcagcgagccgaggtcgcgccactgcactccagctctgggcaacagaaaaagactccgattccaaaaaaaaaaaaaaaaagatacactgtatgtagcatattcttattcaccctgtttaagattctcaaaaaagtgaaagagcttttcctagtgaaaacatcctggcctttgataattactggattcttctctaagtgcacacaggctaccgatacagcagaccatagtggatcattcacagtgtttctctggttatccctcattgaaaaaggactgtaggtaaatctgagcaaaaccgaaatctatattaacatcgttctacccattctaatttgctaattttcttaaacagagaagatagaaacaatagcagcaacaaaacaaattagcagttctttctccctcagtttgtgggcttatttcttttttccttaacacagctaatattttataacctttcatatttggagtatctataaggattcttgactttacacacctcatactctttttaaaactccttactacattgtttaatcattcatattcatttttttgttatacatgctttgtaaaaatgtaagaatctatgactaaattttcatttgtaaaatcaattgttttctttaggtaattattgtgctattttctggttataggtctatttgcaaagatagagtcataattgtatctttagtttcttactttcttcctcagttacgttttcttggagtctctgggtaacttcccattactagctgtgtgttttaagttcatagaatttacccaacccttctcatcatcttcttcctttacttttatgcacctcaaatactttgtttctacttagtatctgtgttgtggatgcaaatcaaaatccttacctataagcgaaatttaaatgagttagaattcctcccaagagagatcccgtcatttaagccttctctttctcatccatatcttgtactcattagcagactatcctctgtaatattttttgctgggaaatgctacaccattttccagtgacaaagtcttcttttattttcctttcctgacatgaacatctccaaattcaattttttatattttttatcataaaactggtgtataactccctgatacgcagtgacacacatttctcagtcattgtattgttccttttgaaaaattagtgaattttctcctactcttcctctttagaataaattatatatgattccatatgtatgtataaatttcccttttctatgtttttttaaaataatgaattccagacacacttggcttccaattctagccaatacggcctcatatttttatagctacataaccttgagcatgtttctgagcatatctaagcctgggtttttaatcctgtaaattgaagattatacctgtcaggcaattggaatatgaagtggattatgtcccccacttgttccacaggccaggtactcttgtgcagggcactccttgcacaaacagttatggcaattcttatactcatctgtcagtgttgtatacagattttttaaaagagtacatttcatgagctgagcatgtgtagtatttttattatttgagttttattctaagcctaagcattatttcaagtcatggttttcacaaaataatttctagacctttttttattatgtctcattttcatttcaaacctattgtcttctgtaagatctatgttattgattcacatttttctcttccacttcgagtttcatttcaagccttcttgattggatcagtaagtctgatactaatactgttctttccaggttttgtaagatgcatgctattcactagaggaaaaaaaaaacatatttctagtgtaataaaccatggtgcagaaaacaaatatttcccttactcaatttttgaagctaactctttacctgccactgtatacattcttttctgtactcctttgttcttaggattttcttttatatttagaaataagcgtttttttctagggtgctttttatgatgccgtattctaattggtaattttactctttccatgggagagaaaactttgatgtatctttcagggatgtctcaataaagagtaatgactttgtgctgttctgccaatgtgaataagatggtgctgtttgtagatggggtgtaagaagagaaggagcacgtagacacacgcctctttttttcaaaactataacctctgcactgaactcttgcataaaacatctctacatgcaaaatggccccagcaagcaacattgcctttgaagattcacttacaaacaaaagtttaggatggtagggcaaaagtattctagatacaataaaatcgatgtagttcttttttaaaaaattcctttttaataacaggaaacaaaggcattaatggaaataggtgctttttttttttacattctaaaggaatttattgcaaacattacctttttggagatggggagactgaggatcaagatctcgaagccagttagtagctgagccaaggctcgaactcaggtctctgtacgtttctcatggaccccagctcctccgcccctcttcatcctatggaggatgctgggactaatgggattttgaacaagtcttgggagtaggaagtgatgagcttttttaatgagaacaggcaaagttttatctatgtggcggatgttaccagacagggcagtgttaaccctggctgcccactggaatcacctggggagtgttacatgtgggctaatgtctgggtcccaccacagaccagttgaaactacttctttgttctcctcgaagtgtgacctgtctcaccagctctgtcatctttaggaatgacattataagccaggttttctggaagtgaggtttgtagacaacctccatcaggatgcccagagatgcccagagatacccagagaagcagataccaagatcctgtgagctcctccttaatacaagctcctgggttcagaagcctggccgctgtgtttatagcaagtgtcccaagtaattctgatgcacagccagtgtattggatgtggtttatttttcttctagtccacatgtcccccgcagttccttaatgatgcctcctgccgctttgcttccttaccttccccttctgcagaccttgagtggaagcaggcgtgaccctgccttgggagggactgctgaacttcaaggttttcaattgattttgatgcttttctccttcctcagaaaggaaagagatttagaatatgggctttcttcatattagatttaagataagaaatgataattacaacactaaaactaacctttaaaaaaatctgttgatttgtttggtaaatgagtgataggattttatctttctccattagattagcccctctgttcttattgatacactatatttatacatgtttatggggtacatgtgaaattttcttacatgcataggatgtgtaattatgaggtcagggtatttagggtatccatcacctcgagtatttgtcatttctgtgtgttgggaagatttctagcatttttatattttctcagaaaatttaaatttctcctttaccaggcattgacatttaaatatcaatattatcttaggacacaatcagatactaacttttaaaaatcacctttggataaagaaatcactcttgaattctgaactgtttattattttaatgaagattttatattacatgcatgtagcctttttcatctgccaaactatttcagaatcctaaatcaatgagcttttgaacatagtaaacataacttggatggtttaaatacactgagttaggcatgtggcctaagcaatatacatttttaaatacatggatttatgtcctaataactatggttcacatattttactagaaggccaaattttattcaaaggattattaatttatgttacatattttgtgatttttaaagtcttattattttaggcaatatttctatttttagcctatacatgtacatgatttcttctatccataaaatacctaggttatctagtacaaaaatctcacctcttaatatcaaacattgccttgattacataatgcatttgtgtatgagatgaagtctgaaaacaaattcgattctttaagactaatagcagattcacttcctaagaccttaccttatttttaatccagaaacctttagaaatcttattaatcattcttaaattaaataggattataaaaaccattgctgtgttattaaactcatagatgtagggggttgataaattgaacccagcattcccttttggttaaactgtatggtctgtacttaaatttgattaggaaagttgtctcagatttcagtattgacttacacaattttcttgtaaaataatgcattatatctagaaaaaaagcactgaaattctggaatcactgctttaagaaacttaaaaagagaactaatatataatgagaagctaaaaaattaatttgtggaaaaaagttttctcagaatctttatgtcctaacaaagttgtactttttaggctcagctaagcaattgtttaatctccttagacagctattaacctccaattatttgcttcatttgttgcttaacaggaaagagaaaaagattatttgaatatctactttccttggtatctaaggaattaaaaaacaggaaaaatgtttctaagttatctaaatataccaagcaacgtaaacatcattttacttcatttgaaatgtacacaattacagttttaaataatacacaattttatacagtttccttttttatattcagccatagaaatacacaatgatgtgactttttgactgtatctttggaaagtaggatattttattttaaaaaaatccataattgaccaattccttttttaagtcatgttgtattaaaatatttagaattatcatacttatttgctctcccattcagtcaataaaatttgattaaattagttatatggtaatttccaggaatttaaaaacgaagtattgtcctcaacgtcttataaaagtaagtggtttaatagaaataaacaaagagtatcatagaaatcgatgggggcagttagtactgccaggtagtggggcaagagacacgatcactgaggtgcaaacttcatttgtttgttaattttataggtttattcctaaactttcttaaacggtgaccacgagtaatcactaattactaataaaaagtaataagcaaaaaagatatgtttgatacaattgattgttggataactttattacaaatttaattttggtcttcagtagatgtgactataatggttgagctattgcttatttctccttccagttaaaacatttttaaaagttattttagtgaataatttttgcttattgttgcttgttttgtgcttgacttagcccatttagatagattttattgcaagaactgtttggaggaaccatttcatgcctgtccaggaaaatctgtggagatttgataatctggattctttgtataatcttaaatcatgaataaaatgacatcttgcatagattaatcttataataccatactgagtatactgaatgttattataatagagacaggtacaacagttaggcacatatttggggcatgtactgatgatttagattagaatagtgaaaggggagaagaagaaaaatggaattaagaaaacgttaaaataggcagaacttgaattttgactttgttttggggaacaattttgaaaaagatagtgaccttatttctctgtcattcacttcaatttctttagtgaatgctctggaaagcattaaacatatagagatgagagagaatgaaggactcagagaaatgtagagaaaccattttgtaaatggtctctctggctctggaaaagaaataagccatatgtcagttgtaaaaagtgaagtttatcttcatcttccaaatgaaggacattgcatatatctgcttcattcctacaaactaattttacaatgtgtttatgagaagggatatataaatggtaaatttgagagacctgggtcagggatggacccttgactgatgtagaaggttctgtaaaataagggtaccttgtcttggaaaactccaaatacttcttgaggattttctctgagtctggtgcctttgtatagatttaattctgtttagaaatatggtttgagaaaattaattagaaacgtggaggaaacaagcaacctcaaagacacttaaaagagtgaaagagggttaagttattgacataaataagatttttaatcaatgtttacaagtattcccatattttcacatgtggacttgttaggctggagtgataggggagcataaaaccgttatccagattagaaacatgctactagaatttgggtgaacactttttcttcaatatgttaatttacaagtcaaaagcattagatatgaaactgaaggtggtaaaaatttaggcataaatttttcatctgaagacagtagtaatagaatttccagcaaaaacgaactgcagggtagaaaaatcttgtatttgtatggaaactaagaagacagtgtgtgaatgtgcattcgtgtgtatgtttgtacttacaaacaaaattttaaaatatgaaaatgcaaatttgcttatgagcaaagtacagcaggtccttgaataatgtcatttgtttaaggtcatatggttataacgttgatgagaaaaaaattcagttcctggctgggaccactatctgtatggagattgcatattctccctcgtctgtggatttctctggtttcctttcacatcccaaacatgagcccatgaggtgaattggcatgtctaaatgaatcactcccagtctgagtgagagtgggtgtgtgtctgagtgtgccctgcaatgggatggagccctgttcagtgttggttcctgtcttgcaccctggctgctggaataagccctgccccaccccatgaccctcaactggaattattgggtaataattatcttccttgtttgtattaatatttcttaaatgtacgtatagctcacatttattttatgtttaatattataagtgtttggggctttatttagaagtttcgtgatgtttttattaccagaaatatgccatgggatctttactcttgtttagatataaattaacttgaggtaaaattgatttccttatatgtcatttcacttaaacttgcagttgattttgaatcaatcatcattctcaattgcttcttataattttaatgataaatgactattagtttagctttatcattttcagttgtagttaaagtttcttaaattatcttgaaatgtggagtcatccacatctttacatgacttttataccaaaaacctgactgcttttcaacatttaaaagatttaactaaaatagctgaaacaatatttatctttgaataataaatgtttgacatgacagatgtcaataaaactacgtaactactgctgtacaactactcagtaatggactatgttttcccagcttctgttttctgttttaaaatgttcaagaaagaaatgcaaaatatcattgatgtttaaattgctttatcagacttcaagttttggaaaccatttgtaaaaagatggaagcaataatttgagtagaaatttgaaggtgatagtttagatatcataggcattacttatcttttttatttaacttttattttaagtttaggtgtccatgcacaagtttgttatatgggtaaacttgtttcatgggggtttgttgtgaagattatttcatcacccaggtattaatcctagtacccactagttatttttcctgattttcttcctccgcccaacctccaccccttcaataggccccagtgtgtgttgttgccctctatttgtccacgtgttcacatcatttagctaccagttataactgagaacatgctgtatttggttttctattcctgcatttatttgctgaggacaatagcctccagctccatccgtgtccccgcaaaggatataattgcattcgtttttatggctgcgtagcattccttggtgcatatgtaccacgttttgtttatccagtctaccattggtgagcactgatggctgagactatgggtttgctagatacaggatcatgtcattaagtctgacagtttgacttccttcctacctatttgaatgtcctttatttctttttcttgcctgattgctctggccagaactcccattgttatgttgaattaagagtggtgagagggcatccttgccttgtgctggtttcgaggggaatgcatccagcttttgcccattcagtgtgatgttggctgtggttttgtcatagatggctcttattattttgaggcatgaaggaccataggaacagttccaaagaagttaaactttaccttgaaaagtggggagacactaaaagagtcaaaagagaaaaatcaaacagtcattaatgcagtactaaattaataggggacaagcacaaagtaaaagctgttcttttttttcaaatgaaatagcatgacctgaatctgatgctgcattggaaatttgagagaaatatatgtggcaaaatctggaggatttgatgattgaatggaggctaggggaagggagagagcaaaaaggcagggatgaaaacagtgttcactatttacatgcttattgtctttagataaccttatgtcaattcatataaatatttgtctcatttctatatattaagaacatacccttgaacatgattatttatattaaaaatgaaatttatattaaaaatgaaaattaactcttattgagatggatgttaggcacaggtttaatggaatattttcaaggaaatgtaaaattgtaacatttataaacaaaataggaaagcttcaagttaaaatataaaaatatctgcaatgtactaatatatccatgaggttcttttgttttgtgttctacagatcttaagctaaaacttttcctttagagttccatatcttagcaaaatgacacaatacaaaattcataggtagttttcctatattgaataagcagtttctctgcttagagaagctgattttgaagatatatgtgtttatgctataatataaggtactgcaatgataggtcataatttttataaaggaagaatttttaaaaatagtttcaatttagatgtatttttgtcctttacaatatctcctctataattttttgattatccttgcctcatattagaaggtatcttagtatcccattaatgttagtgaactcagttaagtgcttctatgtgttgatataaaattatctttggcatgtcaactgtattttggagggagcatgttgatgcaggtaccaggccttaatttctccttttgaaagggacatacggtgcttctgctcacactttcttcacccaagcagccccttgacttgatctgaggaaaacatgggaaaaaaaatgttcttccttgaacttgtaagaaataaaagaaccaaatacttatgaagatctcaaattactactaagttctgcctttctgaacagcaatatttgattgaatatattaatagtgcatttgattttctaaaaatataacctcaaaaagatctactttttatttgtagaatactaaaggaataagaataaagatttgattcatcttttgcaattaaatgtattatgttctattatgtgtacatgagataggaagtgcaccagacagaaaatatccatgatctcatgaagcgtatagtttggtagagtaggaagcagacaaaaaattaacggttagaaagcaattaatgctatgcaacaaataaaacagacatagagggaaagctggcatcgttaaaattcattctgtatgccaaatgattgaaaatttgggaaggtagcagaagctgatctttacatttcccacatgttcattattttgggacaattttcaaaccatcttgatggaaagtggacttatacttcaatctggggaaagaaggaatctaatttcaaataatcaagcacactaattgaaatgaagcaataatttctctcatgttcatttgacattttacttattcttaaaaactatatgaggtaaggtaaattacctaaagatttagtggctacatttataaccctaaattatgttcaggagtaagaaattagaaatcttcagatctggaatacagtttaaatctatatattttgaggatgtattatgtctggtggatatgtaaaaacctatggacagtttataagacagatcacttgcacagcaaactcttgacgaataagaacttatgagaatccaggaggcattgtcgtggaggcaattagtcctgctttgaaagtggttaagactcctaaatgtttcaatcaatactacattttcatgcttacttaaataattattttaaattttctatctcaataatcacaattttaaaataggatagaataatcctaaatagctccaaagaattgatcagggttagagtgccacaaaagctaagagagaggtggcagaagataaaatttggtccagttagcatataaagtactaggaaataaagagctagagctttagctatttccatcccctttcagtcagcctactctaggcactgcaaatagcttttgttttacatttttagcttctgaaattttgaaagaggtttataccactccaaattgttagttcatattttgtaataagcaccagaaattgtgattttaaggatcattttggttttatttctgatatgatagtggtgtgatgatatgtgtgagggttattgtctcttcgtggggacttatatcaatgtaacacaatggtgcctgcaactctttttgttgcctttaaattggtacataatatgctaattcctaggacaaagatgtgcctctcattctgagctaaggagaagacagaaagtaccttaactacgtactcaggaaaaattcctactttgtgaaactttcctttttatttaggaagaaatactaatactgtatacaaataaacagttactgttgtatcaggtactagtaatatttttgaggggtagaatacaatcagataatggaaaaagagtagcattgcttttgtataagatattgtggtcaaggaatgcctctctaaggagatggcatttgagtagagacatgaatgatatgaaaaatggtgtcacaaagtaattcagctaagaaatgagagcaacacataagtatgcaataggaaaataaaagcctaagcaaattatacatatggaaatcaaatacatatgtataatatctatttctgtaggcactgtttcatcaaaagtctcttggacaaaatttacagtggtatattatgagaacaatagaggtctaaattcaaaaatgtcatgtgaatctaatcattagaataatatagaggtcaacaggagagaattggcattttgcaaattagatcagcaggtattctcaaattgttagaatgagaggactgatagaacacttgttagtggaagatgaaaatgcaaaatccacaactgatttgctagaaagcaagacaagcagtccaggtgcagtggctcacgcctgtaaccccagcactttgggaggccaaggcaggaggatcacccgaggtcaggagttcaacaccagccttgccaacatggtgaaaccccagtctctactaaaaatacaaaaattagccaggcatggtggcatgagcctgtaatcccagctacttgggaggctgaggcaggagaattgcttgaacctgggaggtggaggttgcagtgagctgagttcgtgccactgcactccactctgggcgtcagagcaagactcgtctcaaaaaaaaaaaaaaaaaaaaaaagaaaaaggtaagcaaagaatgcagtgttgtaattgagattgcttaatggcagtcaattggtaattaatctatgtattggcacatttttaatgtgccattaaatttaaataatggcacattttgtccgggtgggcaaaatgatttccttctgatccagaaagatacatctctctactgagtaattgactctattatggttatacatcattttaataaatactagtctagactgtgggaatattacagtgattcaaacaaagaaaattatctcccttcctagagttgtattataaaggatacattaacctattgttagacagttataaagtgtaaagttctagctaacagatggcaagtaaatatatactctaatttatatcagtgatagaatagtgaaatcttaccaaattttaaacagaacttgtgcataatcatcttttttaattaatggttttactagaaagtgccatgataggttttattttataaaacaaggcaatgacaaggctcagtgtttctatcaatatccaggtttattcagcatgtcctaggcacctatttacttccaaaaagaaagttcagtaattctggtcccaactattacttcctattttaagtattttaggactatgaatttagtagcacacagtaaactctcagtaaaattattattattattattattattttaaggactcatctcattttaagaaaagtaagcttaagcactcattttgggggtatacattgtacagataaatttatgaaatcatttcaaaagcaagaaaaatgtcattcctttctgaagtacatctccctctccccctgcttattctacagtacagtatctagcacagagtggcttaatatgcaatatcaatactaactgtataatattaatactaattatatgctattagtaaattattgatgactcttttatataatgacaacatgccattgtaagttttgaaaattttatgagtttaacattaatataacaaaatatttttatttaaattttcaacaattttatctatgcagctatgcatattttcagtgcccactatatacctgttgaccctcagggatttatgtttaatttggttacttttactacttccagaaaagattaactatggctgctcaccaaagagatttgtgtttttttgttttgttttgtttcagttatctaattttcaaagatttcaatgaacatgcttttttctttttgtcatcatgaattgaactttatgcttatgaatatttcatttttttctgtcacgtagatcatcagtcatattgatgctcaaagcatctagcaatatagtaactcttttacaatatttttgtaacatattggatacccagataataacttgataaattttaagatttaagaaacattacatagtctttttcaatctgtttgcatttgcatgcatttcaatatgtgcattgtttactgtgcatatgcataataccacaaattggtatcaacaattatgtatgagatagtttgcacgcaatctcaaaacgacttaaataaaactgtaaaatggaatttggaagcataatgaatacacttgccaagtgaaaaaaaaatagaaagaaattgttttatttgtgctcctgcagtggttagtacttattttgtcacaggtttcaagaagtcccaactgcttaaaaatagccttttctaaccttaaaatttcaccattgcaaatttcattgaatatctgaaatactttctgtccacacctcttcttgtataaaatgagttttccaggactcactttaaggacttaacttatctcatgggaacttaataatgatattgtgagaatgaaatatgaaataaaagataatcatctaggtacagagtcttgtgcaacattaaaaatgtgcctggttgtctggtttgaatagggctgtccctgcatgttccattatttctgttttaatagaatgtgacttccatatcctttctcatagttacagagattcccatttatttccattggttccacatagactaccctgataatacaacttcagaaactggaggtagccttctaatagtacaaatgtgaattttctaagaaacaaggatgttgaaagcctgaagttggatatatcaatagagaaatcacctgagtttggggtttctagtcgagtttcatcttaggagtttaaggattaagaactatgtaagttttcattatttatggacttctacttctttaaatgtaaacatgtagctatgaacacgggaacacattagcttgtgtagtacagacataaaaatgtttgataaaaataaatggctttggtatgaattttctcaaatattcttagtacatttgaacaatcatgagtaataagcaacgctttttaggttgctcacggctggattgtattaggcacataaaagtacttagccttatcaaagctctggatagctacatattcttttgtagattcgacccaattttgactgaattttcctaattagcacttctgctattaatgccagtatcaataataatggccatacgaattataatttcttaatcaaatatttaaaataaaattggctttttttttttttttttgagacagagtctccctctctctcacaggtatgatctcggctcactgcaacctctgcctttcgggtttctgcaattctcttgcctcagcctccggagtagctgggattacaggcatatgccaccaggcccagctaatttttaatttttaatatttttagtagagatgggttttcaccatgttggccaggctggtcttgaactcctgacctcaagtgatccaccagcctcggcctcccaaagtgctgggattacaggcatgagccaccatgcctggcccaaaattggccatttttatatgtcttcctttcagtaacaaatggatacactgaaaacacccttgtttataaagcaattgtaattgactcaacattgacaattaaaaatcatcttcctttataaatgacaattttataatgtgaactggatttgacaattcaaatttgatgaacatacagaaagcatgaatacattgttatatattaaggtattcaattttatttcaacttgaaaaaactgttgcttggaaaccaggcaatcataataaatcacacagtcatttttagtaaatgggcaaaggcacaaaccgagataaagtaggctttttgccatagagtaaaacaggcattccagtattccacatattacaaataatgtaaccagcacatatattagactaatattaacttcaactggaatttttggagaaaaattaaattatattgatgatctataataaatagaggtataataattaattatagagcaatggctctatagtaaagatgaagaggggaaatgctttcatctattggaaatagaatgacattctctgaagtcaagtataggattagacattttggttaagattctaacataagtcttctaaatcattcaaataaaatttactgttttgaggtaataaaaagtcaaggtatataagtaactgtcattcttacattctgacctataaaggttacactagactaattctgccctaacaataaaattaaaagaatgtgcttcttgacatgaaacaaccccatacccctttctgttaaaatatattctaaaagggagattagtgttgcagaatttctgttccttagttcagctaaatctgggttcttgtgtcacaaccaggaaaagttaggcatgtggacacattgaaaggtgacaggaacggaatttattggacgaaaagaaaaaaacaaaacaacaacaacaaaaactcttagcaaaatgagaaggattcctgccagcgctcccacctcacagattgaataacaggccacagcacaggaactgaagaggcgcagctcctccctgctgcaaatggctcaaacttcccgtggctccaacccattcttgcagtgtgtaggccggtgggagattctctggggccctccccctttttgcctcctgcatctatcattaggttatgaaataaagaaaagaaacactgattaatctgtatatttaactaggtctgtgtattcctagtgccttagaaattatagcaaatgaagcattgtcacattaagtagtgtaaatcttgagaaaatgcttatattctctaccataaaattctagatagcattaccttgaacatacagcagattcttagacattattacttgagagtgtgaaaatatcatggccatatatgaagcaataaaagtagacaaatcgtgggaaggaactcactgtagtccttgtattatatacattctgcatcaatacaatgctatgcttaccttatttcagttgcttaaaaaacaaaacaaaaccttagttgtagaaaatttctcttagcatagaaaagaaagcaaatattttggaaggaaataagattttttccttcaaagagtgtaatttctatgtattcaaatatatgctggaaatgtataaaaccatatttgggaaaagaaaaaaaagtacctactgtatataattcttccctgtagtgagggagggagggaacaggtttgagaaaagatagaatgtgggttccatatatctgcaaagttttatttattttgaaaagagttctgaagcaaatatacagttccactgattaccacttacgttaacattgggaagtaaacaaaaatagtaataacaattcaaatgcaaacactttcaaaattgaggtcatggtggtactgttgaaaaaaatcaactaaactaaaaatagatgtatttatataaagacattacacttattctacagtggcatatggtttgcataaaactccttcttgtaaaacaaggggaaaatgagggcaaataataagtcatggttttatatccctaaaagggagggaacaagaaagaggggttcatcggtgacaactgcacttaaacctagtggcatctggatataccttatgaagtaattgcttaaaagtcatcctcattcccaagcaatattcctcatgatgatgaataattaagatctccacacaagccacagttttcctttttgagtttactttcagacttggacatagctctcagttaagactgccatgccaatgtggttcagagaatgctcagttttggtcacaggctcagctcaccatccttaaaccctagcagggagcctcagttgttaaaggaaaggaaaaggtttgaacaaagctttccagagtggttgagaaatgtggagagcattacaggttaattaaattgcttttacaattgcataaaagcatggaataagatatttttctcattttattttctgcattatcctcaatgtctggtactgtttggcacatagtggttgtacagtaaatatttgctgaataaatgaataaaatgcatgtgggatactttagctgaataggtttgattttcctctcctttaatagtttgaaaatattgttccactgacttttgtatgcacagatgctatcaagaagcatgccagtccgattttccatcctttgtgcttgaatactcatgcttattagattttccaatattttatatttctttgatactctttttaattttattattattatactttaagttttagggtacatgtgcacaacgtgcaggtttgttacatatgtatacatgtgccgtgttggtgtgctgcacccattaactcgtcaattggcattaggtatatctcctaaagctatccctcccccctccccccaccccacaacagtccccggtgtgtgatgttccccttccattcttaaaatttactataacaagtttgtgtgtaagtattcatgtgtgtcatttgtgtatctttttctcacccttacatatccccttcagtactttaaaagccttttcaataagcagtgttttttttctttttaaaatcatttattctgaaataattacagattcacaggaagttacatagaaatgtacaggaaagttccatgaaaccttctcccattatgcccacttcaagccagaatcctacacaaacacaagtacattatgaaaaccaagaaactgacattggtacaatccatgaagtttaatcagagttcacccattgtacatgcatgcactcatttgtttgtgtatctgtgtttgcatgtgcgtagctttgtgtaaccataatgcaaacaagatactcaactgtatcatcaccgtagactccctgatgttactcttttatatcccttatccctggaaaccactaatttcctcctcatccctataattatattatttcacagttgttacagaaatggaattatgcaatacctatttgtttgaaattaacttttctatttagtgtaatttctttgagatttatccaacttgttgcatatatcagtagttcattcttttcatggttgagtagtattctaatggtatgggtgtcctacagtttgtttaataattctttctttaaaatacatttgggttgttcaagtttttagctattagcagtaaaggtactataagcattcatgtacaagttcctgtgtgaaaataaatacttgtttctctgggataaatgcccagcagtgcagttgctgagtggtgtagtaagtccatctttagttttaaaagaaactgccaaactattttatgaagtggttttattcttttcattcccactagaaatatatgagtgagccactttctgtatatgtttatcaggatttgtcgttttcactattttcatctcagccatcctgataggtgtgtagtcatatctatttagttttaatttgtatttctctaatgcccgatgatatttcagatgtttattttccatctgtatatcttcttcagagaaatgtctgtgcatgtcttttgcccacttttaaaaaatatgaggtaatatcctagaaaattgtaccattgtattttcaagtagtgactactttgtttatttttttcttttctaagtatatatggatattgacacatttctttcctacatatttctttacttcttttgtaatttttaaactatactgatactctactgatgccttctgagagcattgtttgacataatctggttcaaaacctcttacgttagatctattttgcaattcagcctatctgttgggttctttattgcaattagtattgcagtatccagtatttctcaaaggttttaaagctatattttgccaactagcaacttacaaaatcacttctgtttccttgaggatagttttgttgatttaaaatttttgtcttacatttcggttaaaaatttaacattaattgcatcctcagctggtctaggttttttttttctatcattatttatcatggttgagcttttctgtgagccccatattcttggtgagtgcatattcttttggtgagcacatattcttttgcccatgttaattgtcttgggcagtaatatatttctgtgagataagctaaagctcaaatcgtaacttctttctaaccacctgagttcaagaatcaaatagaaagtgaatggtacaaatgattcatctcagagtatagcctttggcattgcagactggatttgactcctctccatgtattatcataactctcagggaaatttattgtaattctgctttgaaaagactccttcacatgtaatcattttgggaaaaaaagggtggggaggagagaaaacactcaggttgccagtttgcctacaaattttatctactcctgacctattacctggtataattaatttttgttttctcagaggaaaaatcttcagtaatgactgacttataaaaatgatgtggtgtgggagagaaaaagtaaaatatcatatgccaacctatttcctgtttgtgacataatcccctttccattagcggctgcgattttccccttaggttcaggaatctccctctaattttatagtgtctccaaggttgagtttggggaggggcagagattctgttagtttttcttgtgttttctttttaattaataactgcagtgtggacaattaaatactttctttgcttatcctaagctaatatttttatactgtttcattatttttgttgatgccatctatatgattaaaaagattgacaccctttgttcttagtcagttgtctgaccttaatgaaatatttcattttcctgccaaacctcatgtcctatccagtcttgtagtcttgttctgaagtaaataaatctcttattttcctaactccctttctttggttgtgttctttaaaggagccaacacacaatatgtgattgccataatacttcaaattatttgtcaagtaccaaagaacatgttgatgaatgaagttgtcagagttttaatgttacctccctagacctatttatttgaaaaacctgtacttggatatctcagtggcctcccaaacttaatgcttctatattctaacctattctatctcaaacattgtcctcctcttgtgatccccattagactgaatggccattatctgtcccattgctcaagccagcaagaaatgtaccttgacgcctttctctgttttattctctatatccaattaatcaataatttctaccaattttatttttcaatattcttcaaatcattcaacccttattcatatctaccaccatcactaacttcaatttcttaccagagaaattaccagagtctcttccaaaataaactctcgttctccaaattattttccatttatatttcatatttttaattgctaatatttttcttactgattatacagaccctttatatattaagaaggattatgtcatatgttttggaaatagtcctccatgcatttatcttttcatttatttgttatttttatttttcatatttttacatttttatgcaatttttccattgtatggtctctgaatttcagatcctcttagaaaacataatgcactcaaaaatctaaaaacattctcaaatatttacttgtaacactttataatttcattttttacttttaaattaggatctatctatcatttatattggtaaattttccgatttccaaaaatagataaagattgtcactatttctaagcaaggtcatatctccatgtttttcatattatatgttcccagattattattatacattttgagtgataattaaattaattgctcactgcactctttctacacatgtaccaattgcaaccaagtaattttagtcataatggtagtaggaatagaagatgttattattgcattagctaacacttgtataattcttacttactgttaaacatctttaagtgctttatatatattaattcttttaatcctcagaataactcaatgaggcaggtataggttagactttaacatataaggagaacaaagactccgtctaatttgtttaagtaataggctctcaacagatggctttcaatgactgaatcaatctacgatattgtgcaacattttccattaaaatagaatgttgtagttatttgccattcaaaatatcaaatgaccttaatgtacatctttgtataagacatcacgtgtttctccaactgttaatttcctaaagcaatgcgttaagaaatctttgataattaaaaaacatttttctagaaactgacaggaatatgcagtacaaatatgaggttgataataagttaaaataatatttaaacataggcacacttcagtggagagtgatactagattagatgcttagtaaatataagtatgttagtagagaacaataatctaaatatggatttcatataggaataaatacggatatcacattagggctttctgaaaaacatttaaaatatgtattctaaattgtcattgattggttcaattatcgatttactttgtgccatttgggaggcatgtttatggtatctctttaaacaaagaaccctactggatatatcactatttcaatagttactactgaaaagatgtaggccttcccagaggcctcacacagcacctacacttacatgtcattggccaggactaggtcatatgaccacacctaatttggagggatgctcagaaatacagcactgctaaaaattgttaatgagtaagtggagtgggaaaagattagcaagtagcatttcttgtcatattgtcctatatattcattaagagaaagttattgtgtttcattggccataaaatcactaaaatacaatattgtatttcaggtaattttaaattttgaatattctaagactcaaagaaaacgtatagagagcttgaagttatgttaaattatatttgaatatgttttagataacatcctcatgctcatgtctgttctcccttacacttccaattttaatgctcatattaaaattgggattataaatatcaaatatataacagtaatataaaaagtttactctgcttgatcctccattacttttttcgtgccaacataagttagatgattttaaatgaatgaataaatgtatcaattaatgttgtacaatttctatgagaagaaaatattactgacattttaaatccaaagtgtagtaagtgatgctaatctctatttatacatttgtgtaagtattcacaacaagaagcattgcctgtttttcttacttttgttcttctatgtctataattttaggacactttgagaattaaattttttatcattgtcaataattgaattaaagctatggtacatcagtatgtttaaatttatatatcaacattctctactgtgtaaagtctatgaaaatatattaaccaaaatgactgcccaaatggatatttaagagacatcaagctaaaatagcctaacaaaacttagaaaatatccatggtgacattatacattttaacccagttaaattgaataatccatcaaagtgtatagtagctattattataaataattttacaaaagagcaatgactcaaataattttagcaggagaataagattgaactttagtagcaatacgtactatggacagtaatcggtactcaccagaagcaagaacttcagttgaaagactgtgaaaggaagttatcaatgacacatggaagggacaggcggcattgcagaatcaaaatattaagactattagtaataaatccagaatatagcatatagcagtagtaaaatatcctgtaggtttatagaaatatacctagttattcttttttttttttctttttgagacagggtcttgctctgtcgcccaggctggagtgcactggcgcgatctcggctcactgcaacctccacctcccaggttcaagctaattctcctgcctcagcctcctgagtagctggaactacaggcgcccgccaccacgcccagctaatttttgtatttttaatagagatggggtttcaccatattgaccagggtggtcttgaactcctgacctcaggtgatccacccgcctcggcctcccaaagtgctgggattacaggcatgaggcaccgcgcctggccaacctagttattcttaaaaataattgaaggaagtgattatgattccccttatataaaatagatactgtgttagtccattctcatgcttctatgaagaaatatctgagactgggtaatttataaaggagaaaagtgcctagcaaaggggtaaaagccttttataaaaccatcagatcttgtgagaactcactcactatcacgagaacagcagtatgggggtaactgcccccctgattcaattacctcccactgggttcctcccacaccacgtgaagattatgagaactacaattcaagatgagatttgggtggagacacagccaaaccatatcagataccaagatgaataaaaactaaaaactcaaaccctaattattaatttattactacctcctggatatttttgtagtagtccttagaaaacctacctgatgaagaaagatgctgactgagctgcttaattccaatttatcaggattgaaatctataacaaaattaatttttaggttgaggtgtcctttcacctgctgatccaagcatgacaagaaaataattagaatgtgttttttccaaacttgataggaagcaagtttttctttcatagtaatttatcagaagctgctaaagaatgattatttttactgttacacatggtctcttgggtggttttcaatgttgttttgctttaacagatgggagtaataaatacatggtagggggatatgtcagtaatacatacaaattctttcctgaggcagtatgaaataccctgtcatttaatgatttatgtaacagttatgagtacaaactcagcacaaccaaagcacacatccactggagtctctaaataaaatggaaagcagaatcagaattcactttaactgtcaggtctcacaaaatcaaaagctttttgtatgactaacccttgtcctaaagataaaagctagatttgttatcttcctctgttgccccttgctatgtaattgagttcaacataattaggccttcccaatggtgaaaaaaaaatttataaatttctaaaggaatgtaaataaagcacacatttgtcaggaaaaactgaaagcaacacatttgatataagaagaagaaatggagaatagtgattaagattacaagagtagcctggaaattggacaatattgggtaataatatttatattatcttctgcttcttaccaactgtatgacctgggaaagtttattggtttaatctacttcttcaactgaggaaatgaagataataatactaacctcgatagattttttataagatttaaattaaaataatgtgtaaaatatttagcaaaatatctggcaatagtgagtcctcaaaaatattagagttactacttttcgtttttcttagtaaacaaaaatactttagttgagtattctcaactgtcaccccaaactgcaattctaaaaattgtggaaaatgaatcaaatgtgccattaaaggctcagcctttctgatgtctggtggtggaattaagggacatatacatagaagtctaaaaaaatttataaaatatccatggtgacattataaatttcatatttaggcaccctactggctgaaatcacagtgaatttaagggagactgacagtacaatttgtactaaaaacacagaagataacttttaaaatagctcaatctctatgattacatttttaattcctatgtaaagaataatgtagtcgtcaaaattgttcctagaaatttgtagtattaaaatgtgaatacactattaataatttttaaatttgtcttttttaattgtacatttttaaggtatacaacatgatgttttgatataaatatacataatacaatgattactacagtctcgcaaattaacgtattcattctcttatatagttctcttatgtttgtcaatatgtgggtatatgtggtacaagtacctaaaattgactctcttagcaaatttatattatgtaatactattaactgtggtccttctgttctgtgattaatctctatccttatttatcctacataactgaacgttgtaccctttggcctccatctctccattttcctcacacttacacccctggtagccatttttccatgttctatttctgtgtatttgagtttttgttttgttttgttttagattccacatataagtgatatcatgcactcttatttatttctgggtctgctttattttacttagcttaattcttctaggtccgccctgctgttgcaaatagcagtaccttgtttttttaaagctgggtaatattcaattgtgtaatttgcagtttctttatccattcattcattcatggacatttaggttgtttccatatcttggctgttaggaataatgatgcaataaacatgggtgtgcagttgtctttataagttggtgatttcttctgggtaggtatctagaaaagagatttctgggtcatatggtagttcgatgtttaactttttaaggaagcttcatactgtttttcacaatggctgaaccaatctacatacccactaatagtgtagaggtttcgtttatctctaaacccttgccaacacttgttatctcatcttttttttataatagtcatgccaacagatgtaagatgatatttaattttggttttgattttcattttcatgatggttagtgatattgaacaccttttcatctacctgttgaccagttttacttcttctttaaagaaatatctattgtcttttgcttatttttgcagggtcagattatttgtttttttgctgtcgagttgcatgagttcattatatagtttggacattacccctttatctgataatgtggttcacacatgatttttacagttcattgctatctttgcattttgttaattgctccctttgttgtactgaagctttttagtttgatgtagtcccaattgtttattttttattttgctgcttatgcttttggttaaatatccaacaatttcttgtcagagccaataccaaggggcttccatccctttttcttctaggattgtatagcttcaggtcttatgcatagatctttaatccattttgagttaatctgtgtatggtgtaagatacgagccagtttcattcttttgcatgtggatattcattttcccacactatttactgaagaggctattcttgcttcattgggtcttcttggtggacttatcaaaaatttgttgactgcatatgcttaagtttatttctaggctctctgttccatttgtctatatgtctgtttttatgctagtccaatattgttttgattactattgctttgtgaacacatttttatattattttctttaaataagcttatttaaaaaacatttttaataaagttgtcacttgtatgttaaggattgatgttttccattagaggctcatttccccacagatgagggtatgttaacctgactgtgaccaaagtgactattatgagccagaatgtctcatattaacttctactacataacacatttacttttgtaagtttagataggaaacttgcaaaagttcaaatatcatttcatttttaagtcttaaaatatttattatgatatttattataagtattataaaaaagccttgtcattaaaaaaatccaataataaggaaatgctttggtgataaaattgtagttactagaattttatatatgtgctggattttaaataataataacctattcttttagaaactaaaacaaaaaattatttaatgtatcgaaatttcaccttcttaagtcctattcattaaatgtcaaatgttttaaactctaccaaatcatgaatatgaacagtattattcaatataatttacttaatcacgattataattccttattaaacgtattgctaactatataaaacaggaaataaattatattaatataataagataaatgtgctctgaaagttaaaaacattaatcattccctaaggtaagtgttagcaattacctttcaaatattacaaaggggcaggaataagaaaggctaacaagattcatttgaacattatttattctgtatgttttctgagataccatatttactcttttctcttcatttttatcattttattttttctagaattattatatttagaaacagtaattctacacattttaatagaaagagttaaaatataaaaatatagaaacaatttaaagttaatgagctatttcattgatttgcttgggattaaaagaacatagcaatcactcaataaatattggctatattttaaatattctcacatatccctttaatatactttaaactgacacattaggaatgtaaagtcacataaaatatgtactgaatattaaagactacgtaaaatgacagtctttgttttcatcttcacttcagctttagctactgtgaaaggaataatttttttcaagttactaaagaacttacttttttccaaagttctgttttattgtatgtgtcatagttgttttggaactacatatttaactttatcataacacccttaatttatgtaggaagttttagattcaatgttttttcaacttcaatttctactttttctattacttctatttctgtgatcgcagggcaagaatatttcccttggttgtcactaaagaccttgttctctgtgcttaatgcttagttttctttaaaaagatccttgaagtatacttgcaaggcctttcatttatttactggtgagctttaccagagactctgcttgcatagccagttcacatctcttcagacagcagtggctcactaagataggtgagggaagaaaacttgctaaactgcatgaaagactgagagacccactgatgctgtggacacattcaatgctgtctttacctgagggctgctgtgttcgttttgttttataatcagtaactgatgctaaaagaaatataaataagaaatactatagggaattattttcaagatactcaaagctaaatgcaagttgaaagtagtttgctatataagttaaaaactttttgaaaaggtcagttgagaatttggcaaattaacaaatgcatttttctattcttgtaattttctttattaactgctctctcattacttaaaattacaacagagaaggctaaggcttatggcacaagaatgggaagaccaacctacacctgcacaaaacaagaaaggtgacaaatgaacttttaatagattgtataaagtccaagcaaaaacagtagccttgaaaacctagtatttaaatcaaatagaggtcatggtggtggaagtgagcaggaggtggctgggggagaaaaagcgttgagttctgaaatgctttatgtcaggaataaaaaatatcaggagcaattcccaaagcaaatacagagttccaggcatggtaaagaggattattttagcataagtgagagaagaacaatagagtgggtcctatattccctgataaagaaaggcaatagagtgggtgcctatattccctgataaaaggcatctacaacccaccagagtaggaaagaaggatgcatgctcacttcccaacatgtagttgaggaagattgcaagacttgcctagaagttctgagatctgggtcccacttgggggagccctcaagtagcatagtagggtagactgagtcaaattttcaaggaatggggcctggtatttctttgccttactgtagttctggggaagctgtcaggattcaccaatcccacaccgcttcaaaagaaaagggaaagataatgatgttaggctcaaggaacttgtgatttgcttaagaaaaatgcagactgaatagaactagtgactaaaagccaagacagttccaaggacataaaaaataaatgctatgcatgctagacgctagaacacaactagaaaaaactgttgaagttgagttcaaacaagaagtattctctcctataccacaccaggatgctttcaaggaaaactctttaatttagacataattcaattaagaaaaataatacaagattccaaagaccaaaggcagataaaaacttataaatttctggatatctaaaaaatacacagtcacttctaaaggtgttaatagcacgagcaaagtatgataagcaaaatatttctatgatgtgaaaagtgcctactcagaagaattcttgctgaatgtaaagaagatgatactcaaatttgtggtaatgaaagaagaaaagttatataattagttgaataaatgtttgctattactagtagaaaataaaaataagactcatttaacgccatgttagttattatctcctttccctaaaaggggttattaaaacaatagtgcatcttaaaaatcagtgttacattttatttgggattataagacaatttgattttaatccatgaaaatgtcatcttcctgatttcttattctgttggataatcattagtgtgagtgatttagggtctgtaatacctggatttttaatgtcagctattatttttactatcagtatggttgctaaacatgaataggagtttcctataaaatggatatatcaatcttttatagagttacataaaaataaatgaaataaacacacatatatgccttgtattcagttgttgcatttcctcttctattttagtttttacttacctggtacttttcaatggagctcattatagtggttaaaaagatttatagtccaagaaaaaaaaaaaagaggaaaacattaccacttttattcccttcacatttcagaatctgttgcagccttctgcttttaagttagtcaattttgtttcttataaaattaagagaaaaaattaacatgttttttcctcctgagaccttttcagcaatagctttttaattatcttctgtggtaaaaataacaaattatagtttttaataaaaagtctcactttagggtacttgggaggttttaggctaacctctaaatcatctgaatggaatatacctcctggggataaaagaaaaaattaaatggatttttaaaattgacatgaagaaaatggtttaacacttacttacatatcatcatgcttataagtatgatctgggattgtcatctgctgtattgtttagaacccatcttctctgagggttttctggtattacgttcaatcagtggaataatattgcatctccttttatgtatgtgcaaacattgcatttagttttccatttttacattttgcacagctcactgagatacaatatgaagtatttaattgcttattctgccaactgctgaagtatacactttcattacagcttaaattaaagacttggaatcaaagttattgcttttttaatacacatatgaagttatggacactggagtttgtaataagtaacaacatcaacgtatctcctgactaaaattacttgagtagaacactcattataacaagaggatacctgcagtgtccctttgtaatgtactacaaattttcagtggtattaaactcttatttaaacttatgttaacatcaaggaaagtacaccttgattaaacttgtgtctttaggtaaaagtaaaatatcaaataaattattctgtatatatttttgtgtgtttaaattgattttatctatcttttaaaatcatagcactttgcctattgttcatatatatataaatctaaaattaagagacagtaaaagtgtcatcatttatattatgttatagtattttaacctaccaaactaatagaagcttcataatacctagtattaactatgcatgcttatctgaaagataagtgctttctgtggaattaggatttttatccttcaccactgtatgtaaattcagtgactgtatgcagttttcactgaaataactttgattttctgccgtactccttggaggccagttaaaaatacattgtatgctggcgtttaatttcatcatatttttatcaagttaatgaccagacatagtgtattataactaaatatataagggctctggtaaaaacaattaagggagcagtatattcagggaaaacaaaggaggaagtgataccaaaaagagtcattttgggtctaaccacattctgaagctgccacttaaaagagttaccttaacctgtctctgcctcagttttttcattcatgaaatagggctaaatatagttactacctgctagggtttgtgggatattacatataatgataggtataagacagttaaaatagtggcacatggtaaagactaatagatgtattttttttcttaattttctgagctgaaaatacaagttaggaagttatcaatgtagagatattagaagaagctactaatagtaatgaggtggtttagcaggactaatctgtgcctcactaaatgtagcctctggattatttgtgtccaaattactatgtgggagaggagatgctttttaaagatcgtatttttagatctcattgaaccataattgctgatggttgagacttagaattttggttaacagtgtcatctagtgattctcatgcatgcagaaatatgagaaccactaatacagagtaccacaaacgccatatacaaaattctggagaacatcaacatttagaacacaggaaaagaaaataaggagtagccaaagatgctgatgtgggaagcaatatgagagagagcactgtcatagaattcaagggggaaagagttttaagaaaattcagaattccttctctctcttattctctaattctctttattaaaaacagagaaacatttcaggcctacacaaaataacataatcataatttttacatctaccattaatctaaaacaaaacaaaacaaaacaaaaatcacctggtagagttgaagtcctttctttacccctcacaactgcatcatcatctcttgcactctcctaacctatttaaacagtatcttcaactcagtgtttattatttctcttcatttctttattctttaatatgtacatagctatacatcctctttaaaatgcatagtttaaaactaaattttataacatatctacttcaaaattaattttagttcaatattttgtgaaaattttccatgttgatgtatgttgcataggttcctttttcatgctatattttatattccagtttatgaagagtctacaatttcattatcacctcttaaacgattgaggtatagatcattttccattttctatgcgatgaatatacttgtttccaagtataagaatttatctgttctcattgtaacatggcttttaatgcaaattactctccaaacttataccaatttgcattttcatcaaggacacatgtttgaaagacaatttttcatggattgcttatatttctttgtgtcttgtgcccagaggcaccagttgcccttttattacaacctgtcttttcgagtcattagcatagcaaacgtcttttgaatgtagtgtcttcttctggaacagaggggaggtttgtttgatgtcctgtgatgtctcctttctgggcaatggttggacacatttggttactatcagttataaagactaaggtttcttaaactcagagtccttcagatgtgacgcacaatcaaggcatgtgcagcgtcctccttggcacatctgcagtacttctgtggaacttcagaggtaaggaggatcaatgctaaaataaagcttgggatttatgctgagtcatgagtcattttctctgaccaagtagtctccagtcttctgctaatattcatgatattgtggcaggctaacttgttagcttatacgtaggataaaaatctcatttgtttcccaccccaatcctctggttctgacatgcacaaagattctcattgttttacatctatacaaagccctaatagttaatctttaaaaagtttctgcctacttgatggtggaaaataaagttgtggttttaatttccatttccttgattcattgtgaggctaagcctcttctttagttacttacttatttggatttcctcatctatgaattacttgttgttatttggctcaatttgctactgaattcttttccttgttatcaaaatgagtttttaataaagtctagttaattgtgtatattaacatgtgtataatatcttcttcaaacctctggcttgtatttttcctgtttaatggtgaatactgatgagaacaaattttttaacttgaaagtttatatttaattaattttaaatttggtagacaaatttctcaatctttttcttcatgattcatccttccctattctgtttaagaaagcaatatattggccaggcacggtgacttacgcctgtaatcccagcacttcaggaggctgagttgggtgatcacttgaggtcaagagtttgagaccagcctggccaacatggtgtaaccctgtctctactaaaaatacaaaaaattagccaggcgtggttgtggatgcctgtaattccatttactcagggggccgaggcaggagaattgcttgaatcctggaggcggaggttgcagtgagccgagatagcatcattgtactccagcctaggtgacagagcgagactgtctcagaaaaaaaacaaaaaagaaagtaatgtattacctgagatcataataacattttttctgtatttttcctaactgatttaaattgtatgttttaaatttaattgtttaatactcctgagactgaattttatgtataagatataaggttccaattcaagtggtttttttccatatgcataaccaattgaatggtatatatttttctctcttctgtgcagacactctatatattttatatttgggctttcttcccatgccattatttaatttgtcatttgtgtaggactgtgctgtagcacacatattgtagtttttatttccagaaatgtagcagtcaagactgtataattaggactaacttaaccttcagaaaacaaatacttatgaacatatagtatgtgcatatatgtgaacatatgtgcatattatgtgatatgtgtatgtgtgtgtacctgtgcatataatgtgtacatgtgtatgtgtgtgtacatagagaaagtactacgtaaaaatccaagggaaaatggcattcaaaagtaacagaatttctgcccaaactacttttgccctcagctgtttgccaacccagacaaacttgaactttgattcttaatagtttggcaccattgaggcagacagcaatgaaaactcaaggccttctcaaagcaagggatcttctccactctaatttgtgacaccaaagagtttcacaatcaaagtaaaagtaggccatgttgttgatgaccttaggagcatgtcagaaacaatggtacatctatacagaatatgtctttgtcataggccacagataacccccaataatagaattttaagccatattatcagcaccagtgaaaaataaccaagcaaataaaaggagaaaagccccatgaaaaaggataccatagatttcagctaagaaaaatatcagacacatattacaaggcaatgatgcatactatatgtttagatacatatagaaagaggactgtatttgtcatatatatatatctgaattaaggagaataaaaaaatctgtcacaattgtataagccagcaaaatattaatagcttaaaagttacaatttacaatagcaaacaaagctgtggattacctgttatctcatctaataaattatatgcatacatttaataaagaaagcttcaaagtgcttgtaaaagacattcaagtgtatatgcatatggaaggatagagtgagagaaaaggaaagagagagattcctacgtagacaactctatagatctattttggttttgtttttccaattattatacactttattgttactaaagtacaattttaaataatgttgagcattctcacttgtaattctaaaaaaatttctaatatataagcattaaaaataaagcatcctctacctttttgttggatcttctttatcagattaatcaagttccctttcattcctagcatgttcatagttttattataaataggagttgatgtttcccaaatttttctccatctagtagaaatatgttttttcttcttttgccagttaactatgttaacacattttctaatgttaagcaattcttgcatccttgcaagagaaacaatactggatgtaaaacttgatgaatttgataacagtactgtatgatgaatttggaaacaatattgtatgttaaaactttatgaattcggtttgtatacataagtttttctttcttgtaccatcctttttggtttaaattaaataacatagctggagagttattgtttttctttttaaaaatatctgcaagattttgtaaaagattagaattctttcctgaacattttgataactgtgctgtgaaattatctgagcattgtgattttttagtgagggaagcattgtgaaactcattcttcttttaacatattacaatcacactttcatcttcattactctgacaccatttatttcaaggagaccatcgcttccatcttgccaaatcccatggtaaattcctacccttcatcttaacttcctaacattcttcttatggagatgtcctctgatttaactaaagagtgcccctttccagccttcccactatgactttcaatctccttgtgattttttatttttctctattgtacatatgactaactgaaattttatattatacatttgtttattgtgcctctctttttaataaacttgaaaagttaaggatttgtctttgttttatacttttaatgcccataatatatgggaacagttatatatgcaatgcatatgtttgctaatgtgatagagttgtaagtattcaagaatctcgtatgccattaatatgttaagcaagaagtagctaaactttgatctctcccgacttcaagatcagagacactttggaattttctgactcttactaaacattagatgatatattaaatctattaaatacctctgatcatttggcaattacctgcaaacatatgcatgcaaacatctcaaaatttgtttatcattatagaaacttgaactttaataatacgtattcattaatatacgtactttttgatttaataaaatttcaaaatttgttttcaattttcttagtacctctgaagaacatactgggaacattattctattattgttttgatttcaggctggacagcagcgctggtgggagcaggagattaaaataaatgggaatattcaaaagggagaattaattacatataacttgacagagctaattaaaccagaagcttatgaagtccgactgactcctctcaccaaatttggtgaaggagattcaacaattcgtgtgatcaaatatagtggtaagtagcctttcatttaaaattatttatttatatatttaactatatggaaaattttggttgctgctatctaccaaatttagacacaaagtaaaacttagcatattgactttctggatcattagccagttaactaaacaaaaaaacaaaaacaaaaaccttaatcaccataaatgtgacatttgattacaaatgtagagatatagaataatttagttaattgtgaacctatgtgatataagcaatgtttctttatttttgatcctacaagttataatacaatatttgtctgcattttatcttttcaaattcttgatgactttaaaactttttaagaagtaaaaaaagatcaaaattcattttctgttttttaaataaaattaatagatttcagtttttgagcagtttaaggtttacagaaaattggcaggaagtatacagagccccgtctccctgacacagtatccccattattaacgtcttacattattgtggtacattggtaaaaattgattaacaactactaagaaattattattaaaatcagtattatacattacagttatttgtgttgtgcagttatatggattttgacaagtgtatataatttctccaccattacagtatcacacagaatagtttcactgcctgaaaagttcccatgctctacccatttatctctcctttctccagtccgggcaaccaatgatatgtttactctgtctatagtttctccttttcgagaatgttgtaaatttggaatcatacagcatgtagtgctttttagactgccttatttcacttagaaatacataagatttctgtatgcctttttgggacttcatagcacatttctttttatcattgaataatctccattgcataaatgtaccagtttatttatatacatatcaaaagacatcttagttgccggattttggtcttggttgttggtggccattcatttttcatattgctaatgttaaaaaatgctaaatgtttgtgtgtgtgtgtgtgtgtgtgtgtgtgtgtgttagtgatagttttctttttattaactatatgcataaaatatttcttcactacttaaatgtcctatttggagaaaaatagaaattagtgcagaactttgaaaaagttaaaagtggatctaaaacttttatctagaattaatatctcaaagagaaacaatggcaattagatatatttattctttctttttttttttttttttttttttggagacgggattttgcttttgttgcccaggctggagtgcaatgccgcaatcttggctcaccgcaacctccacctcctgggtacaagcaattatcctgcttcagcctcccgagtagctgggattacaggcatgtgccaccatgccctactaattttgtatttttagtacagaaggggtttttccatgttggtcaggctggtctcgaactcccgacctcaggtgatccacctgcctcggcctcccaaagtgctagattacaggcatgagccactgcactcagcctagatatgttattttactgtatactaaagagataaatatttcaaaaattgaaatttgtgtgcattttagaattttaatattcagtgttagctgtagaattttcaatgtatttcaggtttgaatgaatcattatttaaacagttcatatttattgtattgcttcagtagaatattattattactatatatatatttttgagatggagtctcactctgtctcccaggctggagtgcagtggcatgatctcaactcactgcaacctccgcctcttgagttcaagtgaatctcctgcctcagcctccccagtagctggtattacatgcacttgccaccacgcccagctaatgtttgtatgtttagtagagagggggtttctccatgggcagcctggtctcaaacttctgacctcaggtgatccacccacttcagcctcccaaagtgcttggattacgggcatgagccacagcacccggccaaacgtgattctttttatcactgattatcagagcctgagttaaaaagataatagaatgctttgtttgcagctgaagtactccattgtgtttacccttaagtatacgtttcctgcttaaggggaaagtagtgaatactgtcaaacgtgaaatatgaagtaaaactattaacaactcattaaagttgtttgtacttacagtttttaccaaataaataagatgtataatgtagagtgcattaatatcaatatctttaaaagatgaagatattcggacccagaaagtttcagtgtcctgcaaagttaaatgactgtgaaatgacaaacctgactagaattagggttcaccactccattagagaagatctttacttctttgctaaagttaattgatcattatgactttccttaagagattttaaaaagttaattagcttagtagtggttattgaaaactctgaggcaacaaactaaaatgaaaaacacatgcaggaaatagatattacttttaataataagttttcaaaattgtttttacatacttaggcatacatattcagatctccaacatttttattaaaattatttttatgtgatataggtttgggcaatgtatactttaatggtttagaggcaatgtattagtctgtttgggctgccataacaaaataccatagtgggaggcttaaacaacacaaacttatttctcacacttttagaggctgagaagtccaagatcaaagcactggcatagttagcttctggtgagagctctcttcctaatttatagatggtcactttttcaccatgtcttcttcacatggcagagagagctctctggtgtctcctcctcctcttataaggacaccaatcccattggattggggccaagattaatttaatcttaattacctccctaaaggatttatccccaaatacaatcacattggggattaggcattgacatatgcatttttatggggacacaattgtctataatatgcatttataaaaaaattatacatgcaagttcaaatgaaagaagaaaaaactggactcgctgaactatttagaagtttgtgcaaattttcacaaagttaactgcattatgtatagtgaatttggtgaattaaatgttggaggcaaagtctcaattaaaattcagtctggtaagagctttacatgtacatacaacatatcttagaactaagttataattcaaggacgcttacatctttgaaagatagcacataattttttaagaatttcatattaactatgaaataattttaatttttactaattttaaaattaaaatacatggatatcttgccaaaaaattaaattgttatttttagttcactttcagttccttttctgttattcttttcataatttgcaatgtggaatgtagaatcagaaaaacaactacagtaatgggaattgtcttctgtatgtaggaatagtggaaatcattgaaaaagttactctgttaaaatttatcatttgtatactaatgttgcaattatatatgaatatttttgcccgtcagagtttattactgttgcacaaatttaacaaaagtggttaatgacaaccactaagaaaatgacaaatcagataagttctgcactgtaaattaactgccaattgtaatcctgggaaactacattctgcccattgtaatcttggggaattacatcaatgctgtccttcatccagattggaatattttctcagagtgataagtggttaattgatatatacagatacaaatttggcccttagatgagagatatttttgttgttgtgttagtaatatttaaagtattcatttctctttgggtggaaattcattggcacttgtattgcaaatataattagttttaggggaaaaaaaattcttttggtaccccagaacagaaaatgtattgctcatcattttaaaattctgtgtgcatgcacacgtgtatatgtatgtgtatattttactgtaattaaacaaaaaggcattgatgtagctattcattttagtacacatattacaacatgatatcaggattgctttattttcatctgtgccatgaactttctactttactctcagtagaagtagaaaacagcaaaaaacaaaagtggaaactctgctagataattgttttcatttttaaatcacctagattatagattggcctagtttcagcctcagttttgatatctgagtatttttgtttagcactagttcagatatttaagaggtcagaaactctataccttgaaaagggaacatttcctgtgctatttagcattggtctttttggtaatttgaggctgttattgctgagctccaaagcagattatattcaatcctctaaaacaaaatggattgcagatataaatctcaatggccacagtgggaaagatcattaagttttggtaaggaactatgagacactgattagacttttatttataaaagacattcaagccatgctaacattgtttttttgtttgtttgtttcttttgcttttcttgtagctcctgtaaatcctcatttgagtaagtatattttaacttacaaaatggcactatatttaataaatacaaaaatataatgtttataaatatacaaaaattgtttagtaactattcttagttggtttaaaacacaattgttcagaatcagtaaaattggcattaaatgtagattttaaatttcaaaggataggagtataaatacaattttttaatactgataattgaggtttatagattttcctaaatattgaaatatggagccatttaccaacctgcttaatatttgctatttctgcagctgtgggattatttttttcttttgtgggattgcatatcatttttatcgttgttacacgtttctttgattttccttctttgaatgtctatattccacttataaaagagtatggttacttagaaagttggtatttgatgggtttaattgagactttcttttatagaacactagtttacactccaatgtatttggtctaatttaggttatgaattctataaaattgttaaatttggggacttctggaaagtttttattttgttttatattaaatgttataagatgatatgtatctacctgaaaaatattcccatatatgaaaacttctctctccctggaaaataatattaaatcaacagaggatttactatgaagacatattctaaaatcagagctatttatttgtaatttaaggttagatttcttacaagtttaaggactaaagagcatcgtctctgggtgcaaaaggaccactgggtatcaggattcttgttcctgagtttttttttgttttgttttttcatcatattgagaaggattcagggaaaattctgcagaccaaataaagcaaaattttgaagaccacgtaatggagaatatttaagatatgtttaattatttctatgtagccccagaaactctgctaaaatcatgttgtaattagaaaaccagtggaaaattcaagatccacttgattctcagttctatatctttgtgaaaatcctggactttattacttatttatacttattactcttttagtattttatattacattgacttttgaaaagtttgtacagctcattgcgttatcattatctatcagatattctttattctaataaactttttaaatgaataaatgtatttgcacatatttataattgtctctttttaaagtgacaggactatcataaaattcttgggttttgactagtgagttttattttcattttacctgccaactttttataaattttcttcagtaataggcttatttattgtaaagatatatgtccttagaaggaatcgagagctattgatgttgcttaagtatctttgtttgatttgaattattacactagttataatattataaacaacttacaccatataaaataacctaaacgatgaaaaattttaggcacaactgacattttttgtagttttcataagctgcattattgcttaattttactatgaaagacttaaatatttaggtctcaaaaattattgtatagatttttaaagacaagatattttctctttttaaccaagtttaaattacgaaaaaaaggttcaacagtgttataaaaattcattatacataattttaaataacatataaaaagtaagacttggcagtagatacataaactgaaatcctttatctttacatttgttctgtgactcttttttgtgcatatgtaatatataattaaataactgaaaacattcaaaatcaaacattgcctttatggtattcaaaccgccagagtagcaactaatggaatttcatgtcatacctaaaatatctttaaagaaatacgtgcatgtatgtaaatgcatacactgctacactgctgttaccaacattatttttccaactgatagcatcaaaaggtcatgtcttgtttggtacaaggtctgtgacataaatatgtgtctaataaatattttatgtacaataatgtttattcagaaatttattgagttatttatttagactcccttaaatatgtatatttcctgtaacattacctacccagaatatagaatataaataaatacaaagagataaagcaagtgtttcgtctaaaaaacaaaaacaaaacataaactcattccctaaatttaaaggaaaagccttctgttttatttttatttgtaagtaccaaaaattttcaattaattcaggtacatgatctcaaccaggactccatttccaaggatatctgataaatctaaccccttatgggtaggtcggagagagactaaaatggaagtctctgttctttaagtgtttatatctctatgaattccagggaatttggattccatttgacattatcatttaatagctgacctttgccaaagttttctcctctgtaaagcctcatgagtaaggattattgtgatttcacagagttgttatgaggctgagtgaaataatatacattatgtttattctttctcaaggatacacactctttaataatgtgtctagtggaccttaccaacttatttatacctatttttttcaagcagtaagaaaacctttgatacctagaaacattactactaccacccacatttcagggatagttgaaaaagtctttctctgaacttgtgttggccctgaactcaacatacgttaggcatccgagaaatcacagtccttcaaagtctttaaaaggtcttttaattacttcatttccatactgaagttcaagtatctgggaaacccacattcagataaagtaggaaggataaatacttttcaaaataatttgctattagcttgccctaaacacacttccatttatgcaaatggatatttaaaagcatctctagacatgcatgaaaaattataaacttaaagtataccaatttaaaactaccctcaggtaaattaataaaggtaattttccaattgacagttttgttttgattgtttctatactgacaaaatgaaagttgggaaaattcttcagcaataattcaagcataaattatattctttaatttcagttatctggatattttagagaaaaattgtttgagtcttaattattcaataagatattaatttacatgtaaaattcttttactttttcattaaaattagattggttttatgtttagttgtaatcttctgcaccattatggctctcatgccattgtcacaatcttgcattattattgctatgtaatattttacatttttcttatgaaaatattgcagtatgtgtattaatttaattaatattaatttaattaaaatttaccaacaggagaatttcattgtggatttgaagatggtaatatttgtttgttcactcaagatgatacagataattttgactggacaaagcaaagtacagcaacaagaaatacaaaatatactcctaatacaggacctaatgctgaccgtagtggctccaaagaaggtatgggggtatgaccttttgtgttcatagcaatcagagacttttaaaaactgctataaatatgaaatactaatatttagccatatatttgaagattatggaataaaatattaaattttctgtacagtatcaatttagatatttacaaaactttgtagacattaattttttctcagacttcactgatacatatagtagagagaataggaattttttgataattcaagtctaaatttcaactttttatacattttatctttaatttggtagatcatttattctttgtgttacagccactattagttacatatacacatagagattttataaatgagatgcaaatcttcctatccatctttattttgtatgaaaactataagacttctcagtgatttgaaatttcattatgcctaagaataatgtgtttaaacactttattttgtctgttttaaggtttttatatgtacattgagacatcacgacccagattggaaggcgaaaaggctcgacttctcagccctgttttcagcatagctcccaaaaacccttatggacccacaaacactgcatattgtttcagcttcttttatcacatgtatggacaacatataggtgagatagcaataattactgattcttacaaaattaatgataactaagaagaaaaaggttcataaacacacagcattaaaacaatttttggtcaaagaatgctataattcactttttaaatgatttatctgcaaattgcaaaataagatagtaagaattttttcccaccatctaatttagatttggaatttgacattttagatcatcacctacctccctttggaatcctaaatcaggtagacaatcaatgagttaaattctttaccaggtctcatggaattgacacagcataatttaggctgcttctttccgaagaaacatgcttcgacagtgactgaatgcatattaatcatgatgaaaagtaatattgtcatgttgctatattgacagttatttttagcaccatccacatatttgaaacgttggtgtgatttttttcatgtttttaaagtatgccaaacacacccagtaagatttaagaacattctaggtcctgcacagcatacaaagataaagacacatttccttcccttgagaccttgtacagtaatagaggataagatcagatgcacaactgtgctagatagagcatgacattacactgagagtagacctagtaaactctgtggggaaaaagatcatgcaggtctaccattctttatgtgcaattctaaaatcctgagaactgaatatcaatttttaaaatttaattatttgacattacatgttagcctgatatataacctgaactgatatgaacctatgtatagtctctatccaaatgaatgtggacatttataccatttgcagcaaaaatattactgtttttaataatatgattctactcgagaccattccagaagatatcacatgatataagtgatataatctctcacctttctaacataagacaaaattctaaataatgaagtatatctaaccccatagagcttgaaccagggattgtggatctttatctagttgaggaatgagtcactgcatcaatacaaacaagaacatttctctggtatgcaaaagaggtatgttttcaatacgcagagattagcacagggagggttaaagcactggtaataaggaagtaaaatttgagaagttaggattacattagtgtctttatataaattaataaagtgatagtataaatatatgtgatgtaaactaatacaattggacacataatatgtatcagccaccatattatttaagctaagtaatactctcaattaagtttgtaaaagtgaacgtcactgtccatcttttaccgtggagaaaactgaacctcaagaagtttgtgtgaactgccaagtaaatggttgtgctgggattcaaactcatacccaacagtattaactagtattcttcacagtatactgacaagcctaaatggatagcacttgggtttttttgttttgttttataatttatttttatttttattttttatgagacaggctcttgctatgttgcccaggctggtctcaaggaatcttcccaccttcgcctctcaaaatgctgggattacaggcatgagtcattgtgcccagccagaaagcttttgagaagttaaactactataaacttgaagtcaggagacctgggcaggaacttggctgtagcacttcatcactgtaatacttcagagaaatcacttaaaatgtctgaaccttggtttccttatctgtaaaatgagaataataactcttatttcagaaagctgtagtttaagttaaattaggcaacatacatagtatcttcaaccagatggcagacactcataatcttaggttactttgaatctgaaatagcaataataatagcaataataaaataatagttgacatttatggagtactcatcatgggctaggatactttgtggattatttctcttaattttcacgatcaacatttgtgcttattaaaatcattatcctgtttcatagataacaaaattgaaatacaaaggactttagttaccatgcccatcacctggctaagtagtgaagccataacacaaacatgggaagctggacagagtctgcctgttttattactgtgcaggaacacttgttggaagattttgcaagcctagctaagtatgtgacagttacttagtagtggtgtgagttattagattttctgcaatcaaaaagcataatgagatatttgatttaggaaaataaacataaaaataggtaaaatcattcagaaacagaatctagactgggaatcacttaaagaaccaatgaaaggaaacaaatcgcataattgccaagccattttatttattgtgggattactatattattactaatgtaggattagctcaactctaattcttcctttttgttaataatgtatactctgtttcctctttgttttgaatatgtgtcatgtactttctttctcctcttccaatttacattggatcacatattttaattgatttttaaataaatatttccaagaccaatattctgaattacttaaagtcataaaatatgttcaccttatttatgagactagattttagggctttactttaaaataattttaagatactttaaaaatacttttaatacatcattataatatacttttaacttaatagttgttagtcttatcttctttattgtcaatggatgtccagttgacgttctgctagttttattctgattattttgggatgagggaaaattaggaggacagttctccatttcttggcaaacatttacattttgacccctatgtcatttctttgcttcatcagactgaaggttgcaggctgggtatcaggtctattacttgagttcctctcagcaagctgcaggcatgctgcttactaaaatctaggcaaaaatacctggtccagacattgagtaatcagttaaagctagatgagatagttcattagagagatctgctggtagttaaaacatcccctctttgcatatattattttcggactttcattcatctgtaaactcaggaggcatttatagccactggttttacaaattgtattttcagttttagtcattcttttggaaatccagattcaaagatgccttgtcctgaatttctaatagcctaattaaatttataacttcatgagtaattgtaaataaatcttgaacttttaactgtgactaaaggacagtataccattgagaaggttcataattatctaatacagaaatgagcaataccctactaagaaaagagattcctctttgaactaaagttaaatatgttgcattacttattatttgcaatataacaaatttccccaaacttttgtgacttaaaacaacaaatatttattatctcacagttgctgtgggtcaatacaagtatagctcaactgagtgcctttggctcaaagtctctcctaaggttatagtccttccagaaaaggactccaccataatttgaagactcagtttggggaggatacacttccaagcccacttgcttgatttttggcaggctttgctcccttaagatattggactatagatactgatttcttgctggctgttgattggaggcctccctcaattcctcaccatgtggacatctctacagggctgtcgcataacatggcagcaggctttcttcaaagcaagtaatccattaagaagagagagagaatgcatgcccaggatttttcataacctaacccctgaagtgatatcccatatgtctgtctggttccatttaatgtgactgagttgataattcaagcccatacccaaggggagagaaatgcccaagagtgttcatgctaggacctaggttgagttgagctctgccacattggtacaatttctttttagttaaatgtttcatcaaaattgattgaagaaaaaaacatgtttccaaatgaaaactataatgttatccttaaagtacctgctgatttatatgtaagtgatacaacatctggccatgataataataaaagattctttcagcattcctgtgactactaatggacatttcaattctcgatgaatccactgaatttctaatgttcttgcaaaaaaaaaaaaaaaaaagaatctcataggagatcactagatatgacaaaagtgtattaaaaataagttaaatgcatcattcatttctttaaaaaaagaatgtgcaatgtaaaggtcatatcatatcaggaaattaaggcacttatgaatacattcattgtacttgatacgaatggttcaataaagttgtgtctctagaaagctaattccactatggagtaaacagggggaaagcaaaggagttcattaatgaagaagcaggagactgtaaaagaactgataaatagagatgtgggattgtagaagggcttattttaagaggaaaaagaggtaataaaaagggtaagcttagatgggaatttagagctctggctgtggaatgagacttttaagagagaaactgatgccatttccactaaagcggtaaaaaaaagaattcagtattaatagtaacatggcttctgatagatttctagctgcaataacagcaagctgacatggaagttgccttcctaacagtctccattttctctgcaaaacagatacagaggtacatgttcaaagaggagatagctttaggagagtggtaaatgggagcacaaagtaactgacaatatagagacagctggagaggttggagatgaggacatcaatctgtaggtttctgaaacgcattttggaatataatggccagtttgagtccccatctgtgcgtagtactgcatttcgcttgctaactgattttcttgctgtcttttttaaaaagtccatagcttccagggtaaagatctttctctaaaagcagtaacaggacctcaaggatatatgcccctctggcttttccttggggtagcttcatagtctgttccagtcatacttgaagtttttcgggtaaagctctcttgtgcctgaagcctcttcacaggctgtctcttttgtcctgctgaactgtaggcttgatgggagtagaaatgatgtctcttctgatgacaccctgccctgcatgtaaatattcaagtactcccccaaaaaaattaataaatatttgtttatctaattgaataagtactttttctcctgtttaatcatctaagtcatgcataaccttccttaaaaaagcaattcagggatatatgctgaaattctttcctatcttctctgctccttttgttcccaaaactcctgatatgtatacctatcataatgtttatcacactgacccctgtaaaattgtaaactccttgagagcagtaaccatgatttatttacatttgattctcggaaacaacatttacacaatagatttaaagaatgatccaaactagattcttttgcttctggatatactagaataacaaaacaagggaattgaaagtatgcagtttagtttggaaatagaaggtagtttcattaagacattatagattgtaaaaaaaaaaacagacagaagatgaagtttattattgacttaacttgaattttcatctatatgctctggcaactaaagtaaaaagaaaagcaaaagtgtcacatattcttaacaattaatgcaaagagaaatgcatattataaaagtacacttgagtaatgttaccagcaatatctttacttactaagatattcatataaaggataaagatataaaacttgttcaaataaaaatttaatatattgataaaccataatacaggataaaataacatttttgttttcagctgaaatattaaggaccaggtatgtcaccttatgatgatctaacttaatgtagagaaggaatgtaaagaatctgaaattaactaatcattaagtttctctttttttattattattatactttaagttttagggtacatgtgcacaatgtgcaggttagttacatatgtatacatgtgccatgctggtgcgctgcacccactaactcgtcatctagcattaggtatatctcccagtgctatacctcccctctccccccaccccacaacagtccccagagtgtgatgttccccttgctgtgtccatgtgatctcattgttcaattcccacctatgagtgagaatatgcggtgtttggttttttgttcttgcgatagtttactgagaatgatgatttccaatttcatccatgtccttacaaagtacatgaactcatcattttttatggctgcatagtattccatggtgtatgtgtgccacattttcttaatccagtctatcattgttggacatttgggttggttccaagtctttgctgttgtgaaaagtgccacaataaacatacatgtgcatgcgtctttatagcagcatgatttatagtcctttgagtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcatctgttgttttctgactttttaatgattgccattctaactggtgcgagatggtatctgattgtggttttgatttgcatttctctgatggccagtgatggtgagcattttttcatgtgttttttggctgcataaatgtcttcttttgagaagtgtctgttcatgtccttcgcccactttctgatggggttgtttttttttttcttgtaaatttgtttgagttcattgtagattctggatattagccctttgtcagatgagtaggttgcaaaaattttctcccattttgtaggttgcctgttcactctggtggtagtttcttctgctgtgcagaagctctttagtttaattagatcccatttgtcaattttggctttggttgccattgctttcagtgttttagacatgaagtccttgcccagcctatgtcctgaatggtaatgcctaggttttcttctagggtttttatggttttaggtctaacgtttaagtctttaatccatctttaattgatttttgtataaggtgtaaggaaggaatccagtttcagctttctacatatggctagccagttttcccagcaccatttattaaatagggaatcctttccccattgcttgtttttctcaggtttgtcaaagatcagatagttgtggatatgtggcattatttctgagggctctgttctgttccattgatctatatctctgttttggtaccagtaccatgctgttttggttactgtagccttgaagtatagtttgaagtcaggtagtgtgatgcctccagctttgttcttttggcttaggattgacttggtgatgcgggctcttttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccatttgtttgtatcctcttttatttcattgagcagtggtttgtagttctccttgaagaggtccttcacatcccttgtaagttggattgctaggtattttattctctttgaagcaattgtgaatgggagttcactcatgatttggctctctgttcatctgttattggtgtataagaatgcttgtgatttttgtacatcgattttgtatcctgagactttgctgaagttgcttatcagcttcaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggactggtgagagagggcatccctgtcttgtgccagttttcaaagggaatgtttccagtttttgcccattcagtatgatattggctgtgggtttgtcatagatagctcttattattttgagatacgtcccatcaatacctaattgattgagagtttttagcatgaagcgttgttgaattttgtcaaaggccttttctgcatctattgagataatcatgtggattaatcaagagttttgcaagaatggattaatgctttctaacagatatgctggcattcaaggattttaaactaggaacttaaatatttttatacaagatattgagaaagcaaagatggtattttgcatgattttatgagtttgatttttattctcattttggtcaaagactgtatttcttctgattagaattcaaaatgtcaagattcttgcttacatatcaaatatattctcaaataggaaatcagctcacatattgggattttttttcccttggagttaaacgccatatgagaaagaatgttaagataaggagccattattttaaagccttgatttcactgactctaggagaatctcagtggaataaatataaaatattaaggtacttgcattctgataaattctcagaattaagttccttgaagaagacaactcttaggtggctgaggggatagataaggctccttagtgttctccatttagatattagggaataactaccaaactgtgagctgtttgataatagttgatattaagtcacgctttctgttaagaattagtctatgctctcagtgaagtcctgttggtatttaatgctgataatgccaatgctgtaaatgtgaaaataatgctatagatggaagacattcattcagtaaactgctttttttttttttttttttgacacagggttacaacaaacctttaatttgtaaaaaaaaaaaaaaaaaaaaaaaaaaacagcaatatctgcaaagcgcaacaaaacaagatatgtcagtatttgtgtgtttacaactctcaatttggagtctagtacatccttttacagaaagcaataaaaaccagacttataggaactaaaatgtaaagaactaaaatgtaaagacataaaaataaggcaaaataattaagttagaatgtttgaagtattagattgactaagcatcacttctagttttgtaagtcaacattatttagaaataatttacatataacaaaaggtacaaattttaagtgaagtgtgatgagttttgacaaatgcatacactcatttaaccaccctcacatcaatgcatacaatatttctaccattccaaaacttttctgtccctttctccaatctcctcccaccactctcaccctagggaagcactggactgttttaacactattaattagctttggcttttcactgttgtggggtggggggtggggggaggggggagggatagcatcgggagatatacctaatgctagatgacgagttagtgggtgcagcgcaccagcatggcacatgtatacatatgtaactgctttgttaaatgagatgaatttaaaattgaggaggtggatagaatctagccatgacttatgacaatgtataataaaactctttttacaggtacttgttatagacctgctagtaaaactatatgtaatctttaatacatttatctttttagaatccaggtttgaaccactaactacttctaaactcattttttttctattcttcattgatgatggtcccttagacaatgtatgtaataaaatctagtgtgtttaagcaaaattaatgatatgaactgagtaaggctgagaacacagtagctgagaaaggctgctacttcaaaccatataagtctaattttcagtataattaatagacaatattatttcatcaattgaattgatggtaagcaattgagttaactgcttctgtttctcatccagtgtaccaaactttaaaactaatttcattgacattaaggatttattacaatgggtattttttacccttaggtttgaattcactcatttctgttcaataggatgaattgcacaggctgtgtgcctaatcctagtgtttagaattctatagagaataaatgacaaatatgataaaagttttttattcatcaaatagttcatcatctttttgaggtaataaatttctgaataaaataaaagtcagaaagtaatatgtatcaaaatgtaggacaagcccatggcgtgggtgaacaagggagagaagactgaggggtacattaaaataaaagtgtctatggaagagaagaaatataaagcatcctacaaaagagggaattatataggaggtggagaacaaaggccaaagaatatgagaaatggacaaagccaatgtatgacaatggagaatactgtgcttatggaagagtagagaaagtgatagaactaaagagggaaaaggtcagcgtaagggatctgacttacatcagagaaatagaaaggaaagctataatttaaaaacattttggactctaatgtacaaattcacctgtgcaccagaaggaatggtaataactgtagaaaataaactggcatttttcatttaggatagcactgcaattatatgttgaaaaaatatcaatggacatgggcagctgtttttattcaagcagaaaataatgattttataatttctcactttgtatgtatgtataaaacaaatgatgctagcaattacctatcaatatacatagatcttgcctagagctggatgattttggcacatcctcattttacatgaaatgtgaaactcagtaagtctgtgttactgattataacaatgcgatttgtatgcaagtgatctccagacctcagaatataccaaattgcaaattaattcatgtaaatgtggcaatttcaagactctatggggaatatgtatgcacattttaggacatatacttaaattatttatctaaaatatataatacatatttatagtacaataattaaaagtaaaattatgttaagaacttaagagaactaggttaacagtagtgataaatattatttatgcaaattatagtttatattataatatatattaaataatattaaaataataatcaggctattgcataatgccatgaataacctcaaagttttggccattattcgtgagataagacagcacttgtgtcatttagcctttttgcctgtagtctttaaacataagagctgactaaagtcctctaagctctagcacctgatttttggagagtggtgaccaaaagatgagaattaagaaactaaggaaaagaaaaagtttgagttttgcttagcttctgcaaacttatattctagaactatagaatttgaaaaatcctataaaattgaaaatccttggagatgattaaatttatatgttttggtatctgatgtctactaaagcatgaacacagtgtctctggggatttaaacttacttttaaggagtattaacacaatccatcatattcacttcagagttttttttactataatactataatgtgctgaatcagctttgctgaatctaacttctcttgaatagctttattctatttcacaagttctaattttgttgaccaagatgacttgacataagtttaaatatcttttggcactgatttctcttttataaacttaagaactagaaacttcctgggagaaaagttccaaaatcatttgttgattaacactgcttttctcatcacctctaaaatatatcagtaataagtagtttgcattcactgactgggataatcatataattattactatatatgtaaaacattgaaattatatttgaaagatttatttcaatcagttgtagttcttgtgtctttttcttatcaaacaagtaaaatttacctttttaaataacatctagccacaattgaatacaccttgtttagcctattctcaaacctaataagacctctgggataatttacacctggcttctttaaacctaggcaaaatatttttttacatattatgtattcaacaaacataaatagaaataactcaagtttgaatttatattacatatgtaaaaagaaaatgttaagaaatataaacataattacaggcaaacagaattcccttagtgagaaacaatattcagtactggcacgataccctataattactgatataagaaagataagtcacacatattaatatgttttactaaatcatgtatttattaaaacgcatgaattctgaaggacatatagtatgcactattttgttagcaaactataataggtcttaaaaatattcttttaatgttttttaaaaagtgcatttcttgattggatgtatttcctgtcaattaaatcaaaataaaaggtcatgcaacccaagagaaataaaactctatatgaaagggtataagagaagcctcaaaaattgtctggtgaaaaatgccaaaggattacttcttattattcaagaatgaataaagaggaagaaaatggagagaggaaaaacatgaggttctaatgaagattccatagaataaaaactggctcacatggcacatagtagaagaaacatatactggtgaaaaagacttactgaattacttcaagtgaaagtaaaatgtgtacagcatatgctttatatatttaacaaagcatataagaatatgaactttacgaaagaatataagagaacagtggaccaagaaaaagatggaactggataaagtctagatataaaggagaattctgtgaggtcacaaaagagtgatacactttaaatagtataatagcagaataaagatgacattggaaacaaaacaacagaaaaaaacaatatggtttggaaattaaagtcagttctgtggaagacaagtttgagattctttcttaccctgaagaggaaaaatgatagaaggtaattttgaagcaaaaagtgaaaatgcaacactgaaagataaaatcaaaaaagaaaactggagaaccataaggacaaatatccatgaattattccaaaataaaatactagcaaattgattcagccttataaaaaaaagtcagtggtctattataaagtacattttatttctgtaatatacgattagttcaacattatggaatgcattaatataacctaacacatcaatagaggaatagagaaaccttagttgaatattttatataataataaatgtgctgattatatgagaaataatatatggtttacatactttaattctcactaaaaacttatgctagttatcatcatttagttaccatttgcctgatgaagaagttgagggaatgagagatttagagatgaagccagagtcatccagctgtgatataaagaatgcagtttttgcttaaaaagtggatacccatatttatatacttctattatatgcatacatgtggtcttatgtgtaaataattaaagaaaatttctttaaaaagttgaaggataagctactctatatcatataacgatacataagcaggtaaatattttttaaaggctaaagcaacatacaccaaaatgttaagaaggctaccctctgagtgatttaatgataatgttatattgtcttttctgttcattagaatttatgtagcatattcatataaataagtttatatactacattatatgtaaagtttatatgtatattgtgaagcgtatatattaacatattactaatttatatcattatctgtaatcaaaatgagatcatctaaaggccaaggagtagtaaatgatatcagataagtcctgttgccctaaacaagcataaaaatgggcaaaatatattagaaaccattttttagagaatagaccaaaaaacagggtaggactgcaatggatgagaaaagagaaactaatggagtgatctccatgacagtcaagttctctgcctgaggaaaatttcctgaccttgccacagatcccagaaattcaagcagaatgtgaagatcccagtcagtcagaaaacaaagattagtgtactgtacaattgatgtcattggaatctgtgggtcagggtaacagaaagaaaaaagatatgcagggttgaatccaaaagtctgtatggggttccctcatgactatttgctgaaggctagactgtacatgtagaaaactagaaaaaccaagacttataatacagcaacctttgtgagattgacagcacaacaaaggtggggagagcaaggagacctgagaggagagcagcatggaatattgaagtctcagccatgaaacttcatgagagtgtagagatctcataaaacccctggcagcacaatgaaaccagaaaggctagaatcatacttgggagaaaggccttctctagacattctccaaaacagcctaaactaaatgcaagccccagtaagattcataggtaagacagatttagagattgagtcccataaagttagagaatttagggcaacaattttggcttttcacagatctgcattagtagtggaaaaccaagcctatacaagttcagcatggtcaatttataactgaacattttgctataacaggagccaatagccttctgagaaagattacagctgaagagtctctataatgttctatctacaatgcccattactcactgaaagtaactagatatccaaataaatagaatatatgattcatagccataaaaagttaacatcagttcgtagaaaccaaacttaagaaagttagactttggacttagcagatagaggctttaaagaaggtattataggccgggcacggtggctcacgcctgtaatcccagcactttgagaggccaaggctggtggatcacgaggtcgggagatcgagaccattctggctaacacggtgaaaccccatctctactaaaaatacaaaaaattagccgggtgtggtaacaggcgcctgtagtcccagctactcgggaggctgaggcaggagaatggcgtgaacccgggaggcggagctttcagtgagccgagatcgcgccactgcacttcagcctgggagacagagcgagactccgtctcaaaaaaaaaaaaaaaaagaaaaaaagaaaaagaaaaagaaaagaaaaaaagtattataaatgtgttccgtgaaataacagaatgtgctgaaagaatcaaaggaaataaaatgcgtgaatggataaagaagttcagcagagaaagagaaactatactaaagggctaggactaaataagaattatactacaaagtacaataaacaaaaaaatttactgggtgggcttaacagaagactggagatgacagaaaaaaaaaagtcagtgaacttgaagacaaagaaaattttccaatttgagaaaataggggaaaatattgaagaaaaataaacagagccataatgacctatacaagaatatcaagttacattatatataagtacttttatatatatgtactttaatatacatatatatttaaggatttatatataagttaattgtgcaaaagagaggaaagagacatgtggcagaaaatattgttagaaataatgggaccaggcgtggtaactcaagtctgtaatcccaaaaactttgggaagccaaggcaggaggattgcttgaactcagttggagatctacctgagtaagatggagagaccccattcataaaaaaagataaataaattagctaggcatgttggggtgcccctgtagtactagctactttggaagctgaggtgggaagatcccttgagcccaggagtttgaggctgctgtgaggtgccatggcaccactgcacaccagtctgggtgacagagcaagaccccatctcttaaaaaaagaataagataaaataaaacaaattttaaaaagaattaatggaaaagacttagaagaaactcagcataaccctgagcaagatgaatctaaagaaaaccgtatttacattcatcacaatcaactactgcaaaccaaagggaaattctctaaagcagcctgaaagagaaagaaaagcatactatatacaagacaaacaaaaataaatgatggtttacttcacattagaaatagcatgcagaagataatggaacacctttaatacgtggaaaaaaaacccgcctgaattctaaacctcacaagaaatatgagagaaatgagaatatttttacttaaaggaatcagagaaatattgtccctagaagctcaccactgcaaaaaatgctaagggatgccctttgggccatgggtgccagattgtaactcatatctacaggtagaaatgtaaaccaccagaaatggaaataagtggaaattgaaacgccatatttcctttcttcttataatttatagaaaatatattcatatctggctcttaaaaaatagtaccggaaggtaaggtttacaatgtaaacaaaagtaaaagatatatttgagtaaagaaatggggcagataaatgaattataatgttgtgtaaggttgttacatttgtggagtgagatatagaaagtgaagtgaataggataaggtaatagtggaacatctgaagggagtttgaattatgacttgtagatatgaagaagtaaaatattgactctaattagactctgagaagttatatcttaactctaaaataatcactaacgcatagtaaaaggagataaagttaagtcagtagagtaaataaattgaaatcttaaatttttatttttttataaatcctgaaaaaaatcagttcctgataaaaaggaatggaaggagagagggagaaggaaaaacagaagaaagaaatgcaaaccaacaggatggtatatttaagtataaacacatcaatagctacattaaacataagtaaactaaacattgaatttaaaatgactaagaaaacaataacataaatatcatcaatattacgcttagggaaactcaccaaacacacaaaaattatataatgcctaattccattaatatgacactctataaaagaaatcattgattagtgatagaagcctgattactagttatctagcaaagggagggtggctgggaagataaactacagaggaaagtgagaaaattgtttgaggaaatggaaatgttctgtatcttgaacattgatacaatcaagatgcattgattttatcttgatcaagtactaacattatagtagacattagtctaaaactattggcctgaacacatagaaatgaatgaattttattgcatgtaaattttgcctcaatacagttgatttttaaaattatctagtaaaatattgattgcctagtgattaagatgtaagactctgaaactccctgagttcaaatcctgcttgtgctattttcttactgtatgacatagagcaaattgtttaacccctctaagttttctcatctataatgtggggataataataataagtacttcataggattgttgagaggattaattcctcatctggagtaagtgtttgatatatatttattgtattaatatcattatcatcattaatatcattactgtgtacagcacattaaactattgaaagagagatatcaaataatgagataaaagctatcttcattttattttccaataactcttttagaagaaaaatgagacaggtaaaaatcaaactgaaaaaataagatgctaaatgataatataagacgacagaattagagtccaactctgagcaagttattcagtacatgattacatgctatgttaatttcctcttgctactgtaacaaataacaaatgatcaccaacttcatgatctaaaacaacacaaatttattagcttatcattctggagaacagaaatttaaaaaaagcattctgggcctaaaatcaagatgtcagcagggctgacttcttctgaagctccaggaaagaagccctttcctttgcctttactagcttcaagaagctgccagtagtccttgtagccccttcctccatcttggaaaccagccatgtaacatctctatctctcatggccttctttcctgtatcaaatctccctctgcctctgttttataaagctatatgtaattgcatttaggactcaccctaataatctagaataatctccccattgcaaaatccttaaatcccttttgcaatatcaggcaacatgcacatgttctagggaattaggagatggttacttttggatcaaatgtcaaatgtcataagagcaagataggaaatgagaggagaagagaggacaagacactagagtgttctgtaaaatttcagtttaaaaagtttacaagtgtttggtcaaggaaaaacaaatttgaggtgaaaatgaatatgcaaaataaaattttattgtcatttttaggtgtcttaaatgtttatctacgtttgaaagggcaaacaacaatagagaatccactgtggtcttcaagtgggaataaaggacaaagatggaatgaggctcatgttaatatatacccaattacttcatttcaggtaagaaaagtagttttggctaattaattgctgtaaatgagcataatattaaaggtggatcttgagcaaatattaaaatatgaatattcagaaattccacgatataagcatcacaaaaattatatgattaggttttgctttagttctaaaagctgttttataaagataaatgcgcttttcctttattcattaatactcatcaagtaattggtttgaataatactttatcaaaatttaaatgattttcctggaaaaaatgtaatccatttctataaaatcacatgcttatattttactccctgaaaaaaaaattattataagtttctataataatggaacttggtaatcaattctcaatctgtttgaatttttcttgattaaattttatatacttacaacaaaaagttccttctgatttaatgccatatcagtaattgatcagtgattattaaaattaagatgactttaaataagttatttttctttgtttctatatagaaaagaagtaaagcttagagagttagctaagagagttaccagtaaagatatagaaattgtaaagactgccacactggccatgatagctagagacaacagatcattaagctatttcagtggagttaatatactgtttaatgattttaatgtgtataaacatatatacatatataaatatatacatatccaaatatttttatattttaaaaatatggtaaaatatcttcaaagtctatgacatatatcttatacagctctatgctttatttcaaaagaattcaaatctatttcatgacattatatttatagcattgaatctactagtgattttttttatgcatttcatggcatatgttgtaagggtatagaaaatcgtgccagtttttaattggtggaatgaccttttcttgtaatctaatctataaattctaattgctttggagattgcacttctaaatcaaaccaggatgataaaaatacatagtcattcacaatgataaacaatcagagagtaagactggctaattatctacagatatataaaagatttattcccatatgattctgaaaaataatcattttgtttctatgaagatcaatacaattgtgaaaatgaatgacaacatatcatcaaactaaattaaactgggaagacaggattccaaagtattactgatagaagtaaccttaatattaagatgtatatactgatattgtcattaaaaagcaatttttttctaaaaagttgatattattatagatatactttcactttccacatgactgcctctccaacacaaaattccagcaaagttcacaataaacaaaaataccaaggtcataatataccacacattttttgaaagatttccactgattatagcatccttgttgttttttttttagaacttttcagatattgtaccatactcttcttgtttgcattgtttccaggaataaatctgtggatagccttaaatttattcttctgtatgtaatgtgactttttctctgtttgcttttaagattttccttatcattcgtatttataaactgtattgtgatgtgctttgatatatttttcttccttctatatgtgctttgtgttcactgaatttcttggatctgtggatttatagttttcataaaatttgaggtttttctcctcttctccttcgaagatttcaatcacacatacataaaattgcttgaaagtgtcacacaactcattaaggcattttcatttttttctatttatgtttaatttgtgatagtttttattatgtcttcacattcaacaatagtttcttctgcaatgtctaatttacttttaattttattcagtgtatttttcatctaagtcattggatttttcatctctgtaagttcaatttgaatcttttaaaaaatatttgtatgtctttagttaatattttgaatatatgaaatccagttataataaccattttaaatcattatttgctattgctaatatctgtataagttcttggttggcttcagttgattgatttttcttctcataatggatcactgttttcgttattttttttacaagtctggtaatttgattgggtaccagatattgtgactgttaccttgataggtgctgcatatttttgtattcttataagtattcttgagctttttcagggaagatagttgagttacttcagaagagtttgattattttaggtgttgcttttaagatttcttaggcgagactagagtaatgtttggtatagggctaattatttttcatgatggaggcaagactactctgagtcgtctaccaaatgtcccatgtattatgaggtttttccatgtggtggatgggaacagtcaccattcccagtcctgtgaatgctgggcactattaactcaaattcacccctctgtttctttcccaagtattgggtagattgctcatttcatgtcctgatcagtactctgctgaatactcaaggaggactctctgcagtgctctatttctctctctctttctttttctctgccactgtttttctctggtattctgccctgaacattccagcttcccttgtttttttgaactctcatctcctcaactcagattttctaccaggtttcaccttcttttcctctacttgcaccatggcctaaaactttgtattggtcaagagaattcaccttatttgactcccatttcccagggatcacacttcttcattatctgatatctagtatcctgaacactgtggttggcccagttatttggtaatttaaagtagaaatatagccttgttcctgttactctatttttcatggaaacaaatggaacaatctgtatttgtaaatagtttgaattgatgcatttttaagctatttaaattaccagtggaaaataaagatagataaaatcatcttttcattttgatcgacgctctttcatttcccaacatatttctaggtctattggctaaggactttatttcattaatcttgattgttcaaggaaacgtgaaacacaactaaacaatcccatgccacttttgttgtttttgtctcgtttcattttagagaaatttgttttgaattgttttataaaaagtttttttttttacccaaaaatcttttataacttgtcaaacttctcaaaaatactttatttggtatgtaacgtcttctaggaactcctgataacaacaatgataccaatatattactatataaattaaggtttgagaggttttaatattactcaaatgtaactttctggtatttgaggatgtatttacttcaagtggacggcacaacttttacctcttgaaattttacacagaatataagtgactttgagtctctttcactagcatttacactgttttatttgttttgagttgcatgactttaaattaatttgatccataaatcctttataaaattacttggacagtcctttgtttgagtgtgtccaattagtttgcttagctgaaaatacaattattgcttagtacttttcaagacaagtagaagttttattctattgaaatttatgttgggttcatttactagaattaacttagcatgatcagtgcttgggatgaaaacagattttgctacattgggaaaaattagggcaacaattccaaagaagcaaaatggatatattcttataatgtcaatgaattttacatcatataccagggaaaatatttaaccatccccttttaatgctttacttctttcatagtatatttcaaatgttttccaggggtaaagtgtacaactagattgtgagacacaagatgctctttacgttttcttagtttaagagaaagggattctggaaacctcctgctcttacatattcatttaaagacttagaaacaggttttgagaaatttttgagaaaattaagatacaaatgcttaacactgtaacagggactggaaaagagactatactgctctccttacatcatgctgccttatgttccaactaagaataataataagctagaaaatattgtcctcattagtagacattacatgctcatgtagcatatctggcattctaagccacattccagggcaattatatggacacaatggtggctcctgacttaaccattgaaaacatttaccaattgcagctcacaatttgatgcatttctttgtctttcccaacagtcgactctcatgttattatttaatattagaaatgttgacaactaattgacatttgtcccacaagatgaactggcagagtattgttaagttaaactcactgttcatatttgggtagtttccccagggaaaaagccaaggctacccactatgtctattatgctgtctctcttcaaatttgttttgtaatggttgaggatagttcaattatttgctaaaccagtgataaaataaagataacattattaatgctaatggttatttttaaatatatttatatcctgaagtttttcaaagtgacatatactgtcaattttcaaactgcagtcttagggttttgcatttgccttagcagtaatgattagaagtgatttgccttttgtcaggaagaaactatgttgtaaatatttgcagaagtcaccattaacaatgaaggcaaatcatcagaagtgcattgtattatttaattcccccatctacttttacacattcgtgattcatgtagctcttcttttcttgctgagaaattacatttgacacatacttttatagcatcatctatatctttattttgacatctatatttatatgttttaaagcattataatgtatgtaagaaactgtcaattaatgaaacaattttgtgaggtacaattctaatacagaaatccacattaattttttagaattcccgtttgaatttacttaccaaaagttaattttctgattaggcaatattttttgtatgttaaggttgcgaagttgcatgaacacactgtgaaaacatttcagttttaaacttgtcatttcaattaagggaaataattttaaataatagtgctattgtgcgggaggaacaggttttgcataattttatccctcttttaggagacctaaactttcacattttctccatgggtacctagttgctgttagttccttcttcaagttagttaaaccaaatgcatttcagaagtactgaagaggaaacgaaaatggttttatctctgtaatgtaatagtagtcaaaataatgatggaaataaatgatggaaatgatggaaataaaaatatgacaatttaactctttaaactagagagtcttaattctcgagataaatataattaagattttttgttgtgtaaagatcacatcttctatggctaaatacatcatattttaatgcacttataatttctcatctgtatattctagaaaacgtcagcaaagatttatttttacaaatgcttaaaagtttggctaaggcacattacttaaatttaatatctacactttatatttgtctaatctaactcacacagaaaccatgtcaagtaaaacatgctctctctagatcttagtctaggagtcatttatgaatctgtttgaatctataaaatttaattaaagtaattcagaaatataattgtagtcaagagctcagagcataaataaaacaatgcaataaatatttattggtgaaattcaacctgttaaaaaataatctacatctttgtaatagcaaaactgtggaaattaaaaggaaacaaataaacatgctacacaggacctttcttttcctttctgttcaaaaaggtccttgtggaagactgcagatttctctggcctattaaaatagattctttatcatcacaagattacaaataaatattaaaaatacaaattatgactgtactaagagttttattgctagaaattatctttatcataccaataaataactagatttatttaaacaaaatgtctaaaattcctgctatgcttaaagaaattaccttgctttatcaatgacaaaatgtagtatcaataattgtaagtgtaaatgtaaataatatatttgcaaatcagcctactttttttactgtaccacttcattcattcggtatcaccaaggggtgaaatattcatataaggtaatgttctaagtataggaagccctctggacacgtgacgctttgatttttgttgattgctagttttgttgttcagcaaaccacagacttacagtcaacatattgccagtaggtaggtagcacacatattaaattacattagtcaatccgcttcctgatgtttactacagatggtttcccgacacagtctctcaatctgactacaaaagggtctgtctttcacaatttcactgctctgggacttttttttttttttttagcacaagcctaggtccaatcttttgattttgatcaagctgcacagggaggcaggaggacaggatgaaaaagaaaattaatataaaaaggaggattgtttaatcctttaaaggcagtagtaggagaagttttgaaatgctttgaagtaatggcaggatcattgtaattaaactatggctttcccaggacagcagctttgaaaagttcagaaatgactttgacgacatgtatgttttagttttgatttttaaagaaatctcaccattttatatgactcccatctggaagtaacaagaacttactaagtgaaagcaattgtgtactttgaataagaaaaagtgtattttcttcaaactttttacctttacatagctaagataggaaatccatgtactgcaattttgttttggcttcagtgatacagaacactgtggatgtttttcaaacatccttcctaataaaaggattttgacttcagctttatctgtgtaaatttcaagtgcgagcaggtgcagagcattttaacccacctttattagactcttcaccacatctcacttccccacataaagcccatgggaatgcaaaccccttatctttgctatggctacattgtaaaccctgtattgcactctacaagcagtatttaatattaactattgatttactctaacattgactctctatcaggtaagggacacatatcaaagagggaaaatataccccaagacttaaaaacctactttttggaaaaaggaaaatattttctcacaggtagtttgctcatacgggcaatttgtaaaggctttaaagaacaatgtgctttaaataagtatgaataataattatttgaaacgtagtcacctcagccttgttcataataggagacaatagttttaatgtctaacgatgactatagggtactggttaaataaattacatccataatgtggaatattctgcaccttaaaatgacttccctttcttcatattcaattctctcaaatgttcataccgttcatttttttctaaatcctttctcatagaccttttaaataaaggactgttaaaaagtcttctgagactttttaaagccacttcccagttacctttccagacaccatcctatctcaaatggaagtcatcatttccaagcagccaaaataatacttcattgtaaattctatctgaggactgagaatttgctaaactgctaacttggttctaaatatttgaactacagctgccattttgttttggcttcagtgaaacagaccattttaaatgtctttcaaagagatggctttggagaatctttaagaacatgcttatcttaacatagataagcaggaaactccatatttatcatatctgtatatcagtaagaactcaaatttttctctgctatcaaatcatgaaaattattatttgtttgatgaactacatttaagtgaaggacagggtctcaatacaaaagttgacaactgatgcctctggttactacctggagattcccactgataatattatgagagcatatcaaagaacattggataaatttctcaaaagtagcctaagttctctcaaaatcatcataattaagctatggctttcccaggacagcagctttgaaaagttcagagatgactctgatttgcctttgaggagatgttttcaaataaaaacaaaaacaaaaactttggcattgataaaaataaacattgtcagatttgttgtgatgacataagtctagaaatgttattaataaagcacattaccagattgatgttagaaacagctctttattaaactattctttggaatgaccaaagcagatatttccttttaacatgtaaatatttttctagaactgtatacccaccactaaatgcatgaattgccttacagtatcaaaaagattaaagttttgctgaaagcaaggaataatttgggagccataaagaaaattctaaaagagtcctgtttctgtaaaaataaaaaatatataaatttgctaattgtgcttctattgtcattgttttaagtatttaataataaaggattctgattgtactcatttattctttcaatattcatgcactgagcctcagtgaccaccattgttatagacaccataaattcaaaggtataccgtgagatattcaacataaatagactgatacatatcttcaagtttaaaaaaatggaatatcagcagtgaaatcatggaggtaaattataaagtcaacatgggaatatgacgaacctattcaatctatttgtgagaaatcaatgtcagagatagaaacactttgttccgggcttcaatatacatattactgttgtaaagaattcagaattgattcattctttaaaatatttctagaaaactaatgttatgagttatgttcagataaaaccagaaagaatctatctcagagaaagacttttcaaataaaacattttttcttatccttaaaaattaaaagaggatgtgtagtcattttttttaattgtattatttaattaagtttagttttgctttaaaatcgacacagagcttttgatgtgaaaaactaatacaatgcaaggaagattcaattactggttttgggatgaaagtttatgttttctgcaagttttaattttgaaagccatcaaatataaaagatgccaggattactgacaagtttatttttgtcaccttgatttctcaagagaaactgatctgcaaatcaaagctccacatttaggtttgtttcattcatatttgtagctcatttttgaaggtatccgaggtcctggaatagaaggtgacattgctattgatgatgtatcaattgcagaaggagaatgtgcaaaacaagacctagcaactaagagtaagtatctttgcttgagattggtttgttgtaacgttaaagtaacattactattaaattaacatttaatttaattaattttaaaaacggagttatttttagttggtttatttagaaatttcttatatgtaataccctaaagtttgttcagttatttttaaagtattaaattcaattgtagacatatttggcctaagataaaatagaagtgagattttgatttagatctacgtaaggcaagtacactttgatttttaattaagattttaaaacactttgatattatttgttttagaagatttaaaaacttgtattaaaatatttgatgaacctatatacatagcacatatttacaatgtaaattgtattagtcaatcttcatactgctataaagaactgcccaacactgggtaatttataaaagaaagagatttaattgactcacagttcagcaaggctgggaggcctaaggaaactcacaatcatggcggaaggtgaaggggaagcagagtaccttcttcacaaggcagcaaggagaattgctgagagaagggggaagtgccccttataaaatcatcagatcggccgggcgcggtggctcacgcctgtaatcccagcactttgggaggccgaggcgggtggatcacaaggtcaggagatcaagaccatcctggctaagacggtgaaaccccgtctctatttaaaaatacaaagaaaaaatattagccgggcgtgtagtccctgtagtcccagctactcgggaggccgaggcaggagattggcgtgaacgcgggaggcggagcttgcagtgagccaagatcacgccactgcactccagcctgggcgacagagcaagagtctgtctcaaaaacataataataataataataataaaaatcatcagatctagtgaaaactcactttcatgagaagagcataggggaagagcccccatgattcagttacctccacctggtctctcacttgaaacatggggattatgcggattatatttcaagatgagatttggtctctcccttgaaacatggggattatgcagattatatttcaagatgagacttgtgtgaggacacaaagccttaccatgtcagcatagatgctttcattcgtccagtttgtgaatatagtgaatatatttcctgatttagccaatttttttttttgagacggagttttgctcttgttgcccaggctggagtgcaacagtgcaatctctgctcactgcaatctccgcctcccgggttcaagtgattctcttgcctcagcctcctgagtagctgggattacagactcgcggcaccacaccccgctaattttttgtatttttagtagagacgcggtttcaccatgttggccaggctggtctcgaactcccgacctcaggtggtccacctgcctcggcctcccaaactgctgggattacaggcgtgagccactgtgcctggccttttgccagccattttaacagattcagcattgtaaagagcctaaatacatatattaagtaatgaagtagacctcatatttatggtctaatctcctatctgcaccacaagcttgtttaataatttgattttcactttatacccttttttgagtattatggtttaatgatatatttaattttatttttttgtcacaggtccattttataatagaagagatataaataaaacatgatgaataatgcacaaagatttagaattatgtatttagctgcttcttaaagtcctcatctccatatttcacattcgaagctatgaaatctaaaatcattcctgttaaaaatgactgcaattgaaggattatcttagactcatctggaatcttttattttgtggtcatatatagagaaagtaatcaaactaaatttacacaaattactcatcaattatttagcacatacaaaagcatgaaaatctatgttgtataaatctagagcaaatcagagtctttggtaattttctatatttagtgagaaactgtaccagtctagatgttgaaagttgaatgtgtacaattgtccactgattactcatatgaactgaattgactcaattcttaagtattgtcaaaagacaaaaactaagatttttatataacaatgagccattttgctcattgttatataaaatgaaaatatattaaaaagtcataaacttagtatttcaagtaacatatttagtaaaaatgtatccttgtgtctgtctagttctgctttagaaaaccagtagctatactcaaaagaacagtttttctaatgcacaggaaaacatgtattctcctcaaaggagaataggatttcttttgaatttcatagtatgactgagtggcagtaacattttattaattgaaggcagttacaactatatacagaaattttacattttcataatgtaagcacaaatattataaataaattcaataaattgaattaaacttttcaaaggaagaaagcaaaggaaattatttactccctagtgcagaaagaaagcataactgataaaactagccacagtaaatgcctgtgaaagcccatagggacttcattactgtacaagttctattacaatagaacatttttataattagttttttttttctcttaaactagcaaatccaagaaatgtgtggcagttttaaatatgaaaacaccccctgtatgtattgggtgtatttatatttaaactctataaattaggggaaataaataatcttaattgaacacaaataatctatttggcatcagaaagttttctgttacatttgtgtcatttaattaccatttattaagttcattttatgactagcatttgattgattgatgattattaaatgaatattatattctaagtacagaccagcctgaaggctgaaagcctcttcctgattcctcaggctgccagttctttccaggcaataaatggaactatggtccacaccatgcagatataagattgtatgtctcaattttcaaactcaattctcccctagatacaagccactttgcaactttagctagtttaatgaattatatctgtgttatccctccacagtaaggcatgcattctaagaggcatcaactggacaccaggttttaacagaaatcccaattacagtaggactttccaggccgattggtggaagggattttttagtttgaatggacttcatcatgcctctaaaagttaaaataaagagaaaattatttgtataatttatagataatggaccgatctaaacatggatcatctactagttgcaatagttaatttctgtacacataaccatccctttctagttttcattaagatagattttctttcagtcttcaagcttatccacttcgggaagcttgaaaaaaaatctactttttgaagtattctgataattttctccatgttcctgctttcctgtggctagcagaactcttaagattgagctcaaccacaaacctatgtgaatatgttatgaacaagttttcatagcatattatatcaattcaaaatctgtaaatctttttatcaagtgccttaaccatatattcattttccttttcacttcccttagcaatgaagctgataaataaaacaaaataaaaataaatattttccagaaatattttccatatacttgttttattattcaccaaggttgtgttagtagctacgtggaatgcttattattcttctttttttgtttgcatttattttccttatctttagattccgttgatggtgctgttgggattttggttcatatatggctttttcccattatcgtcctcatctctatcttaagtcctcgaaggtgaccttatcctggcagaggctataaaagattcaccaggcactggcatgaagaaagagtctttgtaaatggacattgaacaaacaaactaccaaagattcctccactgactactgactcaaaaataaaataataaaaacaaatttttttaagcactggggataaaaagacatcatggaagtataacttattccagactaaacataaaagataatcttgacctgagtagagaagagaccttcaggtgcttttgtggctaaaaagattacagcgtcatctggttgaactctggaaaaaaaaaaaaaaatgaaaaaaagaaaaaaaaaagagctatagaaatccttgtcaaagcacaaagtcatggctggttttgtttcaaatgaatagtttgcttgttaccatggaaacctaatggcctgccaacaaaaacctcactgtaaacagggtacgtgaagagctggcatttattttccttacgagaaggttttcgtagagaattaaataaatgtaggcccttttacctttggctgttacccttccttgaaaataacccgaactcagaattatttaaagcattcatgtttctccccaccttatccccatcccacctttattattattatttttctcccatggctaagctagataactgtatgctgtctctttttgcatgcactactatccaggatggtaaacctgggcttacatgttacacaggcttatcggagtttgcttgcggccacttgaacacccaaactacgtcatctgttccaatgaagaaaccaaaccaccatcttttataaattgccatggaaaccaagtgccttcaatgaaacaagcctgaataattttcaactcagaagcttgcactgctaagagtggtttgtgtaaaactattttataaacaaactacagagcctaaatgtgcaaattacaggcaagacaacaaagccgcttctgaagaagaaaggaccgaagctgctgcgtaagcccatgcagacaagatatttgttgtttaacctcctagacagccatggcctttcggcttattgtccattagaaaatcacttccattgagaccagacatggagcaacactttttttcttccaggttattaaatgggtcaaccagagcaaaaggttattaagaatacttagtgcagaaggtggtaaaacacaaaagtgatttttttactctaacctccatttgaaatgaaattggccctagctttagagggaacaagaaaatgtttgggattgcagtgcatactaactctacagtggaactgggcctgaaaaatctggctttattctaaactctgagggtaatatgcctctgccctttagtcagactctgtgcaaattgtgaaatattattttattattttaccaagattataaaaacacttttacaaaaaaacaaaaacctgtaaaaataattttgagctacctgacgacaaatcatatctttaaccagccagttttccaatgcattgtaaatttcacttaaacctgttggttatgaaaatttgaagatcattttccttaaattatctcagcttttaacttcatttaaaaagacttttgtctaagaagaatattattattatatgttctttcaacaccccaggattaaaaaaactgattatgcaagcaattggaatataagtattaaattatagcatttgcaaatattaatataaaagcacaacaaaatgtagtggaaaatgacaaagcttgttttttaaaacaattctgtagaaatgtttgtgcaaattcagtaattcaacttaaaatataattttacagctatgttcaataaagcctctttccaggtaaggta

SEQ ID NO: 106 - DNA, 159168 bp, Homo sapiens
tgcaggatgagtaagagatacttacagaaagcaacaaaaggaaaactgctaataataatatttattgtaaccttgtgggggaaagttgtatccagtgcaaaccatcataaaggtaagcttttctgttttttttttcaactaaatgtggatgatgactacccttaacacagactgttatgttttgcctccactggtctgttaaattttactaggtatagattctccccctggcagttttctttaagtaataatgcagtgttatctttaagatggctttgatagagaaagatgatattttcaggactaatgccatttctgtaaatagtgttcaaagaatatggaaatagaactctacctttccttcaatttttacctaatgctaaatgatgagttaatgagtgaagcacaccaacatgacacatgtatacatacgtaacaaacctgcacgttgtgcacatgtaccctaaaacttaaagtataataaaataaaataaaatttaccctggcttttaaaggaaaaaaaaataaaaaaataaaataaaataaaaattgagttggtatataataaagataagtttcagattgcacttatcctggtaaagaaagtgtctgtaatgatatgtatctcaataatatgtctatatgtaaattttctttcaatgttttttgtgggtcatgattctttatgtcagaggaccactttgaccaccacttggacactgcccagtattcagcaggctcaattctgccactgaacagagtgagaatatttgctctatacatatgtgttaagcttgacaactcacaattacattctttctgccctctttcttggccataagactcaatataatgaacaactactttttccatggggctatttctgaactgtccctattataattaagtattcataacctgagaaatcaatttagatttttctgtaaaatatgattttataatttagttctctgcccactataaagtctagagactaacaactaagtttctcattctatttttgggagaagggggaattaagactggtttgaattctgtaacacttaaattagttacacatgtccgtttaattagcattacatggaacattaacaccagggagagaaaagacatggtgtgtgggactgacacttataagactaatctcttccccctgtatttaaaatcaaaaagggacatcttgcaaaataaaattttatgaagagtttcttcatatttcgttatcctgttttctacccacagtatgttttcgtgtgtgtgaatatatatattcatatattttttcttctccttttctttaatacagcacactgatccacaaatcagactttaaattctctttaatatttttatcagtgtaaaattaaaaagatgatgaggaggacattccctgtggtctcaaattggcagcaaccaacaagaccaaagaacgaagtagtattaaatactcatcttttaaagagctgcaatccagtagggccaagccctgccgtggacttaacaagaaaacactccccatcctcattattctgttggtcaccttagtgccccttcccagcttatgaaagaagaattggaggagtgggggatcatagaaattgtgggcttcagcctagcacagcaagtgttcatgataaagatactttcccctgtccaaagccaaatgatggggtctcttagagaatcactcataaagactgctcacactgtatattgcatactattgttaaagctactttaagacatttaaatagtgttatgttctatgctaactctgaaactaagatcttttctttttgccaagaaaatagtccttgaacataataaattacacatcgtgtcagaaaactcaaatggtcagagctggtacattacagaagatagagtttttttgtggttttgcttttccctttccacactgccaccaatattttggatgaagattttatgaaagttttctcccctcctccatctttcttccttttgttcttttttctttcttttctttttattttctgtacaaaatatcctttttgttttgagctattttacacataaaataataagggttgtgtatatgtaagttgtagcgcatgttcataaaatgattactagtgtgctcaccatccaagaaaggctgggctgctatctccctaggtacaaagcccagactttggagacccctttggtgtatctgacctgtggaaggatatagttacattctaaatggttaaggtaagaacctaggatcctttccacctcatttcaaaggagcaaaagatttttctttcctttcaggagggggaggggaatggttgtctctcttctatatataaatgaaaagaatccattgttcactgtcagtcatctatggaatgtttggctaccaatgtgggacatttggcttggctttcatcagggttaaggcttagggcaaggcaggccagttcactttctatttattgtgaattaattagtaagatatcagtttctgacccagaacaccttggtgagcattcaagataaaaataatacagatgaatattagaaactcaacagcactaaagagcattacagatgtcaactcatttaatctcttaaccatctatgtggtacttttttttttttttttttttttgagacggagtctcactctgtcgcctaggctagagtgcagtggcgtgatctcagctcactgaaagctccgcctcccgggttcacgccattctcgtgcctcagtctcccgaatagctgggactacaggtgcccaccaccacgcccgactaattttttgtatttttagtagagacggggtttcaccgtgttagccaggatggtctcgatctcctgacctcgtgatccgcccgcctcggcctcccaaagtgctgggaatctgcaagcttttgatagctttttgttttcactcatgtttttgggtttctctttttatatcttactacatatatagttatagaaatatatggtgtgtatatatagaaatatatatatacacaccatatatttctatatggtatatataggtatatatatatagaaatatataccatatatttctatatatttctatctgatgatcctattttatgcaattttatgttttcctcctggtgactttcactcatggtaatttatttattttagggcttctgacttttaagaaaaattttgtgagctgatgttcatcagaattgtatttgtaagaattttaaaggcctgtcattataatgtattatttcagaggcaatttgcgtatgacatgagtcttaggcagggttttttggaagcggagccaagtcaggaattcttgtttacgtgatttattgaaagagtgctctcaggagaatgagagcaagtgaagcaggctagagcaggagataaaaactaagcacaaatagagtctcagctggagaatcgcccagtctgctcctatggggaatctccgaggcatgaattgctccacagagatggtccctccttgaggcaagatagatggcctcgtctacccttgtgtccattggccattagctactggcctgttccccatggcaaggagtggcctctctggggaagtggctcatctttagcagaaggtaagtctctaaagaagggggcacctgtgaactgtgatcacagaacattcacagcaagtggaggaaaggtgcacagccctgaaagattttggtagtgtatcagcagctacgttctactgcagtctactcctcacagccctcagatccacctgcttctcactgaaggtcaatccatccaggcaaagcttattcaggattttggttggtcagaatttccaagaagacttacttgaagaggaatagtaagagtcccactaatgcagttggtgctcatggtctgtccaccctacccccagccattctagattttcctctctttttgctagcacttctactcatgtaggaggctttcctaatgttttactaagagttctgagccctgggttaccattctcttgctgctgtacttatacattggtagttataactgggcacaggaatgccacaagatgcccctgtggatcatctgtatacctaatatattcctctctgcctctagtgcacagcggctgtcttcttcctcatggtcatcagggacctttacatttaccccatcaacattgaactccttttctctctctctctggtctatcagtgtaaggagcacagactgattgatgatcaggcaacagctgtagctctgtgtttagtgtcactgctactgtttcctctggtaaacgtatcccctttctgggatatgctagacccagagcatagtaaattggtcatttcagttggatatttctcatggaaaagttgcttgtttacttaatgattgttgagtagctacattaaggcctgagaatatagcaggtacagaaaagagacaaacatctttgttttcatggaatgtttattctagaagtggaaaaataggtaataagaaaaatacataaaatgggatgttttatgatataaatgctctggaaaatatatgaaggaagaaagcatataggaagtattcaggagggaatataatttttaaatagccctttgggtaagatctaaagtttccagtagagtcagccagtggagtattcagggaaaggatgctccaggcaaagcagcaataggtatgaatgctttcaagcatgccatagagaattagaaatagcaaggaggatggtgtgcatagagagaatatttaagggagagagtggtagataggtcattatggaacaagtaaatgtagaagatgaaagaaccaaataaataaatacctctaccgaaatacaagtacaataatatcctgctcttaagagccaccaatggataactgtattactccgttttctgaacatgatgtaggaacactgtagaaatccagaatatttggatttgaaaaaatgggtatctaaaaatcagaaattgttgtcatcttcttaataaaacctctgtgctttgagaactaacagtcccttacatacaaacaaataagtttactgctcaaactgccatggaaagattctgccctgaattcttacaattatattgagctgggcattttggaagggattaagtcagagtattgtgacagccagtcagaatgagcagtgtttcccccttggaagcaattacattaggtgcagcttctgatattggggatcagagagcaaacattttagtttaggattccaagttcccaacagaaaaatatagtccttaatcttaggaggctaatatgttttcttgtcttttctttccttacccatcacatccaaactagatttctggagaatgagtcatcattgggtttggggtttggaaaagaatttttattttgtttgaaaaagatacacacaggtgagttatacccacgaaaaaaaggagcctaaaaaagttagtttgattagccaaggttgaatatatgttatcttcattgtaatacaagctaattactggtctgagtgagaacttttgattgaatggatctttttcaaagaaaaacaaaattttttaaattttattttatttttaattgatatgtgataattgtacttatttacggtgtacagtgtgatgtttcattatgtgtatacagtacggtaataaccaaattttaaagatgatttttagttcaaagcctgggagacatagccataaatttttctggacagatcttcatttgtttgttgattcatttgatagtttattcatttatccaaccaactatccgtgaaatatatggggagtgtctgttaagtgttgggctttaagtcaaattctggagatatgaaagtgagcaggctgggcacaatggcttactcctataatcccagcactttgggaagcggagatgaaaggatcacttgaagccaggagtttgataccagcctggacaacaaagcgagagcccatttctaagaaaaatgattaaaaaaaattatccaggtgcgctggcctgtgcctgtagtcccagctactcgggaggctgaggcgggaggactgctttcaagattgcagtgagctaggatcatgccattgcactccagcctgagtgacagagccaggccctttctcttaaaaaaaaaaaaaaaaaaaaaggcgaggccaggcacagtggcctatgcctgtaatcccagcacttagggaggcggaagccggtggatcacttaaggccaggatttcaagaccagcctgggcaacatggcgaaatctcatctctactaaaaaataaaaaaattagccaggcatggtggcatgtgcctctaatcccagcttctccagaggttgaggtggaagaatggcttgaacccaggaggcagaggttgcagtgagacaagattgtaccactgcactccagcctgagcgatggagggagactctgtcaaagaaaacaaaacagaagtgagcaaaacagacatgactcatgtcctagcggcacttacagtatgttgaaggagaaaaacattaatcagataataacacaaatagttaattacaaatggtattaaagtgctgtgaagataaaatttcaggttaagagtatataaactgtaaaatggatagggtacagtttcagggaagactttgctagggaggagacattggagctgagatctgaatgaagacagaggaagggctagacatccaggcaagagcagcagcctatgccaagctactgagacatgaaacaaagaattcactggagctgaaataagattgctgtgactggagagcagagagcaaagagcaaagagcaaagaggatggtgatgcacagttagcctggggaggtggctgggacagatcttttggggaaatattcagaatgctgattttcttacagtttaaattgtttgatccaatttagcctaggatattagaaggatctcttgggctggcttgcagctattaggatgtacaccaaagtttaagagcactgatttataattcatagtgtttttcttgttgataaaaacaattggattaatgtcctaagagaaagaaaaatagctagaacataaactgactgtattctggacttttaatgacacatttttattatgtatttcattgaattttcaaagtaatatatatttatttgagaaactttggaaagaaagaaaaatacccagaagagaaatcaagttacccataatttttccatgcagaaattattaaacaacatttggacatcttttcatctggtttaattcataaacatgttatacatatttgagagcatgctgttcattaattattttatgtattcatacatttattgacaaagactagttgtgagagattatgttactctgagttagcgattctgttttaaaccatgcaggcagagttgctagtttctaagagttatgctttcataacctgattcttttctcttttttatgttaaaatgtttcatgcttatatcatagtaaataaaacacctacatattatgaaaaataaacataaagcaaattagtgtgcaattatcaaccaggacagtaattagaatgtcgtcagcccctcagagtcgctgaatacaacccctcttcccacagaggtatctctttcccaacttcttatttttgaacaatagagtattgctttttctgggcggggcgtggtggcttatgcctgtaatcccagcactttgggagaccgaggcgggcggatcacgaggtcaggagtttgagaccagcctggccaatacggcgaaaccctgtctctactaaaaatacaaagattagctgggcatggtggcgcatgcctgtagtcccagctactcgggaggctgaggcagaagaatcgcttgagccctgtaggcggaggttgcagtgagccgagatcacgccactgcactccagcctgggcgacagagcgagactccatctcaaaatcaaaaacaaaaacaaaaacaaaatattgctttgtctggtgatatggtttggctctgtgtccccacccaaacattaccttgaattgggtggggataatccccacgtgtcaatggtgggagcagatggaagtaattggatcatggggcggtttcccgcatgcttttctggtggtaatgagtgagtctcacgagatctgatggttttataagtgtctggaatttcccctgctggcactcactccgtcctggtcctgccgccctgtgaagaaggtgcctgcttctcttttgccttgggccatgattttaagtttcctgaggccttcctaaccatgcttaactgtgagtcaattaaacctctttcctttataaattacccagtcttgggcagttctttatagcagtatgaaaatggactaatatatctggtttttaatgttgtaaaaatgtaattctactataggcatttaaaaaatgtgatttgcttcttactgtcaatgtttttctcttgagattcatccatattgtgatatagcatttcatgtaatagtatacattacattaatatactgagatgtatttatctctttcactgttgatggatgtttgggtcactctggttgttggttgttattgacaatgctgctgtggacatcactatacatttgttttggttcacacttacaaaattcctccaggatatatttttagaagtagaatttcatgggtcatatgataaacacttagtcaattttacagcttttttttttcacttagcagtaaataacgagtatttacatgtatctaaaaatatccagaaacatatattgtattggggcatggaaaaacatataaatgcaacctaagtttcttaacaaaattcccatttttagagttcttggagactttttatttgttaatactaatataaaaagctttgtgtaataatttttgttctagatccttgaggaattgccacacacatgtaccctagaacttaaaagtataataataataaaaaataatttttgttcacatgtaataatatttttttcaatatttagtacaaatgagaattttgggtatcaaaaagaatgaaatggttaggtgtgtcattcaacatccagtcaggaaaattgcaatcgtggtagggcagtttaaaacaggaaattggtgacaaaagtgttgaatgggctggaaaagaaataaggaagcatgatagtatcaccagacacttgtagcttcagaaagctgttcctgcccctacaggtggaagagcaaggagcaacacaatgtttcacagggctcgtgattgtgcacactgcagggtctgccaaagccctcctgtgatttaggaatgacttccatggccactgagcaggaaaccaggaaccaattctctcatgatgctacaagagctgcctgagaggctgaatgcttccaacactgctagactctctgctaatgctgttaaagcccatgggcatccatagtaccctaccttaccacttctgaagccagaagcaggaaaaaaatagatggcttctttcttccctgggtctcttttttttcccctgggtctttcttaacgaaagtgccatcttccaagaagcagactccaagatagaattcaacacaccagaaatttatgggtagaaacacctttgatataaagagaggaggtgcaggagaaggagggggtgaaccttcagactatgagggtctgacacccatgaaagaagagaaggaaggaaggaggactgagtaggaagagcctagaacttcagaatcgttttgaaaaagtcttgttcaggccaattgggaatccctgagaaaaggttgcctttagaatctaaccagaagccagctggcagagcagcctgggaaatcttatctaagcttccagctcccttcaatacagagagggatatagaaagctaaatgttttagaagaaaatgacaaatatttgccacaagaatatttctacatattgtctaattacttttgatttccttgcagaagtatataaagcttcccctctcaccactctgaaaatactggctggctactaatttaaaaaaaattaaattgaatatccttattaaatgagaaggtctagacatagtgtcttatttatattttaatttatacttttgaatactaataaatggataaagttaattttgaagtattttcgtttctattatttggataatttatcaatttatttgccaactcaatgtttctattattaatttgagactcttatataactcttaaagcttggttacatttgtatattttcagttatatccttttcaaatgtaatgtttaaaacaatgtttttatattttagaatataaaatataaactattgttggagaaaattgaaaaatatagaaaaatgtaaagcagaaactttaaaatacctgtaattctactacacatacaccattattaactctcaaatactgttcatattaagactatactgtatttatagatttgtgtcttactttctcactttttgtgagcatttctttacatttcctttgaaaattatttaaccataccatattattaagtgtttgagctatttcctttcatttttagtaaaaataatgctgtaataaacattcacatatataactgtttttccccatatctgtttatttacttagtctagatttgtagtacgggaattactaggtcaaatgactcaaattctaaaatgttactatgttttgacaatgacacttttaattataaaaatgatttgtactcaggatatttagaaagtataaaatagcactaacaaaaatgatctagactagattcatagaatgttaatttattaacatttatacatgttaaaatgtatgcattttgatatatgttgtcaaattgtaaacctctcaatttatgttctcattagcagagaatgagtgcctgtatttataagcccttaccaacactgagatttattattctatttaatcttttccaatttcatcctcttttaagttgtgattttttattactaaagatgataagtaaaacttctattggtttattgaccattaatattttttaatcatcttttcatatattttattcattgtattagtagacactgtttttattatggctttataagagctctttataaataattaacagtcagtagtttaaattttacattcagtcaattagcatatagtatagtagcacagtttcagagacacagacaatttgaattttaatccaggtttatctctttactagctgtaggtaattttttttgaggggagggggatggcaatattgatacttttaagatagtttctttacccttgaattcaaaaaataaacatgcatatctatcaatagatagatcaatattaaaagacatataacccatctctagatagatatctagatagacatgggttttgtgtctttgtgtcttttaatattgagtgaaacctttcaaacttaggtttccactttctaataaaatcttacttttattttgtctttgatgcttttatctttttggtgttatttcttcccaggagcatttagtatctaagttggatcattattttctgttctctgtatcaggcaagctgtttctcatttttgataatgctttttcacgttgcctttctcatatattaagttgactctcctcaatgataagccatttctgtaatttgattctaacctttatttctactaatgtgatttttaaaataattctgaagcatccagtagagtgcacgatacagaaatttaaaaatatatatttatttttacttcaaaactcttttgcctatagtcataatacagaaaaaaatagctaaatgataatatattattagatgaaatataaatatacatgttaaataaagagcatattttaagtgcatttcatagaaagctaactgtctcctttctcccacccctgttgttctggatcaaaatttgaattcagcttccttaatagtttaagattcttctgcagagcttaatagacaagcccatgtatgaaacagggtggctacagtcaggacatgtaaaagtagtagcctagtacaggttgtagatgtcccacaggaatgtggctatagagaataaaatacttggcattttatgtttccaagctcattaagacatacttccagctcttaagagtaggtgaatgcaacatactttgctatggctgaaatgagtgttctcagctgagtcaggcagaatatctcaggggaaaataactggagagaaagcaaaaatgtcatcagcttattgccaagacaaactgagacaagaatctgagccagattcacctaagcatctcttttaggctaaaaaggcagtacaaggatggcaggcatttgttaaagaacagtcctcaatgtgtctgccctgtgagtcactgctctggtctggattggttttcctctgcatctggtgtacatacttcatcctgggatctctcttcactatcatcctgacaattaccttttcccatctcttacatatgatgatacatttccagggtctgatatatcttcattgttttttagtttactgtttcattttggtgaagcatatcatttagctgtttcttgaggaaaaacataagtaagaaatttattttttaaaaccttgcttttctaaatatatctttattataccctcatatttaaatgatagtttggctgggtatggaattctatggagggaataattacctgtagaatattgaagatatttctccattattttctcactgtactgttgctgctataaaagtctaagatgattcttatttataatctttatcctttgattgtgacctttttccctcctccctctcttttctgcttgactctgttctgtaattttaaaatgatgtatatcttggtgaagatccattatgaactgctgagctgtgcatttttggacccttttatctggcaattcatatcctccagttgtgaaaatatgtattgaattatttgaggatcttcccccctctctgtttctggatgtcctattgttaggctgtttgatctcctaaacttgtcttctagcagtgctgtttcctctcctgccttcatctgtatctttctgctataattttttggggggagatttctttatttaccaaacctgtgtgaaattttgtatcttcttattgtacttttaatttctaagtgctcttcatttttgttttttgaatattctcatgtcctccatttaaaattattttttattgcatagtctctccttctaagattttgtgctgactttgctattttggcttctgtcttctatactagaagctttcctcaaataattgataattccaaactgtctactctgaaatctcttgtaaaaactgagactcaatgtagaatgatgcagtagggctcttgttggagaaccactagtgttaatacatttaggttttctcttttggactgttcaggttctttacataagaagcttacttcttggcttaagttgttggagagctgaggggtgaaagcagttagggtgggagtgtgttacaagttcagcattctgtagcttattcagttctcttgttttcagtacagtgcctacataccctctactctgtcttgtgtttcccagttcagaggataactctgtgtctcttaaaaaacaaaacaaaaaaaccctccaatcaaacaaaaaacttccaacctgctaccaggttggtggaagggcagccacacactgatgtggaatgatggatagtaactagagatgtaattgcctctcagacagctttcagaaatgctcccacttatagccctcactccttccaggatggacgtgatgcttccagttttgccatccttatgataattctgtgttaccagtctagagattctgctttcttgagtccagtaagttagttccaaggttttgttgccatttcctcctacttaaatccatttttttaatccgccatcaaaaattaaaacactaatagtgtttttaatttagctgttttaaattttttttatactcttcctcatcttgtcactctctgtcttatttccacatatctcttttccaacttcatatttttacttcaccctctattgtagctcatccctaaacattaaattgatcaggtccatgtttcctgaactatatgaaagtacaaagcagatgctttgtaaactttatttttgcctcttgtatttttaattatgtccagatttcttaatgtatgactgacaaataaaaattgcatatatttagggtatacaatgtaatgttttgatatatgtatacattatgaaatgattaccacaagctgattaacctattcatcacctcacatggttaccatttttgtgtatggtaagcacacttgagagctactctcttaacaaatttcaagtataaaatacattgctaactatagttgctatcctgtatgttagatctgcagtacttattcttcctacagctaaaggtttgtaccctttgaccagtatttcttttttctcacactcttgtagtatacttttaagtaatgttatgctattgcttttagaatactgtatcttcctctcatttaacaatatctttctacaagccttcattttgatttttcttcctatttttctcatcgttttctattatttgtcccaaactgggtgggtgggacttgaattttccctcctcgtgtatatcctgttggaatcctgctctcagaatataaattgtacattctaaagctgtagctagttccactggggaactactactctgactgatttcttcttagtatttatgggagttgatttgacaggcaccaaacatgtgcatttaattttggacttgatagagcttcctttccaggttctcaggatattcctacccctggatcttgctgctgtgaagtcaaagaataatggcattatccttctggctttctgtttgacctctcagagcagctgctgtttaattctgaaggttcagaaagcattctcagccacattttttcctatccacagctcactcgctctgttccctgttgtgcaagccagtctttgggatcatctctgacacctttcttgccatccagtcaattgtgaaatccagttccttttaactcctagttatctctcacatttgaccatcatcctccatctctatagcctttattttctctgaactattgcaattcttttttttttttttttgagacgaagtttcgctcttgttgcccaggctggagtgcaatggcacgacctcagctcaccgcaacctctgcttctgggttcaagcgattctcctgcctcagcctcttgagtagctgggattacagacacttgccacaacgccaggctaattttgtattttcagtagagacagggtttctccatgttggtcaggctggtctcgaactcctgacctcaggtgctctgcccccctcggcctcccaaattgctgggattacaggcgtgagccaccgtgcccggcttgtcttttatccaaaatgtcctgactcttatccattgtcgacccaggtgctaaagtgaacttttaaaaataaacgtttgataattttatttctctacttagaacatgttttttttttttttttttttttttttttttttttttttttttttgagatggagtctcgctctgtcgcccaggctggagtgcggtggcacaatctcggttcactgcaagcaccgcctcccaggttcatgccattctcctgcctcagcctccggagttgctgggactataggcccccgccgccacgcccagctaattttttatatatttagtagagacaggtttcaccgtgttagccaggatggtctcgatttcctgacctcgtgatccacccgcctcggcctcccaaagtgctgggattgcaggcgtgagccaccgcgcccggccagaactcttaaatttaaaacttgtaacatggatgacaaagccctgcatgatttgtgcctgttccctcctttgggcagcttctcccttactcagaatgatccagagcttctttttggcaatttcttgaaggcactatgcccctttatgccacattcccctctgtgtgcttttcgggttttattgctttatttgtccatctaacttcaggccattattcatgactattatctcccctagaaatcctttattatccctctaggttagtttccctgttatatggtcccatggccccttgcactctttacatctcatcacaattgtaactaattgaatatttgtataattatttgttaatgtttatttttctcacttaactgtaagctctctgaggttagattcatgtctttcatgttcaacatctgctgttcctaacagtgtctagaataaatataattatgatatggtcttttcctttaaatatgctgaagtttagatttcatatttcaaaatgttgaatagaagttacagaagaatttaagaaatcaatcatgatagcagatatctttgttttttctattttaagttgatagcgctggtgttccagcattaagaataatgttgacttttgaaaagtctctaccattatattgaagaaatgtcatctctctatattttcatttaaaggtttagattttctttctagtttttaatatatttgagggtgaggtattgcatactttaaaatttcgtctatgaaatgaataatctttcactgtaattcctctctcatgtttgtttatactagatgattcaagaattttaaaaaataaaatctcaaagccaaaccagtctaccatgaggagaataaatcttcctatttcagaaaataaaagatagatttcctggtgttggtgggtttatagtcactgaatgaagttataccattattgcatagttgtatgccttaaaaagagctgaaaacaataaagcatttattcttttttgatcatgcacaattcattaattgaaaagtatttgtttccaggtatttagtggatactgtacagataacaagcattccataatataaaatataatggataataatatgttagataatatatttagataagataatatatttaacatattacaatgactgatcatccccttaaaggaagtaaaaaaaattattgaattatttaacttagagtagcttgctaatgcttacttacttagagaagtgcttgtcaatcttttttttcaattttgccctctgaggagcttctttagacttttttttcctaactgatccctctcccttaaaattttaataccacaggtatactatatattggtttatgtgctgtatgtatatctgtgatttatacagagtaagattttttcaccttttatgaaccagttctcacccttttgggggatgctatcacccctgttgaaaatgcatgacctagagttagtcagttcttgtaattatgacagcaatttcatagtgctattttttgtcattaatgataatttgtaaaagtcctaatagcgtatagattcaacagatcttaaggacttggaggaactaatataataactagatcaacaatctatgtgttaaagaattcacatagcaaaatatttgagggaaaagttattttgtatatcttataatttcctttatccagatgtttttcacaagcatcgtgtaaaaaagaaaggtgagaccgtctaaagtacctaaatttttgttcagtcacactaggcttttagtcttggctctgtgaacgccttccttatcaagtcactaaaacgtactgtttgacaattctcataataatatgaccactggaaaataatttaagtgtctcctgtagtttctagttttccacatttagtttcttttctatatcactaatatgttgagtatctgtgtaatagaaagttatgtacttagtgatttaagtctagccatgatatttggatattatgaaaataaataagcaagatactaggctgggaattaaatttaccaagcaaaatgagtgcttagatgatcactcatggtgaacatgtctacttccctaaataaatagtttgtaagttcattatgagtacagaagactacatttgtagaataaacagattcaaagactaggagaaaatttaaagtcagaagtgtttagggtttgagctgaatgcacttgggtgaaacatattacctctgaacattttagtttatctgtaaaataggaataatagatgctcttttttctgcactggattggtataaagacctaaaatgaaaatgcatatgaaaattctttgaaagtacctaccatggccgggcgcagtgactcatgcctgtaattccagcactctggaaggccgaggagggtggatcgcctgaggtcaggagttcatgagcagcctggccaacatggtgaaaccctgtctctactaacaaatacaaaaaattagccagccgttgtggcgggtgcctgtaatcccagctactcaggaggctgaggcaggagaattgcttgaacctgctaggtggaggttgcagtgagctgagaacgtgccactgcactccagcctgggtgacagagcaagactccattaaaaaaaaaaaaagtacctaccataaatatcttaccaaagtaatatcttaccaatgtaacatattattgtttctgctatatgcaaatttttaattttactgataatactattataaatattgaaacttatttttttttttttgctggccatgttttatttgtcctttttcttcaaacaggataactgaagatacagtgttcaataaaatagatgaaacaaattctaagagactgtgatgccacacgctatgtttaacttaattttattcatgattgccttgggatggggaatagttcattcagtaaaaacatacagtaaaaacaaaatatcttatgtacaacttttaaactgcaataataatgtaccataattacttccatgcacacaagtctagcattcactttttatttttaaataagtacaattaagacttttaggagcattttataataaggtcattcctaattaatttttatttgtagatagatcaagcacctccaaaatacaaattcctatacacagtgagcacattatttaaaatgaacacttaataaacttttaaagacatttcttgggaaagaaaattaaagtatgggtcatactggggagttgttttgctcttttgaaatgtgatatcatacatataataaccagctccgatttatttgcccatacatgcaattcatctgcgtttgcaaatgtgtatctgtaggagtattttgaggaatctcagtgtcacctgttagtagaaaaaaagtgagctgttttataatgagttttgaagttatagctaactcactggaaggttaatatcgagaaaatccatcaattgaattaattgtttctgatttgaaacaaactggattggcgttatacagagaaatgaaaatcaactgtagataaaactgacaagcccactaatagagaattcaggaagaaaacatgttggcatgcccttttaatcagttattgggttatttgtatagtagttatagcctatgtattattttctaactctgcaaatgtcatatctcaaaacagatgttacttaaataaaagcacccttactgctggtctttttttcctgacaaagacacgcagctctaacactgttatgaaacactgtggcaaaaactgctcatgctctgcagacttttgggtcaaagataggtgatgcactttgctttaaattttttttcctttcctaaaatttttgttagacaaacttttgtaagaaagttcattttaattgaagaaaattcactccttttaggttaatcatgttgacatgcaaataattatatcctaacgtaattctctcacgcatttttcatgtaatgcgtttctcaaagtaatgtatacatgtccaaaattgaggacagttaaatttcagaagtaatataaaattcttatgggtttcttttcttccaaacattttatttcccagtaatttatttatcattcattcattcaacaaatatgtattgagcatttatttgtaccagatactacttaagtaccaagagactatgaaaatgaatagattattatgctgtcaaggaactcctcaactaagaaaaaacactttagtttaataaaattgtgaacacagtgagtatttaataaactcttatctattcgcagagagggacaaaatgtgtgcatgtgtataatcacaacagcagaagagataatacagaaaagttcttcttaacgttgaacaaaaaagtaaaattactaggaagtgagtaaatatgtgtcagcctgagtgggtcgatgaaagtaagagatagttgctgtgtagcgggtaagtaaaagacttgtgtgggaaggaaagtgtagttggttggagggcagctaagagaagaatgaggaacctgtgtgggaagtaaggaggaaaggaagactgcaagctatgatcacaaagtcgcttgtttgatgaaatactcctgggagatgaactcaagttttcactttctctggagtaatagcatggattttgaaactgcagaccttttaccacactaatgtcacagttattgaaatcgctttgtattttttggtagaggaaattaaatacctctaccaaaatgtgactattattttcagagctatcattgggtggacagttgttcgtggatgcaattagagttttagtttaatcaagaattaagtttttattttaattgaaataatgtttaagttatgtaagcaaagacaatagttataatcaagttaacctttattttatggaagcatttaaaaatggtaaaggttttcttacttgaatctatcttgggattgtggtcttattttatcagagtataagtttcctaaataaatgataaacttttccctttccctaaataagtcataaacaagaaattgtcttgttagtgagaatgctgtatcactttggtagaagtactagaatgattatcactcatcttacacaggtatttttgaattttaaatctaatcatttagaaaatcctgttgactctttgtttgctcagaaaagaaagagcccaacatcttaataccttgaagaaggtgtgctgaggaatatgggctgtccagtcacaacaacaatatttttgatgcattagtaaatatagaaaaaagtctatccgtctggtataccagacatacagtgacagcacctatgaagatgctctaggatattgctattgatcagttctagaatccctattttttcaagatcaacttttgttgctctttagctaaagtttcatatttcaaagtgggtctggattcccaatcttggctcaaaatatagtatttttatttcaaaacatagaccaataggactttcaataccattgtgcaaagctgaataaaagcttattttataaaatgaattctgtggctaaacacaactattcccttgtagtgttagtgaaggaattatggtcttataaaatgggattaggaaaccatttttatattctatcaggaatattttggactccttccatatggtatgtttggacactttatattcttgtagaaccttattttgtggatcatttatatgagtgttagtaacaaaacactttagactttggagttatcaaataattgcttatgcctctagacacattggggaacattaaaatatgtggctgtaagtccaaatgctaagatagtctctttggaaaatggataatcaccccagaagaatactaaactaccatgcttacctctaggggattaaaaaaatgtctcaaatctgaacttctctcaaagacctaataccaactcttcatagggaaaatttctgtgttaaagatcttgttaagaaaccaaagtttgatcctgaagccacaatcgtccatgatgcaatgtttcaaggtaactgtgtcacttgtcctggtgccacaaggcaatgagaagacttggcttggtgtgttggagaccagaacttgggggtgaccaaacacttgggtatatttagagtctctgtatacttttcctttttttttcttagagactgtgtctctgattgagtaaattaaaacaggggaacctcattaaagctattaagaataatttaaagttcaatagtcttcttggatggcctgtgtcataataaagaaaagcttatatttttgccagtactacaactgctacgggcatgattaggctggagccttctcaagcaccagagatttataatgccaactcaactaattgccttggaaacttcttggagtttttcatttgactttattatatttatgaaatacctttgttgtttgttctctgctaactttttccccaggaacccacagttaccagttcaagcagaccatttcatcatgttaaatctcttgtgacctaggcatctttctgtaggtggtcctgaactcaacatgatggtaaatttccttgaattttggatagttgctttgcattatattcacatatatatatatacacacacacaatgtctatattctttaagttctgtgatactgccagatgagtgttttcaaggcagacaacaacataccatctatggttgggaaaacagctagtgatgcctcacaaacaaagatgattttctagaaactaataatgaattctcacatggctgataattgttcatgagccacgcatcttagcctatttattgcttctcctgtaactgtgctgtgatattttattgaagcacagtgacttcctattttagcagaacaaaattgttatttctgtttactttcatttcaaattagatcataatggaaatctttgagtgtaatgagctttaaaacctaattcctataaaaatgatccattttagcctaaataactaagaccttaatcttggcaatattaatttctgtatctcaaagaattaataatcatttgaaaatatgtagaaaagcttttctcgtgtactgttgcaataataataaaacaaactttttattctattttgacaaatgactccgtacacatgattcagttctgagtattgaaatattgaatttatacttgaacagatttcagtcttgctgaaagtgcctggaaatagttttcagaaagcctcttagaaatatgtcaatcttattcaaagtggagatgtttgccacttaatgtcaaagtcttaagctcaaggctgaaatatttctttattggctaaaatgttgaaatagtttaatgtgggattctcattgggtctcatttgcctgttccagggcagaaattattaaatgaataatgaaaaagtacaagtttacaaaactgtcatcttttaaaataccacctctctcaataatctaggtttgtacataaattattaaacatttttatgattacctcttataagccaggtgtgcataattttcttaatgctgtacattttctctttccaagtaaccatattgactcagtttcaggactgaacaaacacttggaagctatgtgctctaagccctaataaatgcatgactcccctttacaatgctcctgaccagtcttcagctgaatgtgttaacacagcttgctacttcacaagttcacctacattttttgagagatcaaattgttcaaacttgttggaaagttctgtttcacatctttataaatttgtttacgtatttatgtgtgtatatatgaatctacttccaaacttgaaggtaacatctggcacataatttcaatcaattgaaaatggagagcaaggcttatatgactatttcttctatgtaatggacatttaaatatttgcagactctcatcttctcatctttgagatctcttttttccaggcttcacatccccaactctttcaattaatcatcaaaaacagacttttcccattatgaccctttgaaaacttactctgtgtattacagattactatcctaagtatggactatccaaagcaaagtaaaatggtaaatagtgttccgaatttttcctgttgttttttctgtggttgtttggtcagcctcattttttgtttctcttaaatgcagttttttttccaatatctggagtcccactgcttccctagcagtacaccagctttgttttaagaacagagtgtggcagagccgttcagcaaactcggaaataatttctttatctggctcaggggtcccagatctctagttttatatagaaaggaccatctgaaataacttttcatgattgccctctttttccccatatgcttttagggaggtaaatttgttttaaagtttgtctcaattctcctgcctaaaggcctactgaacattttctgagacccaaggtagctattcccttagtctctctctccatacggtgattcatctcaacttcccctctgcatgtcgggtttcttcttccttgtgtgggccagctttgtgtctccatgaatatgcccacccatcttctcttaagcatatacagtgatcagttgcagtcatacactaaatctgagacgtgaatttcaatattaagtaaagatttctcagagagaggatttgattgccctactaaatgtggtttaagtttacatgtgacatgtacagagcatttcaaagagaaagatgtctacttcaatgttaaatagctcttggttttatcccagtgtttcggtctgtggttactcttttgtatttttcattttttattaaattaaaatgccatcaaatatttagggcttttcatgcctttgagatttttaaaagagtaagtatcattggatttgttctgatctagaatgtatgctttagtttgatttctaggaagtattttaatgagttcactggactttgacatgagaatcttttaaatgggatcattataaaaactcacaaacctgaataaacttaggttcttaactttgcttcttattctccatacagatttagacaattcattgcttggaatttgaaaatgtcagacatttcaaaggatttgtacctgacattttcaaggacaacagagttcaacttaaaaaaaaaataaaaaaacatgctgatctgaaatagcatctgcctttagaacaagggcgcttagttgcacttgatattagccatttgaccttcctaatataaagggcaagttctgtcatgtgggggaagctgtttaattgagcaaactataccatataccatatttttgttctcttctttcttctcctattttttcccgtgtgcataataaacctatttatgtggctgagaagactcatgatctagtgttaaacgtggctgttttctataccgctttgaatcttgagcgaaaaaaaaatgtccttatggagacagtgccattagaatcccctcgtatttttcttatagagtaatatttttctgatactgactagtcattaagtggagtggcaaggaactccaatcatgacggtttgtctgggctctatttggtcttccatctttctccatcttctttcttgaccaatttgaatacaccatttatcagacagttgacctttaaactttgttttatggacacataataattgtacatatttatgtgatacaatgtgatgttttgatacactatgtaaaaatcaaatcagggttttcagcatattattcacctcatacatgtgtctttgttgcgatgagaacattaaaaattcccttttctattttgaaatatataatacaatgcaattcctatcaaaataccaatgacattcttcccagaaatttaaaaaaatcctgaaatttgtatgaaaacacaaaagtctccaaatattccaagaaattccaggcaaaaagaacaaacctggaggcattgcactatctgatttcaaaatatactgcaaagctatagtaaccaaaacagcatggtattggcataaaaacagacgtatagaccaatagaatggagatcccaggaattaatgcacatgtttacagcctattgatttttaacagaggtgtcaagaacacacaatagagaaagaccagtctcttcaataaatggtacctggttaactttgtatccttcaattgtttgaactggccttatgtgaaatgtactggtttgagacaggttattcccaaataccttattttgaggcaggggtgagtagaagtcccattttcactgttattcaagttttgaatgaaaggagaaagactttgacataatataatacagctgtcctgccagggttgtgctcattgtgattgcacattgtccatggtggatatagtgttcatagactacatttatactgagattcacctactggtacaagcagaccattgtccggcctcttgctagtattgcctcctgctccagcaggacacatggatgaacatagtgtcctgtgtgtagtaaagactctatgtctttgatgaattcatttgaataggctttgtgccagtattaggtttcttttacaactgggatcttgacacttttatgttgatggttgaccttgctttaccttggtttcaggtactgctataatttttggcatctaactgttggtcttgactttacttaaattctaaatttccctcatgaccctcttattggtctcccaaatatctacctgtctaccaccatcctcactttcccactgtgttgaagagaaattgaattcaacccctctagaaaagcagcagaccattgttttcgttgttcctttaataggctggtcatgaaaacagtaaactcttgatttaactggaggtctttaatatccagagagtgaaagagctatatctgagatttttgggctggctcatttattctgccatctctcaagcagttccctggttgagactatattcctagaatctgtgtggcatattgtctattctctggttgaagagtatatcattgaaaattaacatgtacataaaattaaaagaagatttgtcaagaaacaatggaggtggatatttaatatataagctgccttataacaaaagtgagtttaagaagttttaaaatataataatttgcttccttgtgtcagtcaaactgactggttgtgaaacatgccaaataagattatcactgatttatcacactctcgatataaatatccaggcacagtgaaatacagaactgaggcacgtcaggcacataatataaaaatagacttgaagcatattaagtcagaattaacctaaaaatgccactgcttcccacttcataatacaccaagacacaactctactctattaacttgactcctgaagcactggattcagttttgaataactgcccctctaaagacagcaaggacctactgctccaaccgtatctcctagccttggccttttgtgggctctctgctccagacatcctgagaagctgagctccatggacattccgtacactctcgtggctccagatctttgcatatgaggctccttctgtctgaaatcttttcctcatgtctatgtcaactttgcctggctaattttttctcagtattcttatattgactctgatccttctcttatgccttatttttttaatttaaacttttattttaggttcagggggtacatgtagagattttttacttgggtatattgcgtttggacttctaatgatccctttgcccaagtagtgaacatagtacctgataggtagttttcaactctttcatccttccttccagtgttattgttctttgtgtctgtgtgtaccaaatgtttagctcccatttgtaagtgagaacatgctgtatttggttttctgtttctgcattaatatgcctagaataatggcttctagatgcactcctgttcctgcaaaggacctgatttcatattttcaggctgcctagtattccatcgtgtgtatgtaccacattttctttatccaatccactgttgatgggcacctagattgattccctgtctttgctatcgtgagtagtgttatgataaacatgcaagggcatgtgtgttttttcagtagaacaatgtattatcctttgagtatatgcccagtaatggaattgctggatcaaatggtagttctatttttagttcttggagaactctccaaattgctttcttccttcttatgtagcaactgagacatttctccactagagaaatagccttcctaatagcctgagactgggttggatattccttctttgtctgcccactgaaaaacaagttcatctgcatctttgcatctcagcacgtagagcattgctgtttacatctttcttgcccatcttcctcaccagactgtaagttcctggagaacaaaaaattgtctgctttagtgtcccagaggcatagccaagttttaatatctgagaaagcaagtctgaggaaatactccaccgtttgcgcactttctattcatgtctaatagtcctgcattatttctttttccccctaaggcagggtttctcaaccttggcactattgatatttggggccagataactttttgttggagggagattttggtagcatccctggtttcaaccaattagatgccagcagccacctactctagttgtgaaaaacaaaaattatttgaaaattattgaaaaacataccttttaataacgttttctggaaagtcaaatgtttattctttcttctgctgcccctcactccactctacttctgcaagacctggcatacaataggtgctcaaaaatatttgtcgaacttttaataaatgcctggaaagagcacatttttcaatcattgagttgcctttgtttgtttgtttgcttctctttgtgcttcagtaggatgaatatgaaaattgctcctaggctaaatcccaaatcctgtacatgcgcaaaaggccccacatgatcctagctctccctgcctgactacttcatcttggatgatttttctttccatcccgaaggattctttcagtgtcttctgtctgcttttagccttgacatacattgtcttctctgtctggaatgtgattcttcccttttgcctgcttatgtgagtaagcatgctttgggttgagagttacagaaactcatattcaattagctttgggaaaagcgggatttattggaagcaaattccagtatttcacataactgtattaagggcaggagtgatccaggccttggatcaactggaacaagaactgaaatgctgcctggattccccttctgtctatgcctttatctccatgcctctctgatatcaattttattttttcctcctgcaatttccttcctcacattcagagaacagatccataggaatgtgcagagtctacttcctacattgactgttctaccaccagaaaggcattgattctcttctcttagatttagtcccctaaaatgtctcaccttggatcaaatgcccatgcccacattaatcaactctgtctgggagctgagttcacataaaatagatgtggcagcatagaattttcaatgagttctgtgagccacactgccaactcaaatgtctattctactggctcattatttcccatccttcagtgctcagctctaatataattttcttaaagaaccctaattacaagcttttgtagcactttgcacttcttcataatgcttattaaaattataatcacttttcattggtataatttgttcgccatctcttccccgcactcctaccccaccccctgctagaatgtaagtttcaggaacgcagcagctatatttctcttgttctgtgtgatcttcagcactgaacaccaagtctcagtaagagtgggtatctgattagtaattattgaagaaggcctgaatgtatggacccagtcacaaaatttcaaacagcagttcagatatataagtgatatgtttgagatgaagttcaaagattcaaaatgatttaatttaagggaatattaatagatcttatataatacacatgctgtctacaccaagggcatgtctgtcatatgtaaatactgccaataagatagttatatattagaagtgctttttacctgtagattaagagttatgatgtctctaaagaacaacattcatttttattcttgtaaggagaggtgttaaagagtggagaaggaatcgcatatggaaataacaaaggtgcaccacataatttttgatttttacaaactcagagaaagagcataaaagaaaagaaaataaaaacaaataaatgtggttttcatatagaatttttgattctattgccatcaatacattgcaatccccatcaaatttgttggttgttatataagtcacaagacatagacaagtttagaaaagaaagatatggagtgttggatctgattatataaaaataaaaattaaaaactttctgaagttttaatgtgaaaattaaaaaactttctaaattttaatgtaaaaattaaaaactttggtcacttaaaaaacattataaataaaattaaaatggtagaaataggcttcaaaagtatttatgacagataataaaataatagccttcatatgttaaaaatctttttcaaatcaataaggaataaaggtcagcagggaattcacaaagaaatacaaattctcaataaacatgtaaacactggttcaatttcactattaatttcctaaaagtatattataacaatgatatatatgtatttgtgtgtgtgtgtgtatatatatatatatatatatatatcaaattggcaacaattctaaatactaagtgctagctattttatggcaaaaagagatatataatgctttcaaataagctgttttgaactgctttcaaagaagcagtttggaactattttataagagctttgattttgttaaggaataagttactcagtgtaattgagattagcagtgattagttagtccccaggtggctttaagaaggaaattgtaaaatttaaaacacacacaaaatatatgaattcacccaactgttatggaaggctaaggccttttgtctgagatgggccctttgaatagagtttataatgtatcctctaaatttccaagttgggattcaagaatctaagacacttgcagaataatctgaatgcagattctttagcagattctttacactcaccattttaaaaatcttttatattttttcactcacatctaactcttcagaaatctatttttagtaacttgtctttgttgactcttactcaagcatttcacattcaaatagcatcagtttttatatagttaattatgtgatcacagtaacatgtacaactgatataaataggtttgggggcacataaaactttttctcggtaactacacaatttaaccagtaggagcaagtagttaaccaaccaagagtatgtggtgttgggggaatccattagtctaaggctaggactggaggacattagatattccagaattgtataattgtaagttgattaagggaacttctactgtatttaccattatttccatacttaagatgataagggcaattgtgtaattactatatcccctgctgaactgaaggctgcttaagtgtgggtgctgtctcttatccatggctgtatttccagggtttaaaatagagtctaacacaaaataggtacgaaacaaatatttattgaatgaaggaaggaacaaaatgtttgcaccattttattcagtaatattttactttagaaatctacatggggaaaaattcgacctatgtatgtccaagatctatgtttaaggatatttactcaaagttctttatgacagtttaaaaatagcaatatgattgttcattgaagcaaaaatagcaatcgatttgtaatagtaaaactcattacaacaatacaaaaaaattaatcatggtcatgtgtggaaaagtattataaaatcattaaaaaccctagtcttcccaaatgttaaaattatctttttcaaactacctattgggtactactatgttcactatctgagtgatgggatcagtggcagcccaaacctcagcatcagttaatatactcatgtagcaaacctgcaaatgcaccccttgaatctaaagtaaaaaaataagccaggccccccaaaatatctttttcaaagaacatggaaagtgctcaaaatttggtattaatttttgtaagtatagtaaaaattatctatagcattatcccaaatttgaaagtgagtatcgttatttatatctacatatatcaaatgctggaaagaatagcattactgttagcagtaatcctctgggttgtgtatgatttttattttcttgcctccaaattttatgtattattttatagtcagaagaagaaaggaaagtttaaaatcgaaatgtttttttcccctcaggcaatgagtggaaattgattagcatttagttagaagagcagaaagcagtccagacagagcagctgagacaacaaaagcaattctggagtatcatagtcacagaggaagaaaaattaagaaaatgacagaaaaaagaacatgttccaagaattaagtttgaagtgacaaaaaccatgaaagatataaattatataatttaaggtaaagaataattggtgtggcttcaataagttatgcaatattatcaattttatcaaataagaaatgatattaaagataaatggttgtcatttaatcaagaaaaataatccagtccaataataaaatcaactgttgataggattctagctagatatgtcttacagtttttttcccacttatttttatctgcaaggttgtcactgtttgaagttatctaattaggatagtctcccatgagttgacatctttcccaggaagggacctgggaaagcatgtgttgaccctttagcaaaacattgtacaaagtttcatacactaggtcagtactctgctgtatggagacttataacctgcaggtgttctctattggaaatggagctgcagactggcctgaaggaactatcaggcttccagatttccctcggtagaagccaaagtcactgggtcaggctaagttcaatattgtgaatcagtggagttattcatagcagaaataagagccgatatgcaggtaaggaatccaacagcaagtggcaacagcagacagcctgatgctattgatctttctgacttcctgcttatgcggccagatttttatttctcctgagtgggaagaagtaggagatccctataagctgaatgcatgtccacaactgggcccaagagcaaaacggtggagattggggcagaagctatgtctaaactttgttgatttatggtgcttgtgaggattaagtgacctagtgtatataaaagcatttagataagtgcctggtacatggaataaacacaatgtaagcaatagttgttactactattgtcatggatcttgaaggaaaagtagaattttgatgggatcaggaggtatagtgattctatcctttgtttagagaccaaccttggcttgaaccatgcaggaaatttactaataatagagcatctccaggctctataccagctcttggagttgggcttgattatgtgtgttttaaaactccctaaattattctgatgcacagtcaggtttgagataatcaaatctggggctatagatggagtacaaaagcataatgaaatgaagggaatgaggatgtttatggcatctttgaatagggaatcacccttgtttatctgggtgggcaagagagttcttatagacaacaaaagcaattactgaggattatagtcacagaggaagaaaaattaagaaaatgacagaaaaacgatcatgttccaagaattaaatttgaagcaactagaaccatgatagaagttacacgatttaagttgaagaataattagtgtggcttaaataaattatatattatcaatattattgaatagagaataacagagaaatggctgtcatttaattaagaaaaaataagaatccagtcaaatgataaaatcaactgagagagcaagaactgagagttcttacaccatagatggagataaattcataaagatagtttggggctactctataagtgatcttggggctttgttagttgactctactgactaggccatagatattcattgaagattgaatggggacaaagagtgatatgtttggactcgagaatcaggaatataaatttgaatgtttctgggggaaggaggtggggaaaataatgatgctttgtctcactttaaattcatggttctggttcatgacatgttatttccattcatatttctttggcttcatctagtggaatagtttttaccaaactgagaagtgtatttcttatggcctaaaaggagaggagaactggagaatcatatatataatatatatatatttatatatgtatatatatttatttatacattatatatttataaatttatatattatatatatttatatattatataatgtctcccacatcagtccctacaatgacacattgtagatgctcaacaaagatgtattgagtgaattgacgaataaatcaagtgataatttaaatcctagtattggatgagctggtcaagagagaatggcagggaagagagctgaggaagtgatctctacaaacaccttcttttaagagtttgctagaggaaatgagaaatccaataaggatttttacttaaaaaagattatgataggaagagaatcataagtcctatgtcatgaatgtaatatttagacagagttttaaagagtgcttgcaaggttgaagaggatgaaacatgagtcaaggacactggatatggccagcagtagggctgttaatgttctggtgtaacattcctgcattacaaaccaccttaaacttagtggcaaaagcacaaccattttattatgttaatgaattatttcaatcaggaatttggacaaagcctagtgggggtggcttgtttggggtctcagctgggaacactttattggcttggagtgacttgaatgactgcctggaatcatctgaaggtcgttcacatgtctagtgcctggtctggcatagcttgaagtctgggttcagctgggagtatggaccagggcacctgcaagtgatttctcttctggcttgggttcaccacaacgtggtggcagggttgtttcttagagaaagtgtccagagggaacatctggcaggtgagctttgcaagggaagcaggtaaacgttgcatggccgttcctgatttagtctaggaaatccatacagtgctattctgcggctttatggtgttgggtacaagtgagttactaagggcagcactgatctaagaaagggtaattaggcttaaggggaggaaagttagtgtctgtctcttgattgagtggcaagatcacattgaagaagagcaagcgtgaaggaagatttcattgctaccatctttgaaattacaagttgccataattggtaaattttgataaaattatttatatatttttcttcaagaagtttgatgacaaaagaaagaaaatagatggaatgaattagatttagaacggaatatttcagaccgctcatttccaaaggggatcatcacacaccggggcctgtcgtggggtagcgggaggggagagggatagcattaggagatatacctaatgtaaacgatgagttaatgggtgcagcacaccaacatggcacatgtatacatatgtaacaaacctgcacgttgtgcacatgtaccctagaacttaaagtgtaataaaaaataaaaaaaattaaaaattaaaacaagctaaagagtttaatcgaagagttttagtgacctgcacaaggcacacaatttgggggaaagccagtcttccagaaaaacagtatttttaatgcttcacactttctgttgtttcattacaaaaggctgaaattccataggagtgaggtgatctagaacccactgtgcttagggtaaaggagaagaaaattggtggattcagggccctttgtctctgcttcaatcaaagtagctttgatttgatcagttttatatattggggttagatataggattttattttaagaaagaattttactactcaagaagttgaaaataatagagtaaatgttctcagagtttccatctctttccaactttccgtgtttctattattttaatttcctgtatggtccataaactgttaatgacagcaatttcaaagattaaaggcataggcaccaaggaagaagaaagtgaaaattactcatttttgcaaatctttacataccaagcattgagctaaggtccttatatatgtgatccaattaaatccttacactgctgcaaagtagatgttactatccatgacagaaactgaaggctcaaataatttaaatcatttgtctagggtgacccactaattcaaaactaaattgttagtctacaaagacaatgttctgacaaaatggagttcaaaaacttttaaaagtaaaatctagaaaaaatatgtatttattggaattgatatgaataaaatgcttgtttagttgtaaaaattctgatatgtttggtaaagtttcactaaatacatatttggcccgctgttaaaaaaaatattcagctgaaccaaggccgaagtgaaatatcttcatcgtagaattaaattctgaggtatgggaatgaatctaaaatttgataagatttttagttaatattaaatttcattattacaatatcaagtactcaaagtttattttattttattggtataaatttaagtggcaagaagcccataagtctgggcatttagtgcaaccatcactcgaatagtatacattgtattcattaagtaatttctcatctcccattcccccatctcattcccatttttctgagtctcccatgactattatttcccctctatgcccatgtgtacacgttatttagcttccacttataagtcagaacatgtggttttggtgtttctgtgtgagttatttcacttaagataatggcctccagttatatccttattgctgcaaaagacatgattttattctttttatggcagactagtattccattgtgtgtgtatcatacatatatgtatatatgtatgtatatgtatatatatgtgtgtatgtatacatatatatagcatttataacatttattgatatatgatataaaagatatggaataaacctgtgttgatcagtggatgactagatacataaaatgttatatatacatatataatatatacatatacatatacataccatatacatatatatatagcatttatccaatcattcattggatccattggatcataacatttatccaatcatccagtcaaccattggtagatacaggtgggttccatatctttgctattatgagtagtgctgtgataaatataccagtacaagtatttttttatacaaagtttacattgttgacattatagcacaggaacaataacttctctgcattcttattgtctacaatgttcttgaagacatgctattgcattgtttgtgatataaaataattgcttactgtccactaaatagatggaggagggagatattttgaggtaggacatttttctcttaaggcttctttttgtactttgtgttctttatatttaggctaaagatgatttgaaataaagatttttaaatcttatcaatgcttataaagtaaataatcctacagagattagcattatgacattacttctattattctaacttaattactatttatattttataaatatttttggcacaaaagataaagatattttaaaaatttatctagctgatatgttttttcttgatatttattaaattcatatgctgtcatatatttaactttttggctgttttaaatcattttctgatgtgaaattaacacctttcactattaaatataaattattgtggcattttactcttagaaaagtaaatttgcattagtgaaaaataattgttcaatatataaagtatataagattttctccaagttacctattcatgtattaacaattgatgcaagtgatttgctgtttttattttatttttgttcatattgtgataagaaatgatgataatctatccattacatgatcattaatcatatacgagttcaataatgcctgatacggcattaaaatagaattttaactgttcaagcttctcaaatccatggctaacactcaaacctaaaagcagatttaggcttaaaatcaaggttggagccaaacttcagtgcagtactataaaatatctaccttcttatattcttataagtgtccaatagacagctcaggagccaaatgtgtcctgagacttttgtagttttaaatataattacttaatactcacaaatatcttactaatgtgacatttaaataaattcaatttgaaattataattgggaaaataaactagaacattattaatttattcaagaatatattggtattcaggtcatactgtctatgtggagtcatcagatggctattcaaaagtttacatattactcagagctcagtggaatcactgctaattctctaattaaagttttaaaatttaatgctgaaagctactgttggtgaaggccaagagatttgattaaaatcaatttgattcgttaaatttattgaatgcagctctaaaaaattcttgaactatgtatttggtgacttcatgaaaagatagtaaatgatctgattaaaagcaacttgataacaaatgtattggtcaagataacagtttgattcaaaaattggtcaaaaataatgtaaataaattttttctcccaaatattggtaatcttggtaaaaccatatttcattttatagtccatcagttactaatgccaagtgtattactgtgtacacttagaaagttggccctactatacattctcccattttcataggttcatattatttttaaaattcaaatagaccacactttattaccatgactaatgagtatttaatgtggcctacacacatgtggatttatgaccatgtgttgaggcaacaattattgattaggaaatggaatctgaagaaagactaaatgggcattttagttatagaattcttttgttttacgattcttgaatttgtaacaaaacagcaagtaacaaaatggtcgttttggtcatcagaaaataattgactttatttcagtgatatttgctgtgttatcagattattgagttaaagaaaaatgtattcaatttcctccttcctctctcacatgtagaatacatgatacactaaaaaggattgatcaaatgctgctgaagggaaattgaaatgttaggtaggctgagtacacaggttgtttaaaatgagatcattgaactttctgttgccattactaacctggtaaataaaacaatgcattgtggcaaatgttactgaggtcaaaaacattctcacatttaatagaaataattaatatccatcttcattaatgtctttatttttaaaagtgagaagtagatgaaatggatcatcttttgaagtagtgacttctgttattggaaggcattcaagcaaggactaaagagtcattttttgaacacatggaggatttatgcactatctagaaattcaaacttccccaaagaatgttccacagagcagtagttacaaagtaggttaatctatactgttttaaaaatgtttctatggtctattgataggaaaataaaatgttaaatatttccctctattttaggactattcatatatttatatgctaatatgcattgtgactcttcacgaagagaatgaattttagctgttttctaaacatgttttactttattgccatttatttatatctcctttattcatgactactgatgactactgcttattcagttaaatacacatcagggaacgccagactaaatgttacaaaaaacccttttccggctctgagatgatttgaatataatgcatcttttcaaagtagaactaaaaatttgaaaggaagataaaattaaaatgatatctaggaacaagtaatggtagagaacctcctgtttcctcagtaatatacactagctttttggaatcacatggctataagttcagcaacatgacttaagatccaaagtaatacttctttaaacaagacagaaggttattgctttctcataaaattctagaatgatactagtgctctgctgcaagaattcaagtgtgaagaattctctcttgttgctcaagccccttagtgtgatctcctcatctccatcatcccagatggcaaaaatgcaggggaaggagaaggtaaactgcttccttttaagggcacaacccacatcagacttctattggcatcactttgaccaaaactgaatcatatatctacctgcaattgcaaaggaatgggcttggtgtattgtaagtggttatatgcccagctaaagattgggaagttctattattatagaaggagggcatgcatagtagagaacaacctgcagtccttgctgtataggtcattttgtcagtgtaatttttttctgatatttgtaatgaaatattgcctctagaaattaaagcagtatttctttactgatcttctgtcattttcttacatatatatcataaaacccaagaaaaaagtacaaaatgttaatagtagctctaaatgagagaaagtgagagagagagagagagagacagagttcagagagtatgaataaatgagaggaacacaggctgggccatgcataatgcatcttgctgtgagtcaaatctgaggattacactttgcatttaaggtgagatactctggtcactgggaaattagtatctcctgagccaaaaagcccatatgacacattggcattcaaatattcataaattatttgctttgtggtggtattaacactttatatttttgaatgacatagattctaagctgataactgttccccaattttcttttatttcaacagtttttgtcattctgcatttctcagatttcatgtttcttttaagcatttattaagcaatcactttgccagctattttacatcaattttctcacatatagaatttcaaatttacaaatacacacacacacacacacacacacagatgaactaattagaagttttgaacatcctctctgcatagaactttgttaaatgctctggaaatatttttttaaagggtagtactgtcaggttgtgtgctacacgtactctgaaaatggaaactgcagaaaacaagaaaattttctaaaacaaaagcaaattataggactagtgggcatggtgttatgtgcttgttggcagctcacactcatcatcagaaataactcacttttcataactgaaaacataggtgttataatcctgcttctagttgtcattgcttcaactcagggtactgtattaagaaatggaaagtatgtcagaaaattgctcaaaggatatatataaaataacttttgatttttttgaactttcatcagttgtttcattcatcacagttttggttatgttccatttttacagatccaatgacttaaatagggataggaggtcttttttattccattaattttccctaagagaaaagagatgtgctatattcaaaggggcatgtgtgccaaaaataatgaaattatatttaaaatttgtgctttatctttttctatggcgtctttcaaaaaacatttcttttcacattttgaaaatacttagactagagctcctcttttgacttgtagtaagacggtgctgcaccctgaaaagcattagaaacacccatctccctttaatttttcttaggttgtcattcaagatccttgttgctttgtcgtttgactccattttttctactaacctacttttttacccatcataaacccaacactcatctgaaagtgcagttttagcggtttccttattgccaaatattcttgatcttattgcccttacctttctcctcctcaaataccctgtttcactagccctttaaatccaatgtgtatcacacccagctattttctccccacaaaccaatactgcctcttaaccctcctaatgttgttaatgataattctattccctttaatccaggttttaaacttcaaagtcgtttctgtttctctctatcaactgtctcacacaatcagttgctgtgcttattctagggtccacatccgcagtgtcttcattttctgtttggatcctcctttccattccagcctagttcaggccctcattattttttaattgacactatgttctgtacttttgctttttccaataaaccatgatggctttcaagcccaaatcacttgttctctgaatatgcccatcattcttacctttaagtttctccaataaaatattctcctccatgtatctggttattgagatattacccatccataagagtcaatattattcccatgggaatttatctgaaaccatttaatacaaacatcatagatgggctcatataggcaatttcactttgatgcattgcatttattttcttctgttctgaaactgtgatcctttaagacatacagtattacaaacaatttaaactcttgcattgacaacacattcacaaaacttagtgcgacaaagttataatttttcttggggcagtaaccatgtcttatttatctctgaatcccccagagcactttctgcagtttttataaaacaggagtacatcaaatatatagtgaataaataaatgaatttaagacttcttactataagtattggtaaactctagatgcaaggaatggccaaagaaccagccagtttcttttagcataaattctttattcattatctaagatgtgctttatttcagtattctgagacaataaaacattatgactttttttggaaataaaatagatatatctacaattattttgctaaaggagataaaaatgggtcagtatgatttttactgcctaagtgtatggcactaatacatactctatacaaaatgtgggaatgaagagaccaacattaccttcacagctatattagttacctattgccatatagcaacttaccataattttagcagcttaaacaacacacatttattatctcatggtttctgtgggtcaggagtccaggtatggcattgctggattcaatgcttcagggtcttaccagtctgcaactcacatgttggctgggtctgcagtctcatcagaggctcaactgggtaagaatttgtttctaagctcattcatgttattggcagaatttatttccttgaagtggtaggactgagatttctctcagctcctggaggttactatcagttcctgtagtgtccatttctacttgcttcgtcacagctgacaagggagaatctaaagctagtttgttagcaagacagtattatataacatagcatgaattgtgaagtgacatcctgtcacttttgctgttttctgctgactattatcaaatcaccggtctcacactcacactcaaaaagagggcattctataagactatagacaccaggtgttggtgttgggtatcttaggggcttacctaaagtctccccacaaagacttttggtgtgtggttcctatttgatcatgcgtgagtcttatctcagattctggtgtgagtattattctatgggcactctcctcccattttccttaaacattcatgtctgaattctcactgataggatatagacattaaagaacatggtgggtttggagggggaaggaaggctacatttatttgctggttgtttcaagggctgaaactatggcagagttcatactaagattcctaacaaggagttacaccaatgcagaatgcgatgaccaggacaggacctggcctgctatgtggtacaactacttattttactgatttgcaaacagcaatgccgagacggagtaacttgcccaggattgaaggggtatttgtggcctacctggagaccctgagctcttagcaaagttaatgggtgcctgtaatttattcagctaaatatagtatactgacattggctttgatccaaagatgcaggttttggaatttttttttacaacatttaaaattgatatcacagagtaaacgttagggctgggtgcggtggctcgtggctgtaattccagcattttgggaggccaaggtgggaggactgcttgaggccaggagtttcaggctgcagtgagctatgatcatgccactgcactccagcctggacaacagagtgagaccctatttcaaaaaaaagaaaacagaaacagagtaaattataatgatattttacttattttggtgtatgaagaataaaactaaaagattcttttaaaaagtttctaaatgagattttttaatgtatatgctagccattaatttatttatagagaataaaaaaataactaaaagagtatttcctatgtttgataaaactctgtagagaatgcatatggaatgaatgagcagtcaaaataatcaatcatgaagacatgaaacacttttaaaataaaccttggctagaggcttgactctttttcctttcctggttgaggtctacttcttaaagaatatgttagtatttctttcaacatgaatcactcattcatttacttatttacatattgatacatgtgatattatgcatatactgtatattagacagtatgctggcaccaaaaatacaaaagtcaaggcttagttttaagtatttcctagtctctggaaagcaggaaacataaacaaaaaccatcatattatgttctaggagcatggttatataaactaactctggaacaaatccatgggaaaaaaataattcctgtgtctgaagagatggggacaccttcagaggaagtgacatttaacaccaggaaggtgcacagtgaatgaacattttctctacttactgttttcttagtttggtagcaattttactttctatgcattttgatacttcacagttgcgtttctattctgacagaatatttaggtgattttgaacttttagtagattggaataggagcaggactgaaagcaacatcatttgtttcctttactactggatactgctccaaattttatgctatttaaaatgtcatagaaaatggacatatgcattgatgagtgtcaaaatagatgatttattttgaacctgcggtgctcaggttacaagatttagacgtgagagaactacttctcaatattttgaattcatgttctttcatcttcagtgaagagaaaaatgagtattttttaacctatagtagccacagattgaattagtacataaattaattgtatcttttaatgtaaatgaacccttcagaatcaatgagaaaaataacatttgcaaaatatattcaaaaatagactttccatgatgcctatcataacatttcttgcatttctggctttatattataattggttttctgtcttagctcatatttaaattaattaattcaatacttaaactgtaattatctaaaaagtggggctaattatttcagtttactccagaagtagattgtaaaactcaaaggtgataatgcctaggaaaatgacttataaactaaaaactctacaggaataaaatgcatttaaaatttggcaaactgtctgaagcattctcatttcttaagtttttggaacaagttttgaggcacagcagaaattttttaaaaacatttttctgtaaacttaaattccataaagtcaattatacattgttacaattaatgttctcttgaagatgtgctggatagaggataaatatgtttttattagagttcttacttgcaaattcatgttaatatgagtcatagtccaaatgatgcagagacagtttcctaggacagctctgaaatagctcttgtttctaagggtctgtctgtctctttaccacttcctccctctcttccttccctgcttattttctttttcccttttttgcttgcaatccagtttattaaaagataacactcagtaggctgtctaaagatgaaaactcctacttaggttctggaagagaacttttatttaattgtaggtgtgtcttggttttctaacctcttcctagattagctatgaaaaggaaccaataaaaatagatgccatgtggtaaaaatgtgagaattttcaaatcattaacctatattacaaatacttaatcatcagtatgaagtattttaccttttaactagaggaagtaagttatgtacagcaattagtgtagatggtaataagatgtttcagcaccctccaaataattgtgtgtgtgtgtgtgtgtgtgtgtgtgtgtgtgtgtacccctatcaaatgaagtgtcaacactataggtaggtagtttttagaaaagagtaaaaaggagctaattattgaatgaatgcctaatgtgtgcaaacaagaaaaaaagcttccactcccaccaacaattagggaaggtacagacatcctctcaaagtttggtgaataaatacatctgtccattgattatggatacacctgtccaatgtaatcaaatattttcaaaacaaagaataagaatctccatatacttatttctttgttaaaacaattgtatagaacattagtgttagaattgcagtttatctagtcacacttcttcatttaacatatgaaatcctaagaggtcaggtgagttttacagtattctagctggggaaaaaagcttgtactgaaattcatatcctttttccagtagagttcttttcactttgttttttcatttatttatccagtcatcaaatactcaatgagtgccttgtttagcagggctgaaacaaaaggtagtataattaagatcgaattatctttttttatttctttttttcctcttccttcctttttttccttcctttctttctccttcctttctttctcctccttctcttctttttatattccttactctgagagatattattctgaatattgggaattcctaaaaagagagtgaggcagatagatagttacatacgtaccacactattactgcttattagagttaagtaaaaatcagagaggacatgaatgtagacattgtagtgaacatcaacttatatttaccacattattttggatatgttgagacagatttagggttggaacacaatacaatgttaattattgttttcctgttatttcaactacctctcccttccatccccacaccaccattttataaacttgtcttgttaatgtaaatgacatagattcaccatcactacatcaccattgatctataatgtcatgaaatctttgatgtactgaggagtattggtaactgttggggtgggacaaactgatgtaaatgcagttttctttaagaattcacaatgactataaagacttgtggaaacatattaaaaaatgtttctggataaggtagagtggctcctttcaagatcagctaaacgtttaacaaaatttagagactaaaatttcattattattctacaaacttgtccatggattttgaaaagaaaaataacaatgactttggaacttaaaactgttgaggggagagtttttctccccagatgttggtaaatttatgaaattaataaaattgcatgggaatgggcactgaaaaatgccttccaggacatttgtcatattctcagtatcaattcatgaaatggaaaccagaagttgtttctgtagtcattatgtaatagatagtaaacatgcatttttggcaaatgaatagttagcaaattaggcatctggatgcagtggaattttggattcttaattgcataattcacccttgaacacctgccagaggaaaaacgagcaaagataatatagaatctgaggaaaaatataagctgataaatagggaatgataatgcagtatctaacaagtttttgacttcacatcctagcctgttttccacaattaatactatttctgtaattatccagagatatttagatttgcataagaggtattctaaggatatggaattcagctgattataagatattacatttgcttatcttcacattttatcattggaaagactttttaaaagtgagaaattcagtgcatgctatgaactgctttggatatgattataggaattaaaaatacattctttgaagtaatgctgtttctgggtagtcacgatttttatagtacatttagaagtaagtatcagattttgaaaacatttaactatcaatttatcaatgctaccttctctgtttctctctttaagtcaaattattatttcttagtgctctacacaaacctactccatcctattgttctatttttactagacaagtaaatataaacatcaacagtaggtgatatatactaaacatattcacaataaaatatggaagggaatctaattaatcagtaataatggctggatggggactaggttaggaagtcatgatcgggtctagaggtaatgtgcaacaatggaagaagcaagtgtttgaatcgccttacagccttttataaaatatggaaatttaagttttactctctgagtctcagtcttttcattggtagccataagcataatagcattattgtagggaattaaatgaattaaactgcttatgggcatttcaataaaataaaagttgacatacaacaaaattatagcttccttgctactcagtctctcactatacaagcattttgaatagagtctttggatattaaagttagaatgcagcttattaagactatcatgtgttcctttgggttttgtgagttggaactatctcagggaccccagtaaggaagagtgatgctgcatcacgtgggagagctccagagttccattaccacctgcctcagagtggtgctccattggagggctttgctctatacatgggtatacaatagcacttgaaggatcctagtgtgtgtgtgtgtgtgtgtgtgtgtgtgtgtgtgtatttttttgagacagggtctcgatctgtcacctaggctgtagggaatctcagtatttaacaaaagtttaaaatccactaattgtagtccatttcatcccaattttactgatgagaagattgaggacctgagaagttatgttacttatcccaagcaaataattattgtggcacatttacctattcagtgtaggttaaaaaaaataagcactgaagtgaacaatttttatagaatggggtttgacagattctatttgataaagaaaaagacagacgtgacaatatagaacagacagaatgagttgaagatttaatgaagagtaaggagggtaaagagaaagtcgaggctttagaaaaatgatccaagtcgatcagctgaaagtcccaatagagggagatgtggattctgttctcccggtgaggatggcaggcatcctgctctgaattatgaggaggaatgatacagctgatgttggacactggggagagtctgctttggctagttggcagccttgggtgttgctgaaggatgatggaagcaaggagtgaaggtaactgaatagcagaggctccctagagccatccctgtgatttaaagtttctgagaatgaggtttggagcacttggggaaaaaaaatgcctgaaggtaggtagaggttggttgaggagaccactgaattgtgtcaatatgtcattttgaggtagctgatttatgtttattttggccatttttacatatcactgttattgctttttgctaaaattcactcattgtggcctttttatggctgctctgtgcagcactaatctgcatcagaattgggaagagatatggcatctgtctttaagacccagggcgtacctagctgccacttaacacaaaaagaacctctttaaaacactaactttaagataacctttggagttgaaaaaataaaaagctctctcttgggagaaaaaattcttgtctaggaattgatcatgtatgtgtaagatttccagtaagtcaaagccatataagttccttatcatatagtctatatctctatggcatattttgacacttaaatattatcctaataataattaggatgtattattttaatatgtattagtttcactataataataataactatgattattattctttttgctttgtgacagactaggccttgtcacatgaaggtaggttaggaaaatatgtttatttttatttacagattaggaaataaatacatagaagttaagttacttgtgaagattccccatctgattacacacaagggtaggtttaacaatcttgtcttcttaatataagcccactttccagtcactatatcaggatgtcctcatgtagcatataagatagcagtacatgtcatgctgcttcatatattgccatctcaattactgtgcttatgtgtagtctcttcaaatagactgcgagctatggaagtagcaacaaaattcttttatttcttttgggcttccaacctggtagacagtaaatacttattatttacttacaatttctcaaaggcatactattacaatatatataataatctggctgtcttagtgccagaccctatgcatacaaaaaaagttagacaatatctttgtcctccaagtgttcagtcagatgtgagaaggacaataaatccagcaataagtatggctgcctccttgtcattcaagtctcagcttaaatacctcctcaataaagacttctctgactcccagtctaaggatgcttctttaccctaaactctaatacatcttgtcaatttctgaaaaataacttatcccaatgctctacttaaaatagccctaggaacgcttaaatactgttggtgggagtgtaaattagttcaaccattgttgaaagcagtatggtgatgcctcaaagagctgaaagcagaactaccatttgacccagcaattccattactgggtatatactcaggggaatataaattattctacaataaagacacatgcatgcaaatgttcattgcagcactattcaaaacagcaaagacatggaatcaacctaaatgcccatcaatgacagctggataaagaaaatgtggtacatatacaccatggaatactatgcagccataaaaagaaaaagatcatgtcttttgcaggaacatggatggagctggagtctattatccttagcaaactagcacaggaacagaaaaccaaatattgcatgtttccacttacaagtgggagctaatgatgagaactcatgaatacaaagaagggagcaacagacactggggtctacttgatggtggagggtgagaggagggagaggagcaggaaaagacaactattgggaactaggtttaatacctgagtatgaaataatctgtacaacaaacccccatgacatgagtttacctatgtatcagatgttcacatgcaccctcaagcctaaaagtttaaaaataaaattaataaaatagctctgagacccacaccatcttttttttattttccctatagtgcttctcccttcctatattataatttatccccttggtttattatctatctccttccactagaatagaagctccatgagaacagcgacaattttgtcttgttcactgttgtatgcccagcttttagaaaagcagatgcacaataaacatttagtgcatagagaaaaaattttatctagcctctagctgtaaatgccatctaaatactgcgattctcaaattctgtctctcaaattcatgtctccaactcttacctttatattgagcccccaataaatagattcaattgcctactttttttttttttttagacggagtcttgctctgtctcccaggctggagtgcagtggcacgatctcggctcactgcaagctccacctcctgggttcacgccattctcccgcctcagcctcccgagtagctgagactacaggtgcccaccaccatgcccagctaattttttgtatttttagtagagacggggtttcaccattcacaggatggtctcgatcacctgacctcgtgatccgcccagctcggcctcccaaagtgctgggattacaggcgtgagccaccacgcccagcctcaattgcctactttttatttccttttgaatgtctaataggcatctgaaacttaacactttcaaaacataattcttgattttcttttttcctcccatgccaaactggtttactctacaatctacccagtttaataaatgttttcattatctacctacctgttcaagttaaaatttatagatccaatccaatgcctatcttcctagaaaatatatagtagatatatgtcctcctctctactatttctgccatgactactctactccatgaaatagtaacatatttcacctgaattacttaatgcaaaactcttctgtattttctattgctgctgtaacaaattaccacacactaggtgacttagaacaacacaagttaattatcttacatttctgaaggtcagagattcaaaatgaattgggctgcaatcaagatgttagcagggctttgttccttctggaggctctagggaaaaatctatttgtcctttttagcttttagaagccactgacattacttggcttgtggcttcacccttcatcttcaaagccagcagcatagcatctttcaatctctttctctgcttccactgtcatattgccttttcggactctgaccctcctattttgctcttataagagtccttgtgattacattggacccactgagataatccagaataatcttccatctcaagatcctttgctgaaaaatatctgcaaagtcccttttggcatgtgaggtaacatactcacaggtccttggaatcacagtgaggaaatctttataggcaaggggtactattctgtgtaccccaccttctaaatgtgtttcttgctcctactcttgcccttttctaaactgttcttcctcaagcagcccatacagccttttaaaaacctgaatcagatcttgaccagattcagagagagtttaaccacaccgttccctggttaagatccttcaatgtctgcccatttaacttagaataaatctcaactccttaagttggttcacaaggccctgaatcatggggctcctgttacctccacaacttcgtcttgccccattccctagcttgctcactatagctctctagttagttttctttatgttgattaaatataccaataccttccctcaccatgaggcctagcactttttactccctctggcacaaatgctcttcttcaaatttctcagctggctgcctctttccccatttctcttggtgaagctctttggctctctactgcaaaagagatattattactgcatttatttcccttattgaaatagtcacaactgcaatgattctgcttattgtttgcatacagtgtgtgccttttctcgaatgtaaacttctgtaggacagattgctcaactgttactatattgatgtgctccgatatttagcacaaggcctggatttgttggtgtattgcaaatgaatgtctcaataataataaaagtaactcctattgagagtgtattatatactttatgtgatttaatttgtctaagcttcacaacagtatgagataggtacatttcttacctgcattttgtagatgaaaagactgagacaccaaaaagtaaaataattttctcagagtcacagctagtaagtaaaaccagaatttaactcaggaagtatgactgtagagtccatattcttaatttctatattacactagtagtttcagccagtaaaattggtgttgatggaaataaacatgaagaatatatagttttagcttggaggaggaatgttaaaaatacaaatcaataattaaaatacttgtacaaattgcaggctaatattcaccatacttttgttattgggaaaatcttttagaaaggaaaaaatcctaaaagagagaattggtagatttgcttatctgaatattgagagatcttgtatgacagaaatgccaaaaattaatttagaggcaaatggctaagatgttttgcagtatatatgacagaaaaaagttaatattcttactatatagattaagtcttcaaaaaataagtaagaaaaagatacataattttataagcagcagatacatgagtaggcaattcactaggaagacatactatgaaaagtatggaaaaagctcaacttactactgataatccaaggagtgcaaattaaagcaatgagattatttttgaacataaaattgtcaaagtttaaaaatgggctatttgtcatataatgatagtaaacataaatacaatctaattttctagtaatcgggcatttttagatatattatgatctagccaattgatggaatgctacacaatcatgatgatgatagagtttaaacagtgggttacacaactttaagtattgtttgaaactatttttgcaaagcattttttgtttatattttcaagggaaaattagggaaggagataatagcaaacaagaggatattttttattttatatttacctgtattttctgaactgtcttcagtaaacatttattgaaaagaaaagttggctgggcgtggtggctcatgcctgtaatcccagcattttgagaggctgaggtgggtggatcacctgaggtcagcagttcaagaccagcctgaccaacatggtaaaaccctgtccctactaaaaatacaaaagttatccgggcgtggcagggggcgcctgtaatcccagctactcatgaggctgaggtaggagaatcacttgaatcctggagtcagaggttgtagtgagctaagattgtgccactgcgctccagcctgggttacagagtgagactctgtgtccaaaaaaaaaaaaaaaagatgggaacatatataattttattgttcatgttcgggggatgtcatgtttgggggtcttaggttgtcctaggtcactagcttcctcaggagtgagttctcctgtttagtcctattcacgtcaatgatgaatctcagacaccatctgaccctgaagcagtttattctggcagtacttttacaaggcagatgttgggagcagagcaatggcatgggccagatacaatcaggacatcagatggccatctgactgggagggtcttgacttggagacaccattcccagagtttaagggatctttccccctttcttattatgtcttcagtccaggtcagttactaggagtttccttcagagggagtttaagttattcttgtaagagtaagctttgttttaaggtttctaggaattgcatctgtgctgaggtggtcttgtctcctggaaactcccaggccaggttgcatcatgctgctaagtgtcacatagttttggccccatgagatttttgagtaggccttctcactatcattaatcacatagccacaatacatctcttacaatataccacataggggaaagaggatagggcttttcagtctcattataaactagttcaatctatacttgatcattagatttatctacctagtgtataactctgctaatgacttctgttatctgcttcataaagtcaaaaccttagcttgatattcaagatccacaatcaactgatcccaaattgtctttctacctctttgttaatccgtttcctgttcttgattatagatatttatgtgtccacttgaaagggcttttaattgcttctgcctattgaattctacccattcaggcagggccaatattaattgtaattttctacgaagagtatgctctgactccctgctaaaagtgacccttttcacctaaagtctcacaatactctgcaatattataggatacttactatatacagatatatagtggttatttttgtatatggctcatgttcccaactagattttaatatgcttgtgtcatagttcatgtcctttacgtatttctatttcccacagtctttgaatgtcatcatgccttgcaaataaaaacttcctaatttaatgaaccgtgaacttacaagtttgccgttctcttgctggtttcttaatagtttctttaattcactaatcacacaataatcttccaatatatggagtattttaaatcccttctctgccaactaatactatataatcttgggcaacttaatatctctgtgctttatattcttcaactgtagggcttttctgaattaaatgtgataatacatgaagaattgaacattgtaagcactcaataaatgttagccaaattataaaaataatgctcatatgcattattactactaataactaatatttgtgtgttactctgtggacattgccgtttaaaaacttccctttttaaggaacgcttatttttatttagatataagttatataacattaatatagtttttctttactgtgtagtgatttgtctacatgtattaattaagattactctagcttctgtaaagaaaaaaaaaatcatcaattctcgatagattaacccaatgtaaacagtttattcccacccacttggcagtggcaggaatggtggtaggttggtctcagttctacctgatcttcaaaaacacaaattgactgaactcttttttcttccacacatgatttataaggtcaccttgggcaagtacttccaactgccaaaatgggaggaagaaagagatcactgaggattgtacagcagattcttatgacccaagcctggaagtgcaacacttcacttttacctttattctactggcctgaaattaatcacatgaccccaccaagacacaagggaagctgggaaatgtagtctctatctgggcagctgctttctagcaacaactctcaaacatggaaaagactataaatctttgcgagatagatagctatttctgccacattatttaaactttattaatacttggatgttattacagcagtcacctttaagtaatagaaatcattgtgtaaaacaataagtctgatctgccctcaattgccagcactgcttttcctcatattgtcttctttatttaaggctacatttaatctctttaagtgtacttaataagtggaaatatctatacttaaaaacacaagagtcatgatctaaagttacagatattccttaaaaaaaaaaaacaaagtaatggctaagccttcttaaaaacaattttcccccattagagaaagagtataactcattttaggaagctgggtttaagtttgatatatcaaaaaccatagaggcagaatttcttaaaatgttgggcatggtttattttgaagaaaaatgttatggtatgcatttatcagtatttgggaaaactgtaaattatacaggaatagtaacaggaaacttgtatttatttttacacaagggaagacttcattcagatggcaaagatcatgagagaaggaaatgtggttcccaaaaggactttaacaactcctatgattccctggcagatgtggaggggtggtcagctatgtcttcagaaaacattgtggggttaggaagttgcctaattagaaattagaaatcaccacctggaaatgttggcacattgatggtctcaaacacatcactgtgcatggaggtattgagatttccctttcgatgttaggggtggctgttaaagctgagaaggacttgattcttcatattgaagacaacagggtgaagtaggttcacaaggaaactttagaataagcttttctaccctcaaccataagtaaaaattggttttcccttatagtaaaaaaactaagacataaagtctggaagaaaacccagtagtatcattagtcaaaatgtaggggtaatgcttttttttaaattaaaaatgctctaaatcatgattcttttggaatcatggattagttaataatcagtgcctgttctgttctttcagtaaagagctatgtatgacatatttttattatgacaaatgccctaagacttggtcaactacttctgaaccacatctggtggaaagaacaatctcagcaggaaggtaacttagtgaaaaagtaaagttcaaaactcaagaataataactaacatttattgatactcactatttttaaaacagtttatttattttcccaattaaacttacacaataagtactgttttaatgtcatcctaaatataaggaagatgctttataactattttaaatatgagaaaactgaggttcataatggctcaataattttgcctgaggttagctaatcagtgagtattaaggctgtgatatgatccaggaagcctgactttagagattgcacgttgaaccctatgctttctgctcatttataggcattgttttatgcacacacgtgcacatgcacgcacacacactttcaagctatgtgctttcacatacttcaaacttgggtgtcatctgtgactcatctatttctagacttagaaaaaaaagtctatttctagacttagaaatggtggttatggacaatagatgagtcacattcgcttaggtgttattacagcagtcacctttatgtaatagatgtaatagataatacatttaataatacaatttagataacacaattagtaacagatttgatatagttgttaattcatttgtgcctgcatttaataaacatttgctgattccgtatgcgctgcaggcactgtgcaaagatataaggctactgtgacaacattgatctcgttaattccagtctttcccttctgtaacccatcttgcattactactttcagaccaagtccttcaatgttactttcatcctgaaaagctaagcttttctgtctaaacttaaaggcttttaaaaacatggacccaaccgtaacttcctgctaaactacatgacttttttctcatttctacctccattttcctcacaccttgttttgctcatcagcttatctaaatcctaatcatattttaaggttagttttcccatggagttactacaggtattttctatgaggtgggggatgtaccacatacacacatgtacaattatgtactgtattagtccattttcatgctgctgataaagacatacccgagactgggaaatttacaaagaaaaaaggtttattggacttacagaaaagaggtttattgaccatttggtgcggaggcctcataatcatggcagaaggtgaaaggcatgtctcacatggtggcagacaagagaagagagcttgtgcagggaaactcacccttataatatcatcagatctcatgagactcattcactgtcacaagaacagcatgggaaagacctgcctccatgattcaattacctttcactgggtccctcccacaacgtgggaattcaagatgagatttcagtgggaacacagacaaaccatatcattctgcccctggccccttccaagtctcacatcctttttcatttgaaaaccaatcttgccttcccaatagtcctccaaagtcttaactaatttcagcattaactcagatatccatagtccaagttctcatctgagacaaggcaagtcccttctgcctatgagcctgtaaaatcaaaagcaagttagttacttcctagatacaatggggttacaggcattgggtaaatatagccattccaaatgtgagaaattggccaaaacaaaggggctacaggccccatgcaagtccgaaatccagtggggcggtcaaatcttaaagctccaaaatgatctcctttgactccatgtctcatatccaggtcacgccgatgcaagaggtgggttcccatggtcttgggaagctccactcctgtggctttgcaaggtacagcctccttcctggctgctttcatgggctagtgttgagtgtctgtgacttttccaggtgcacagtgcaagttatcagtggatctaccattctagggtatggaggatggtggccctcatctcacagctccattaggtggtgccccagtagggactctgtgtgggggttctgacctcatgtttccctcccacactgccctagcagaggttctccataagagccccagcccagcagtaaacctctgcctggacatccaggcacttccgtacatcttctgaaatctaggcagaggttcccaaacttcaattcttgacgtctgtgcattctcaggctcaacaccacatggaagttgccaaggcttgaggcttgcaccctctgaaaccatggcctgagctttacattggcgcatttcagccacggctggagcagctgggacacagtacaccaagtccctaggctgcacacagcatgaggaacctgggcccagcccacaaaaccactttttcctcctagacctcctggcctgtaatgggaggtcctgctatgaagacgtctgacatgccctggagatattttcgccattgttttggggattaacatttggctccttgttacttatggaaatttctgcagctggcttgaatttctcctcagagaatgggattttcttttctatcgcattatcaggctacaaattttgcaaacttttatgctctgcttcccttataaaactgaatgcctttaacagcacccaagtcacctcttgaaggctttgctgcttagcattttcttccaccagttaccctaaatcatctctctcaagttcaaagttccacaaatctctagggcaggggcaaaatgccaccagtccctttgctaaaacataacaagcatcacctttgctccagttcccaacaagttcctcatctccatctgagaccacctcagcctggactttattgtctatattgctatcagcattttggacaaagccattcaacaagtctctaggaagttccaaactttcccacatttttctgtcttcttctgacccctccaaacaattctaccccgtgctgttacccagttccaaagtcacttccacatttttgggtatctgttcagcagtgccccactctaccggtatcaatttatggtattagtctgttttcacactgctgataaagacatacccaagactgggaaatttataaagaaagacttggacttacagttccgtgtggttggagagccctctcaatcatgcaagaaggtgaaaggcacatattacatggaggcagacaagagaagagagcttgtgcagggaaactcccccttaaaatacatcagatctcgtgagactcattagttatcacaagaagagtatgggaaagacctgaccccatgattcagttacctttcactgggtgcctcccacaacacctgggaattcaagatgagatttcagtggggacatagccaaacaatatcatatgcaatttttctaactggtatacatttatataagcatataaaatacaaaagtaaaaatcatacatgtcctctgcaaagacacaacacaatgtggggaagactagttatgttctttaccctctccatccctcacactcaagtaacaaatcttaatagtttgttgttaccttccattattttctctctgtgttttgattgtagggactaaggtgagatatgtttgtagttagtgttatgtgtttctgagtcacataataaacaatttgatttattagtttaatttgttaatttcatcaagatgaaaccatcagaaatttagggtgaaatcttatcatctcagctcagggctctaggaatagaatatcatcatattaagatgtattagtgagttccagttattgatatctctatattcttagaagttacaattaaataagttgccatttccacattaatctactaaatataggtcctgtttctgcaggtatatattcattctggaaattcaaaagaggattgtttggggcatcttgaggaacataccctgcacaaaggaattacttaacacagccatggtgttactatgatcatatctgccactatattaattagtgttaccagagtttaacatttgggcaatggacaatgaatcttttgaaaacatttacttggcaaaaattcaaaatgtactttaagtgcatttttgtttacaatgaaaaatataaatatattgtaaatatagtatggcatgatgttaatatttattgaaatttgggcttttgaatttaaaaaaattggatcacgaatgaggtaatgtacagaatctcactggtgtgtggcacaggtcttaattgctatcaggtaccagtttgtagaagtgccaactgctaatatattttgaaaaataacaatttagggagtaaatattgtgccatgtattagaaagcatttcttcagatgtcatttattttaaacataattattaaataatcctaaaaaatttgattataatatatgttatatttattacttgtaaataccagacatatacccttttctagacagataaaatagagttgttaactttgggctaggaatactgttaacattcatactgtatactaattatggttttaagcttgttgttcattatgaataagtatagcaaagcttgctttgctgttttagagtatgtttgattatttttatgtagaagtataaatactatagaaatggtataggtgactttccagataccattggaattctgaaattttcttattttgggtcatgattctcttgattatgaggtgtgtatgttaggtaaattacctaacttctgtgtgccttactttcctcatttgaaaagtagtaataatagcaggtatagctgtaaagggttaatgtcaggtttaaatgagataatgggtataaagtgcttaaaataatgggagccagaaagtgcttcaaaggtgttagaatttattccaggtaataattccacagagtgctgtagaaacttgtttcatagaaacttaactggactcaacagtgttgataaactgtatgcatgtcacccagaatcattgtaatacaaaatgaagttcctaactcaattgtctgctttgaactttacctaatccatttcctgggtgcattagcacatacttgtctgtcagtaggagctagttgaagtactcttattttgcctttctcttgaagatgatcaaggagagagtgcttgctgagctaattcaagtctccttgaatttgaattgctgagaaagcagcataaaccagaatgtcttcatttatggcaagttcttgacatatatgtttataatgagtgacatatatttaaagatagacataataatgttaacaacagtaatagtgaaatggacactaatgtcaattgcttgttaaattttgaagacttataaaagagaaatatgagccttgaagttcttttaaagtataggaagccattatattattgtcttgacttgaatgagaactgtgaactgatactccaggtctcacaagaatctacactgtctgttgaagataagaattttgactaggaatctttgaacaaatgcactgaattaagtactatttctctcctcagtctgctgagtaataataatgggattaataatgcttttcatgtaggcttactatgaatgttaaaggcattaacatatgtaagatgagtaaacacttggcacatatggagtgatatataaattatagctattgtcatttttttaaaattatactttaagttttagggtacatgtgcacaacgtgcaggttagttacatatgtatacatgtgccattttattatgaagtatgtactatatttttgttatttcagtgatgtataatagcaaagttctcaataattcatttaactagccatagaagaagttattatgcttctgactttagaaaataataaaaatattaatttaaataaatcaatgaactatagttatctaatagcatgttggatacaattttagagaaaatgatgtttatgttcaagtattatgtcagcataagggagtctgttaatatatatgctaaagggggatttagactatttttaatccataagctgtacaattattgttgtagtatattgctcttaatcatagaaacttcttgtttagtgtatatagaaggaatagagcatcagtgcttaaagctgagaacaaagttggttagagaatctggataaaatctatctaccctaaatgaaaccagacattgttttgtgtaactagagagttaattttataacattgccatcaatgatttctcttttacattttctattctattgcatggtacacttagaattccaaggcagcttttccctagtcagagagtttgaactaatagtactttggctttcaagcagaaacagcaggcatgctcactagtaagtattgccagtcatttaatatatcttttatttttctaaatttgtcttatttatcctttgtattccttggataaagtattggtcagatctatgctccacaggaacaaaatattaaacacctattttgtttatgctattcattctttaaaaacagaacagttttttcccattgtctagaaactgttattaagagacagctaggagttttaaattatattgcttgcagtattgaacaatgcacccatggagctctctgacactaaaaataaccaacccagtgaattcctctgaggattcctttttttctaagtaattttttctttttgttaccatataataattgcacatatttatggaatatagagtgatattccaatacatatatacaatgtgtaatgatcaaataaaagtaattattatattcattgcctcaaacatttatcctgtctttctgttgggaacattcaaaatcctctcttctagctatttgaaaatgtacaatagcttattgttaactaaagtcaccctactgtgttgttgatctagctgtagtaattttgtatctgttgcctaacctcttcttatcatcacctcccctctacccttcccagtctcttgataaccacagttctactctccacttctatgccctcaacactttttgctccctcatatgagtgagaacatgcagtatttatccttctgtgcctgacttatttcacttaacatgtcttccaggctcatccatgtgcctgtgaatgacagaatttctttctttttgtggctgtataatattccattgcatatatggaccatattttctttatccattcacccattgatggacatttatgttgattccatatcttggcttttgtgcatagtgctgcaataaacatgggggtgcatatatctctttgatatactgattttctttcctttggatgaatacccaacagagggattgctggatcatatggtagctctattttcagttttttggggaaccttcatactgttttcaatagtggctatactttttacattcccaccagtgatgtgtaagagttccctttctctacattgtcaccagcaattagtttttgttttcttgataatacccattataaccagggtgacatgaaatctcactgtggttttgacttgcatttctctgatgattaatgatattgagcttttaaaagtatacttgttggctatttgtatgtcttcttttgagaaagatccattcagatcctttgcccatttttaagttggtttatttgttttttgttgttgtagagttgtttgaggtccttgcatattctggatattagacccttgttggatgaatagtttgcaaatattttctcccattctataggttatctcatcattctattgattgtttcttttgctgtgtagagccattttagtttgatatagttccatttgtctatttttgcttatgttgcctgtggttttgaagtcttacccataaaatctttggctcaaccaatgtccttaagcattaccccgatgctttcttctagtagttttaaagcttcatggcttacatttaagtctttaatccacactgagtagatttttgtatgtggtgagagataggggtttggtttcatttttctgcatataagacacttaattttcccagatccatttattgaagagagtgttctttcttcatttatgttcttggtgcttttgtcaaaaataaactggcagtaaatatgtgaattatttctggattctctgttctttgtgtctgtttttataccagtactatgctgtttcggttactatatagctttgcagtatattttgaagtcatgtaatgtgatgccttcagctttgttctttttgctcaggattgctttggatacttggtctcttttgtggttccatacaaattttagaataattttcttttatttctgcaaataatgacattaatattttgataaggattgcattgaatctgtagattgctatgggtagtactgacattttaacaatattaattcttccaattcatgaacatgggatatcttctatttatttgtgtcatctttcatttcttttatagttttctgtagtgttcactgcagagtccacctcctgggttaaatttattcctaggtagtttcttgtagctattgtaaaatgagattcctcttagacattctttacaactgacatgtactacagtgatctttgaagtgtttgcagtatcttactctagaagaatgataaatggcatctcattatcttttttctctttgccccatgtggagactatttttgatcctatgacttataaatattctcttgaaggtcagcaaaggacttttctccataaaggtcctccttagctttctgaaacatttgacatagttgtctaccttctatcttctccttagctttctgaagcatttgacatagttgcctacctatctccttctccaagctatctcccatttatttctgtacctggtattatcctgcttctcttctatctaaacattccttctttttgctgcttttgctccttttttgctaaaattctgagctctattattgctaatgacctccatacttttgaaacatcatagatttcactgttgtagcaaatcacttcctgattcttttcataggccaatttcctgagtatttgctccatattttcaggtgtttctccttcagtattgggccctgaacactaattcaattgttcaaataaatctctttcttgtttttctgatttccattattgaatcaagttttcttaccttcagtttccctttaataaatgtaaattgcatcaagctgtcaaatttattttctgaaagcaaggtcccaaatataaattcttccttcaggaacttttaaacttgaaaatagagttctcagccaagaatattaccaacttcctaaggttgtggtgaagattaaaagtggtattgtacataaaagtgattaacattatatctggcacatagatagtggatatattattcattactatgactaattatattatctcttgatcactaattttattacttcaaatatttttgtcttttaagtgtcatttcaactaattatataatatcttgttagttattagtcatataaaaatgtccgttattcatttaccattccaaatgacagtgtttgtggacaatgtgatttacttgattttattcaaagaaatgggaggattaatactctcccagaaggagaaagaacttgatcagaacaccagtgacttctgtgtttgcccaaattccaccacttggataaagaatttaccttctggatccttagtttgtcaccgttattttttattttattttattttattttgagacggagtcttgctctgtcgcccaggctggagtgcagtggcgcaatctcggctcactgcaagctccgcctcccgggttcatgccattcttctgcctcagcctcccgagtagctgggactacaggcgccagccaccacgcccggctaattttttgtatttttagtagagacgaggtttcaccgtgttagccaggatggtctcgatttcctgacttcgtgatccgcccgcctcggcctcccaaagtgctggggttacaggcgtgagccaccgtgtctggccagtttgtcacctttaaatgtatatatgaatatattttctgattgcttatagggttatggtgagacttcgatagtagtcttatcttaagaggggatttgttctttgcccttttggaagggctctaactttcgtcttagcactctcccctctcatcatttttatcaaacatgatctcaagataggatcaagatgcttaagaacaaagtctaaatggttaataacacttatagtgtgacttcttctcaaaagtggaaaaaatacactgctaagaagtgaactataaacagcacattattatttttgtgagaagagaaagagaaccaaacatatgctatgagtaatataaacagactctgtgatactgttcttcatccacatgttattattatctgttctatgagtttaaaagtaaaaactacattttaatcacaaaagttgataataaagcatatatgcatatttgatactagtcattagaagcccagtagagctgaggataaaggaagctatattttctaatgcttctgtttctttgctaaaagctattctaagatgtgctgcttcttgctgagttcaaactattggcacttggcccagtgaaggaaaaatagagaattaaaattgttggcatttagtgtttcctctgaaagattatgtaatcaattatcttagataacattctatagaacatttttagtatctcatgtagcttagtagatttctttatcactggtctttaatatatttctacaagatgtttaacaatgtaatatgtaagtatgagagaactttgcattttgatagttgtcctattgtactctcattacttgtccagcttcacctttccttcacttcacatgtgtttttattgtcctatttcttagaaacattatgcattaaaaatgaaccacagaaaccaagagttgccaagttcatagacacagaaagtagaatgggggttgtcagggactggaggaagagggaaatggggagttattgtttagcaggtatggagtttcagttagggaaaatgaagaagtgctggagatagatggtgatgatggctgtacaacactgtgaatgcacttaatgccactgaagtgtacactaaaaatggtaaattttatgtgtaacttacgcatatacctatgtaacaaatctgcacgtcctgcacatgtattccagaacttaaagtataataaataaaaaataaataaaataaagtccaggtggccctggaatcagcagagactcatacacacaaaaaaaagaccaaatagttaagagaaatgattttgtaattataggtcatgatgcattagctgatcatgaaagcaatttaatagcaaattaatagatcatgatcagcatgtaaaccaaaaaaaagaataataaaacatatgaatacattgttcataatgtgaatggtactaaaacttctgtttcattataatttagccaatcagcatctatatggtggttatatagtcgtatgtggttgataccttgttctttttggttaatgccctattctaatagattcatgcccattacacagtggttattaaatattttgaaaatcatttctatatgagtagacactgtatatgatataaaatgtatttcttactgtgcttgaatttcaaaaatttaaagacaaaaatttcatacaggagaaagtctaatatagactgacagcaaactcttgcatggcaaatctaaggaaccagcgtctagcttgtgcctagttttaactgcagcattagcaataaagttctgtctgtccccatggccatggaaagggtctcttccctttgtggaagatgagatcaacaattcagagaaacgttctcaccagtgccgaagcactgattgaataaaatgagtctataaaccaaggaggctgaattcagatggctgaaaattggccaggtcttagagtttctacatggaggactccatctgtggttttatattttttttttcagacttttgtgcccagctgatctaggccaatttgctgtgtaattcttccaaaccatttcctcactcagcagctataaatccatccaacttccattgcagctcatgggcagtatcccgggactgtttggggcttaatttcactggctcattagtgcaaagctccctagagaatgcttacatttttactttttctggattttttttctccaaaggagcagaagtcttccttcacagatgctgttactggtagctggcagtgagctgatggatgatttttctttttcttttggcactgtgaggtagggcatgctcagcattgttactgtggtaaactattcattagcctcacttttaaaggctactagtgatgctattggtgtgtgatgctacgtaaactctgttaaccattctacaaccaattggactaaataggctaattgctcagtgaaatcagctcttccagtgtagctagtctgacatctgtgtggtaaatacttaccaagatttactcttgtgaatttacagctgttctctctgtaactaatagactgattgagagagttttgtaacagctgtttgagagaggtataatgaggtatgacctcttcacatgtacttcttgctagttgttagatgtttttctgcctttatatttatgttaaactatacagtcagtaaatttcaggttaaccatgactccatgccatttcttataatctaggaacacaaggatgcttctcaaagttgatcagcactaaatttaagataaattgaaggaaggcactattttctcatctattaagcacaaagacaaatagctggacttaaaactgctaaacactcaagacttttcaaatcaaagcacaattttaatagtaattttcaaatttcatttctgctttatttttctccatttaagaaattattttcttagatcatgagaattaatgttataactttttctccttgttttcttctttttcaaaaattcctcctccctactcttcccagtcaccctagttcccaattcacgggcaaccattgatttgttattacacattgatcagttattgtagataatgttgcattttttaaaagaatttcatgcaaatggaaaaatacaatatacactctgaatctgtcctctttcacttagaataattatttgagaaacatccatgttgttgctaatataaatagttcattttcatttctcagtggtattatattgtatagttatgccaaaatttgtttatctatttacctgtggatggccatttgggttatttccagttttgagttaaaatgtgtatgtgcatgtagatctatctatcatctctctagcaatcatctatctaatctggtataaacattaactagtctgtctagaaatatgttttcatttcttttgggaaaattgctaggaggagaatgattgtatcatatggtaggtttatgcttagtgctttaagaaactgccaaacagcttttcaaagtggttgttctatttcatattcccactaggagagtatgagacttctagtttttctttttccttcatagtatcactgtcactaacacttggtgtagtaagtgtttttaattttggcgtttctaataggtatgttgaaagtcaattgtccatatatgtgtggatctatttattaattccttattttgttccacttatctatttatctatcttcatgtcagtactgtaagtcttgattattctagctctataaaaaatcttattttatttttctttttctttttatttatttatttttttgcattttttagtttattttgcttagttttttttttaaattacactttaagttctagggtacatgttcacaacatgcaggtttgttacatatgtatacatgtgccatgttggtgtgctgcacccattaactcgtcatttacattaggtatatctcccaatgctatgcctccctcctcccccacccaacaggccctggtgtgtgttgttccccttcctgtgtccaagcgttctcattgttcagttcccacctatgagtgagaacatgtggtgtttggttttttgtccttgcgatagtttgctgagaatgatggtttccagcttcatccatgtccctacaaaggacatgaactcatccttttttatggctgcatagtattccatggtgtatatatgccacattttcttaatccagtctatcattgatggacatttgggttggttccaagtcttagctattgtgaatagtgccgcaataaacatacgtgtgcatgtgtctttatagcagcatgatttataatcctttgggtatatacccagtaatgggatggccgggtcaaatggtatttctagttctagatcctttaggaattgccacactctcttccacaatggttgaactagtttacagtcccaccaacagtgtaaaagtgttcctatttctccacatcctctccagcacctgttgtttcctgactttttaatgatcaccattctaactggcgtgagatggtatctcattgtggttttgatttgcatttctctgatggccagtgatgatgagcattttttcatgtgtctgttggctgcataaatgtcttcttttgagaagtgtctgttcatatccttcgcccactttttattggggttgtttgtttttttcttgtaaatatgtttgatttctttgtagattctggatattagccctttgtcagatgagtagattgcaaaaattttttcccattgtgtgggttgcctgttcactctgatggtggtttcttttgctgtgcagaagctctttagttgaattagatcccatttgtcaatttttgggggcattttatgtcctttgcatttctgtaggacttttagtggctgcttataatattctacaacattgctgctgggcttttggtgtcagttaggattacaatggacctaaagataaatacacggtgaatcgaaatcataatattaagtattctaacccttgaacaaaatatatctattcattgatttagatcttaatttcttttatcaatgttttataattttcagtgtgaagatcttacacatcttttctcaggtttactcctaaagtatttcatattttgtgatgctactctaaattatacatttttaaaatttcaatttgtaaacattgatttcttatatatagatatacaaatgatttttatgttaatagtaaactcaattaattctaatatctttttgtagattgcttatggttttctacataggtgatcatgctgtcagcaaatatttcttcctttccaatctggatactttataaaaagaaataattctttatcttgcctgactgaactagttagaactaccagtaaaatgttgaatacaggtggtgggagtggacttctttgtcttgttcctgattttagaaaaaaatgttcagtctctcaggattatgtatgatagttgtagattttccatagatatgcttcatcaagtttaggaagttgttttctatacctagtttgctgagagcttattttttagagtcatgaatagatattgtattttgtcaaaagtttgtgttgaatttattcagctcattagatatgtttttcagttattactttatttttcaaatattaaactagtaaaccccaacttggtcactttgtgttatcgtttttatgtattgttggatttattttgctaataaaacttcttgcatctatgtttatgtgggatattttcccatggtttcttttcttacaatgtgttttgtttttattatcaggataacgctagcttcacagagtgagttgagacatagtcatacctcttcagttttttgaaagggttttcatagaattggtataatttcttccttaaatgcttggtagaattagcaaataaagccaactgggcctagaattctcatagtgggaaggttgttaactaaaaattcaatttatttgatagatatgagctatttgagttatccaattcttcttgagtgaggtttagtagtttatgtttttaaaagaatttacccatttcacctaaattgctcaaattattggcacaactttttaattttttcccttttattatctataaaatctgtagtaccatcacttttaaaatttttcttatggagttttttttttcttctaacatttgttcttgatcactttgagtagaagtttatgaattttattgaatttttcaaagaatcatattttggttttattgatattctctattgtttttctattttgtagttcaccaactttaattctaatctttattattgcctctttgtccttactttaggtataattttcccctttttacagtttcttaagatgaaagctgaggtcattgttttgagatctttattcttttataatatagatgcttagtgctataaggtgcctaccatccctcacatttgattagttttatttttgttttcatttaaaaatttagttaaaaacaagttttaatttccctttctataacgtatttcactcgagtaatttagaactggcccagaatatagtatagtttggtaaatgttctgtgcactaaacaaatgtatatttgactggtaattttctctaaatttcaattaggtcaagcttattgataatgttgtgcaaattttctatattcttactatttttttctactttttaagtcagttatttaaagatagaggtgtttaatctctgaatataatagtgattttatctttccttctagttattttttttctcttaaagttctgttattatgcataatgcttaagacttattctctgttcatgagctgaccactttgtccctgctagtattttttattttcatctctgttaatattatttgcactgaaataaacattgtgtgaaaataatatactcacatcagttttctatgtttagtgtttgcatggtatgttttttctatcattttaacctatttgtgtcttcatatttatagttaatttcttttaaaaaattttaatgacacaaaataattgtacttatggggcacaatgatatgtttcaatgcatatatacattgtgtaatgatcaaatcatagtaattagcaaatctgtcacctcaaacatttatcatctctgtggtggccacatttaaaataatcttttctagctattttgagatatacagtaccttactgttaactgtagtcaatctactgtgcaataaaacaccagggcttatttttcctttctaattgtaactttgtatccattgactcacctctctccatctcatccttttccctgtcctttacatcccatccttttccctatccttcacagtctcaggtaatcatggttcactattcactacttctgtaagatcaacttcttaaggttccatatatgagtgagattatgtagtatttttccttttgtatctaacttgtttcacttaacacagttgtcttcagtattatccatgttgttgcaaatgaaaacaaattattttttctggccaagtagtatttcattgtttttatatgtaccatattttctttattcattcattactggatacttaggttgatttcatatcttggatattgtgaatagtgctgcaagaaacattgtggtgcagatatctcttcaacatactgatttcattttctacagataggtacccagtagttggattactggatcatatagtagttctattcttaattttttgaggaactcccaaaatgttttccacaatgactatactaatttacatacccacaaacagtacatgttttcccttttctccacatcctcaccaacacttcttatcttttgtctgtttgataacagccatttaactggagtgagttgatatctcactgtggttttaattttcatttccctgttgattagtgatgttgagcatttttcatgtacttttggtcatttgtatgttttaattttttaaagaaatgtctattcaggtcttttgcccacttttattggattatttttgttgttgttattgggttgagtgccttagatattctagatatttaccccttgtcagatgtatagttgcaagtattttctccctttctgtatggtttctcttcactctgctgattgtttccattgctatgctgaagcttttttgtatgctgaaggttttgaagtttgatgtaatcccatttctttgtttttgcttttgttgcctgtgctttttaggtcttataaaaaaattcttgcccagtccaatgtcaagaagtattttctctctgttttcttctagcagttttatagtttcaggtctcatatttaagtctttaatccattttcagttgagttttgtatatgccaaaagatacatgtccagtttcattctcctacaactggatatacaaattacccagcaccatctattgatgagacagtcttttccctaatatttgttcttgggaccgttgtcgaaaatcagtgctgatgtgtgtatttatttctgggcttgctcttccgttccattggtctatgtgtttcttttcatgtcagtaccatcctattttggctactatcgtgttgttgtatattttgaaatcaggtaatatgatgcctctaggttttcccctcttagtattggtgtggctattcagggtcttttgtggtttcattcaaattttagtatttttttcttatttctataaataacaccgttagtattttaatagaaattgcactaaatctatagattgctttgggtagtatgagcattttagaaatattaattcttcaagttcatgaacaagaaatgtctatcagattattcgtgtacttctcagttgctttcatctgcattttatagttttcagtgtagagatctttcacctccttggttaaatttactcctaggtatcttgctttttggtagctattgtaaaagtgattgttttcttcatttttttcagataattcactactaatgcataaaaacactactgatttttagctgttaagtttgtatgctgcagttttactaaacttgtttattagttctaagagatttttggtgtagtctttaggattttctatacataagactatagcctctgcaaacagaaacactttgactttcttctttctgatttggataagttttattgatttctgttgcctcattactctggctaggacttccagtacagttgaatagaagttgtttaaatgagcacacttctctcgttccagatgttaaagaaaaagtgtttagcttttctccatttagtatgatgttagctgtgggtttgccatatatggcctttattgtgttgtggtagtacctttatacctaattttggggatttttttttttatcatgaagggatgttgaattttgttaaatacttttcctgtacctatggaaattgtcatattgttttgtccttctttctgttaatttgaggtaccacatttattggatttttgtatgttagacaattcttgcttcactggaatgaatcatatttggtcatggtcaatgatctttatcatgtgctattgaattcagtttgctagtatcttgttgagaattttttgcatctatgttcactcagggatattggcctgtagttttcctttttgttgcatccttgtatagttttgatatcagggcaatgctggccttgcagaatgggtttggaaatattccctcttctttcatttttggaatagtttaagatgagttggtattacttccttaaatgtttggcaggatttagcagtgaaaccaccaagtctttggcttttttaaatgctgttatatccctgtaatagatgctataattatttttatttttttaattatactttaagttctgggatacatgcacagaatgtgcaggtttattacataggtatacatgtgccatggtggtttgctgcacccatcaacccattatctacattaggtatttctcctaatgctatccctctcttagcccccagcctcctgacaggccccagtgtgtgatgttcccctccctgtgtctgtgtgttctcattgctcagctcccacttatgagagagaacatgcagtgtttggttttctgtttatgtgttagtttgacaaaaacaagcaatggggaaaggattccctatttaataaatggtgttgggaaaactggctagccatgtgcagaaaactgaaactggatcccttccttgtgccttatacaaaaattaactcaagatgaaataaagacttaaatgtaagacctaaaactgtaaaatccctagaagtaaacctaggcaataccattcaggacataggcatgggcaaagacttcatgactaaaacaccaaaagcaatggcaacaaaagtcaaaattgacaaatgggatctaactaaactaaagagcttctgcataggaaaagaaactatcatcagagtgaacaggcagcctacagaatgggagaaaatttttgcaatctgtccatctgacaagggctaatatccagaatctacaaggaacttaaacaagtttacaagaaaaaaatgaccccatcaaaatgtgggcgaagataaacgcttctcaaaagaagacatttatgtggccaataaacatatggcttttgttaatagaaaaaaacttttagtactgatagattcagttattttacttgttattggtttgttcagattttatattttttcctgtttcaatcttgatagttttgtgtgtccaggaatttattcatttcttctagattattagtttgttggcatgtaattgttcatagcagtttctcatgatcctttatatttcagttgtgtcagttttatcattttccctctctgcatttattttactcttcattttttcttagtcttgatagagatttatcaaaattttgtttatctttttaaaaacccagttctttattccgttgatgttttgtatgggttttctaggctctatatcatttgtttctgctctaatctttattattccttttttagctttatactattgtgatcagaaaagatatttgatatgatctctgtcttcttaaatttattaagatttattttgtggcctaacatatgttatattcaagagaatgtaccatttacagttgagaaaaatgtgtattctgcagctgttgaatgaaatgttctataaatatctattaggttaatttgagcttgagtgcagtttaaattcagtgtttctttgttgatgtttttggtctggataacccatccattgctgaatagggagtgttgacataacctgttattattgtgttgcagtctgtctctccatttagatttaatgatatttcctctctatatttgggtggtccagcactggatgcatatatatttataattgttatattctcttgctgaatagatatttctatcattatataatgacattttttgttcctttttacactttttgacttggagtctattttatctgctgcaactatagttactcctacttgcttttgattttcatttgcatgtaatatctttttccatcccttcactctcagtctttttgcattcttataggtgaagtgagtcttttataagcagcacacagttgagtcttgttttttatccatttgaccgctctatatcttttaactggataatttaactgtttagattcaagttattattgctaggtaagaacttactccagccattttgttaattattttctggtggctttgtagctcccatgttcttttattcctctcttattgtttgcctttgtggtttggtgattttctgttatggtaagctttgggtctttcctttttcttatttgtgtgtctgttggtatgtctatttttgtggttaccatgaaactaagatttaaaaattgtggttataacagactactttaagcttataacagtgtaactttggtcacagaaaagtactctagactttcgtcctcctcttcacaatttacatttttgttgctttaatttacatctatatatattttgtgttccttaacaactaattgtagctgcagttatttttaaccactttgatatttaacctttatgctagtggtatgaaagatttacatagcacctttagagtattggagtattctgagtttgaatataaacttacgtctactactgagttttatactttcatatgtttttatgatagtaattattgttcttggctttgagttgcagcattcccttaagcatttcttgtaagatcagtctggtggtgaagaagaccagcttttgctggtcagggaagggcattattctctttcatttatgaaggatagctttgttgagtataatattcttggctaacaggttttttttttctttcagtattttaaatgtgtcatcccattttctcctgacctgcaaggtttatagttggtttcttaaagagtaaatagttgggttctgctgtttcatctaatcttttcatctcttttaatgggagtatttagactttgatttaatgtgattacttatgcggttaagtttaaatcactaatctcgctatttgttttctattagtcccatttgttctttattcatttcccttcttttttctgagttcttttggattgagtaaattttataatttcattgtatcatcttatttggcttgttagctataactttttattattatagtggatgattgagtatatagtgcacatctataactttcaagtaaataattaccttctattaatattatactctttcacgtatagtattaaaaccttataatagtatacttccttttctccaatacattggagaatataatacattgatcctatctagtgtattgtttcattacatacattgtagttttcatccctaggtgttcaaccttggttgtttttatatttttgacttttctgtttaacatgttcaatttatctttcctagcaccttttaaatacatgggatatgggcacaataactgatttaatgtctttgtttactaatgctaatgtgtgtgaattctggatcaatttcaatttttaaatttattttcattataggactttttttgtacctctgtgcgtggctggtcatttttgagtggatgacagacttttagattttaccttttttgactgcttggtatttttgaattttaaatgttgtcaaactttgttctgggacacaggttacttggaaatggttttattttttctaagtcttgcttttcaggtaagtaaggcaggaccatagcagaatttagtcaagaactaattatcccctactcctgaggtaagagctttctgagtacagtacaagtccttatgcatggtaagatttcctagtctggcttttgaaaccagacacttttccaagtcccacgtgatctgtggcttctgtttcttttaatctttgtggatgtttctttccctttgattggatagtttcctcataagcaaatgctgattagtactctgctgaatactcctgccctctctctatgcagcttctcgtctccagtaatctctgtgaactctagctgattttgtctcccaagactcacagctctatctcctcaactcagagtcagctaggctccatatggttccccctccctaattttttttaagtttcatactgtgtttgtgattttcatgtgggcttaaactcttcctagattggtaattacagtcatgaatcacttaacaatgaggatacattttgagaaatgtgtcattagctgattttgtcatgtgaacatcatagagcatgcttatggtcatatatataagacattaatttttttttgcctgtctcagattcaacatgtaggagtcaataagtaatatgtttgttcacatactgaagtgcagagagatactccaaattcttccagaaagttcaaggcaggataggtatctgcagagttcataaagtcataagaggtgcaccttcaatatttatagttattatttcattgccaacaagtagaaataatctggccattgcttccatggaaaaactaccctctagtacaatgtgatatcatgttcaattactgtgattccttatgagtcagaaaataaagtgaccctcagattaagatatggaaacaacttaggtgtctaacaatggatgaatgaataaagaaaatgtgacacacacacacaaacacacacacacacacacacacacacacacacacacacacaagaatactattcagccataaaggaataaactcctgtcatttgtagcaacatgtatggaactggaggacattacgttacatgaaatcagccaggaacggaaagttaaacactgaatgttctcactcatatatggaagctaaaaaaagttgatcttatagaagtaacatgtagaacagagaatactagagtctgggaagggcaggagggaaggagggaatagggagagatttgttaaaggatacacaattatagatagataggaataaattctaatgttctacagcattgaaggatgattatagttaacaataatatattatatagtttcaaatagctagaaggaggatattgaatattcccaacctacaaaagagataaatgtccagggtgatggatacactaataactctgatctgaccacagtacattgtatgtatggaaacatcactatgtgttccataaatatatacaattattatatgtcaattaaaaaagaaaagaaaatgaagaggaaaagagagaaaagaaaataattaaaaattagagaatttaaaaagactaaatatgtaaaacttcccttttatgtaacgtaaatttgaaataaactttttttttttgaaaaatgggagggagatatcacaagatacatcaaaactcctacttagtttaattagaactaatgacaaatttctacctttgttgttttttaataaaaagtcttgagcactccaaatttgtctctaaaatattttcttaccttttactggactgtgagaaattttcttcccaaactttctttctcaaactgtggatcagtaccattaaaagagaacgaagaaacccaaccctttaaacttgaagcagaagagggctgtgctcacttctgatctgagccactctgaggacgagagatggattatgcctcacaccttcttgaggggtcatcttttacatcacctctcttgatgtgtttggcagtactatgctcccagatactgaaccatgcttctaacaataaaacaacttctcagaccctactctgtcaccctaacttcaaatgatttaaagtgggaggcagtctcctgggtctctcactcaaccctctctcattatttagctccctatctttttgtaaagaggggtcttatttctaactatccaaaataattagattatatcctttcttcttccagtatttcccctcccttttccagagatggcctcagtctcacaggagaaaacatagctccccaaaccttggggacaaaatataggttatgctattttcataaagtagccatgctgtttttatgcctcctatttctatttaatcttccacttatacatcatctgatgttgattgtgctgagtttattaagtaaaaatatcaatgtgtttctctcttctgactaaataagctattagtaaaagccttgaaatggaagattaggctacataaatatttgaagagcatgctgcttatccttcttaatagaattaaattttctcaagaaatatcaatataggacactgacttctatagtttgcagtagagttgttgattttttcttaggatgtaagaatttcaatgagttaaatttaaaataattttaaatactaactacccattgcctcacctgtataaagggcaggttttcttgctcactatccttttctgaagtgcttttctattaataaagtaagtaacattgtgtctgggataagaaataaagaatactttgttagcttcctatctggcatatctgtagtgttcattaatttcaattccataaacacttattgaacatgtactctgtgccaaattcaagaaattcctatcctagtagaggaagccaattcgtacaatagagtttgataactgcccaagtacacgagtggtaaagaagagaaattgtcataagctcttaattttattaccagaaataaagttgattctgtcctgtataattagacatgtgaagtcaaagtctattcgtatgaagttttcttaaccaaaacaaggaagcattattcaacaattctgtgtaaaatgaatactaatttttatattccttgcaatattcctttatagctttgtttttttctatttctgattgatcttttgtgggctccaagcactttaaactttcttgcctggggctgtccatcaggtagttaattatctgtaagcagtgttttatgtagctagttttcaaacaacttattgaccctttgatgtaaaagtatgttgaaaactaagtatgtaaagtatgttagcataaattttccaagaataaatgttttcctcaagctttaagattaaattttggaacctcctggaaaaaaatgataaatgtcagttgtgctctttattatcaggaaattaatgtgctttttggaattttcctaggggaaacagttttaaagtctttactaaatattttaacaaaacagaaaataattatatctgcttcacctagcttataaatactgcattacctataatgtcaactttagttaaaacttctcctaaacagtgcctgaattagaaaggaacttgaaacctggtgaactaataaaaggatggaaaaagtccttgcaaatttattttttggggcctataatttaacctttgtcaatgaaaagagtcaaactctgtaaaatatttgaagagatttattctgaaacaattatgagtgaacaatggctcatgacatagcccttaagatcctgagaacataagtccaaagtggacagggtgcagcttggttttgtataacatgtgtaaaaaacattttggggagacaaaagacatcaatcgatacaggtaagatgtactttggttcagtccagaaaggtggcacaactggaagtcatgggcagattcaaagattttctgattggaattggttgaaagaattattatcaatagaaaggaatgcctggttacaataaggggttgtggggaccaagattttatcatgtaggaagcctccaagtagcaggcttcagagagaatagattgtaaatgtttcttatcaaacatagtctttatcagtaattccaaagggaggcgggtataacgaaccatgtttggctcccctcttctcatcatggcctgaactcatttttgaggttaactttggaatgctcagctgtgaggaggggcccatttagatggttgagggacattagaatttcgtttatattttataccttcgggatcaaatagtttcatggaaatatatacatctttagtaggcatgtattccaccgttcctcctagtctcaaatcccactgttttctaagggagactctgagatcagaagtcacaggaaaaaaaattgaaacatgtaaaagagttttgtgaattttattcattggtgaatgacatgaaatctcatacatttcaatttttactttttcccccggcaaccatccctaaacaaaagtaaaaattactgctttttgattcttaattgtaattgctgttattttggcttagttattttgttggttatgtgttatttagtaaaatctcttgattttttggtaccagtttataattgcattataatattttttctgtaagattcattaaaaactttaagacatatttttatcgtgtatttctaacattcttatcactgtgggctttgtttttcatgagggattgttagtcttttgctttgcctgaggccatggtacacacacatacacacacaaacacacatgcacacactaatttgatgcacattatagaaaggaaaatggaatgcatattataaaaaggaaaatggaaaagcaatgtcagatttcaagtacggtgatatgctaaagtctaagctgctttacaagaagtaaaatatgtttaataaaacaaacatcttcactaatcaagccaagtgtgctgcctgtgtttgcagctgcatgtcaaacatacctcagattccacttcttttaatcttagcccagttggaggtagatgaggcagaacctaggcaaagtggtaaatcctgtgaaatttgtctataccctcattctcctgccttttattctcctccacattccctctcctggctcttctatccttctcaggcttcctgctccccagtccaaataggaagggatcttacaatgacccatttatacctgctgattgactgattatgctgtcactgagatgccttcacactgaagctttacctcaaccagccttttatctctgattgtaggagaggctttttcctttttagaaaaacttaatttcccttgtgagctggtgagggattatttttagatagttagatgggaggaagctctcaggagcttctgaaattacagttgtctgactcgagcaaatttgatttagattttatgatgttttgagctgtccaagcagttgatctacaaccagtccctataaagaaaaattgcactggatacttgttaaaaatggcaaggaagactttatttaagaccgttgcaatataagtgaagactattgccatagaggagagaaattgaacccaactctggtgacataaagaacaggagaatttttaaacactggaaggagcgagtgagaaagtactgaaggactttagcagggagattggtgaatgtgactgggccatctgtatttgctaatcattgtttatcaaagttaggctcctaccctcccacagagacagcaacagggccctgtctttcttgattaaatgtcaaagggatatatggctccagggcccttgagaaagatattcatggcttgtaaaactggcaagagactgggagaagatttatattaatacaaaggggcaaataaagaatttacaagttttctaaagtaaatgctgtaagaaaggagatgtcagtggcctagagtcagaaaaattctgtacaaagttaagccaggcagaggggcatgttaaggtcttcttggtcacctgccttccacactgctttctttttatacctccatgctgtctactctgctaaagaaccttaaggtttctggttcttactgatttgattgaagttgacttggtgtccttgcactattagtttcttccgcatgtgatatgtgtcctgtcatagcacatgtacacctgttggcatttatcctgcttcactacctgtgtgctcttactcctgattttaatctgcttcctgccctctcttccatatgtcctgtgacttggaatcacatatattatcttctgggatatttgacattgttttcatttgcatctaatgattttcatatttaatattataactcttgttatctgatgtcctcaaacacatctctaagcccaatatgacttacacttctggttagaaagttttgcctaaaatcactgtagcatctggctgcagtctcttcattaatagagatattatattggggattaatatttatagtcataaaaagggaaaagaacagatccagtaagaagacaccatagattcagcaattttgcttcctgagagtgagggctagtggccacctgcagcatacctgggcaagtctcaagccctgcccagcatatactatcgcagcttttcagagaaagagaatgtcactgaatgttcatagtagaaaatctttattctcacatgggaaaatctcctccctaccaattgattttagtcttttctatgatttatccccactaggagagttcatagaacataatttatagcagcacatgttcaaaaacctgggtatttggcttagaataagatcatagttagcaaaggtaggctttagcagaacacttcagggtgagcataggctgtggtggttgtaaaatatgttccaatttgcactaaggcagctccagttaacacctattttttcagaataattattaatagcatgcccttttactctcaaatgggttttgatttggaagataaattatagggtcactttagctttgccactctaagttctgattctttctgaggggtttctaccagtgcatagtgtgggtgtttctcctcattctacttagctttcagaggtgcaattattggattaaactctctttggattctctgtctctcacacacacacatcactacctccaaaggaaaaatgtacttctcagactatcttttaagcataatttaagaagaaaaacgttcctttaaatgcaacataatatgcaaaaatacctgcccacagtgaacacacagctttacattatgatgataaatgtggtttgttttccagcagggcttattgccttatgttttcaaaaacagagatttggtggtgaccttttatttacagaaagattgaccaaagctttgaaaacgtaacttgtttttactttgccttttcaacagggcacattttaagcaaggtatcctttcccactagtctctataagcaaggataactggtaaagtaatttgtttttctttcttgttctagagcacattcccagaagcagatgggggctagatggtgatggagggcaggtattttcaagttaaaagtaaacattggtattcacatttcccaaaagaagaaatagaagtttataggaattacataatttgttcaagagcacagctaataagtgagagagccggagctcaaacccaggtcgacataacttcatagcctgtttcctggatcagtctcctatacagttttcaagctatgtcataatttgttcagtgtttgtcttttccctgagggcaggacatttgtctttcctttgtctagcctaccatgggcatctaataaatagtaaatgagtgatgagtaaagtcatgcatgagagggagagggaatgagaatgagagctagggtgagagggaggtgtggtatggaatctgaaaggcagcatcatgactggtggcaagcgtttgtcagtagtagatgttcacagggagtcactagaactctcactgagtcccaggtgagaagccagatggatataatgaagtaataagctcaagagttggggggtggggatggtagcagaatggtttgaaagtttttcttggcagcttccttgccccttaggctcgagagatagtacaagacagtagtcaaggaatgagctttgaatccagttaatccttagggtgagcccttgcaacaatctccaaaagtaaagagggaaccactttacattcaggatctcatttcatccttagaacacttttgttaagtagatactgctattccctttttaacactgagtcacctgagactttttagtgaaataacttgcgcaaggtcattcacaataggaaagatttcctgtttgggtctatttgaccctaaagaatgagctcccagttatcccttttcctcaggaggcatttgtgagactgctgctactaccaaggtaagaagttaccatcaacctcaccctttctctcactgtcactgagtcattgatgacactacctcctacctctccacaggggttaaaagaaaagttatttctatcaaaagcaaatatttacagagtacttactgaacccagatactgtagcaggtgctttatatgtattaattaaattcttacaacaaggttatgagatatttttctctgatttttctcattttacaagtgagaaaattaaggcaccgagaggttaagtaaccttggcaaaggttacccagcaaataagtggtagagctaaaatttgagtgcaagtagtctgactctagaatctatgttctcaattactatgcccctatttatgtgttctattgactcttaggtaagaaaaggtaagttgctgaggactagatccataagttaactttacttaaaaccattgacatctgttgtacctattatcctgaagattgctttcacaaggataataggataattggactctccctgaatttataataatgataataataatagccagttatcactgagtactgtcaacatgccagaaacagtgttaagagctttccctaccttatcttgtttaatcctcccgataatactgcaaaacaggattattattcttgatttgcagatgaggaaactgaagcttacatgtaagtaccttgctcaaagccacacagttggcatctgtctgatttcctgttgtaaccactagttgctctgctgcttccccccagaaggctgccttagtctttgattcattaattggttttgctggatgttggccattttacctggcccaggagggcatgttactctgcatgttcactttcaggagacaaaggcaaattaccaaaagaacaaactaacaccagggatcttttcaagaaaattaattcctggaatgccgcttgctcagtatccacttactaactacatttcacactatgtcttacgttttttcccctgcataaagctacacttacaacacactccaggaccaaatgcttctaattatggacaagattaacactgagaagttaaagaatatttaagagatattacttattctttagaaaaattatattagagaaatttcaatatagggtttagatagtatacataccacggttaaacatatccacatgtaaacaaaacagaaatatataaatatctttatgtttattaaaattgaacatagaaatttagaaatttagaaccagaagggagcttagacatcatctagtttagatcagaaaactaaatgaggccacttttgctgatatgacttggctagctttcaggcatctcacaaaattcagattaagcatcatctttatgaattatttcctaatccccattctcatgcctgtctgtcactgaggagacctgacccctccttctttctttatcctagtatagtctgtggctgtgactatttgcatcatggctcttaatcactttatgttcgttgacttttatgcggtccagaggtctttttttttaacatctattatgcatgaattcatagggaaggggtttcagcagcccaggctcctttccgttggttctcacaaagtgtgtttctccagatggagcaggatggtgcttcaggtgaacctaggtacctttatttctctttggtttccttctttttctggtcattttccttcacatgtttcaggaagctatttcagctcttaaactgcttaatatgctcaatacacacattaattcttttggcaagaatcatgcccttaaattgtctgtttacaataatgccaacagcatgctaggtaacattgtagactcttccagttttgccatggtagcattagtggggcatttctttttacagtacccattcccttatgtctacaatatcacctttcttatagattcgcatgtgtgtggtcaaaggaacaactccatgttttctaaaagggctaggaaacatacatcaggtgtctctcctctttccattggtgtttgtcgttttggcatattactgaagtatggaagttcctgccaaagggagacttcatttttctaagagtagttttaggctcacaacaaaattaaaaggaaggtactgagactttcggcttacctctacattcacacatcgtcaccccaatttaatagcttacattaggattaactttggttttgtacattctatggatttaggcaaatgtacaatgacatgtatccactattatagtgtcgtatagactattttcactgccctaaaaatcctgtgttctgcttattcatccctccctttcccctactccctgataatcactgatcttcatagtttctccttttccagaaaagcatatagttggaattatacagtatgtaaccttttcagattgggcttctttcacttagttacacacatttaagttttctccatgtcttttcatggcttgatagctcattttttttagcttgaataatattccattgtctgtatgtaccacagtttatctattcatctgttgaaggatatcttctttgctgccaagtcttggcaatttagctgctataaatatccatgtgcatgtttttgggtcaatataagttttcaacccctttgggtaagtaccaaagagcactattgctggattatatgtttagagtatctttaattttgtatgaaactaccgtattgtcttacagaggggctgtacaattttacattccccactagcaatgaatgagagttcttgttgctccacatccttgccagaatttgatattctgaattttggtcattctaagaggtgtatagtgatatctcatttcagtttgcatttatctgatgacacatgatttggagcatcttttcacaggcttatttgccacctacatatattttctcgtgatgtgtttgctaaatggtttggctcctttttaaacttgagttgtgttcttattgttgagttttaagagtcctttgtatatttttgataacaatcctttttcagatatatcttttacaacattttcacccagtctgtggttgtcatttgattctcttgacaatgtctttattttcaaagaccaattttaatttatttttttaatttttattttttatttcaataggtttatgcagaacaggaggtgtttggttacatggataagatctttagtggtgatttcggtgcatccatcaccagaggagtgtacactgtacccaatatataatcatttatccctcaccatcctcccactctttcccccgaatccctgaagtccattttatcattcttatgcccttgtgtcctcataacttagcttccacttataagtgagaacatacaatatttggttttccattcctgagttacttcactttaaataatagtctccaattccatccaggttgctgtgaatgtaatcatttcattcatttttatagctgagtagtattccatggtatatatattttctttattcacttattgattgatgggcatttgggctgtttccatatttttgcagctaaaaattgtgctgctataaacatgcatgtgcacgtatcttttttgtataatgacttcttttcatctggatagataccaggagtaagattgctagatcaaatggtagatctaattttaattctttaaggagtatccacactgttttctatagtggttatactagtttacatttccactagcagtgtaaaagtgttcccttttcaccacattcaggccaacatatattattttttgatttttggattatgttcattctactcggttttgatttgcatttgcctgataattagtgatattgagcattttttcatatttttattggtcatttgtatatcttgttttgtgaattgtctattcatgcccctagccgactttttgatgggattgtttgtttcttgctgatttgtttgaattccttgtagactctggatattagtcctttgagggatgcatagtttgtgaatattttctcccactctgtgggttgtctgtcaactctgcagattattacttttgctgtacagaagctttttagtttaattaagtcccatatatttatctttcttttgttgcatttaattttggttcttggtcatgaacgctttgcctaagccaatgtctagaagggtttttccaatgttttcttctagaatttttatggtttcaaatcttaggtttaagtctttgactcatcttgagttaatttttgtataaggtgagagatgaggatccagtttcattctacatgtggcttgccaattatcctagcaccatttgttgaaaagggtgtcctctctccactttatgttttcgtttgctttctcaaagatcacttgactctatgtatttgggtttatttcttggttgtctattatgttccattggtctatgtgcctatttttatgccagtaccatgatgttttggtgactatagccttatagtatagtttgaagttggataatatgatggctccagatttgttccttttgcttagtcttgctttggctgtgtgggcccttttttggttctacatgaattttaggattgttttttctacttctgtgaagaatgctggtggtaatttgatgggaattgcattgaatttgtgaattgcatttggcagtatgattatttttacaatattgattctacccattcatgagcatgggatatgttctcatttgtttacatcatctatgatttctttcagcagtgttttgtagttttccttgtagaggtctttcatgtccttggttagatatattcccaagtattttattttttctgcagctatcataaaatgagttgagttcttgatttgattctcagcttggtcactgttggtgtatagcagtgctactgatttgtgtacattaattttgtaccctgaaactttactgaatttatcagtcctaggagctttctgggtgagtctttaggattttctaggtatatgattatattatcagcacacagagacagtttgacttcctcttcacccatttgaatcccctttattcctttctcttgtctgagtgatctggctatgacttccagtactatgttgaatagaagtggtgaacgtgggaatccttttcttgttccagttctcagggggagtgctttcaacttttccccgttcagtataatactgactatgggtttgtcatagatggcttttattaccttaatatatgtccctcctatgctgattttgctgagggttttaatcataaaggatgccagattttgtcaaatgctttttctgaatctattgcgatgattatgttatttttgtttttaattctttatgcgctgtaatgcatttattgacttgcatatgttaaaccatccctgcatccctggtatgaaacccacttgatcatggtgtattatctttttgataatgctgttggattcagttagatttttgcatctgtattcatcagggacattggtctgtagttttcttttttagttatgtcctttcctggttttggctttagggtgatactggcttcatgggatgatttagggagaattccctctttttctatgttttggaatagtgtgaatagggttagtactagttcttctttgaatgtctgatagaattcaactgtgaatttatctgatcctggacttgttttttcttggcaattttttattaccatttcaatatcactgcttgttattgctctgtttagagtttctatttcttcctggtttaatctagagggttgcatattttcagaaatttatccatctcctctagattttctagtatgtgaacatgaaggtgtttatagtatccttaagtgatcttttgtatttctgtggtatcagttgtactttctccctttttgtttctaattgagcttatttggatcttctctcttcttttcctatttaatcttgttaatggtctatcaattttgtttatcttttcaaagaaacatatttttgtttcatttatctgtttttttttttgtttcaatttcatttagttctggtctaacctttgttattttttttttcttctgttgggtttggttttggtttgttcttttttctctagttccttgaggtgtgaccttagattgcttatttgtgctctttcagactttttgatgtaggcattcaatgctacaaacttttttcatagaactgcttgtgctgtatcccagaggttttgctaggttgtgtcactattattgttcagttcaagtaatttttaaaatttcaattttggtttcattgttgactcaacaatcattcaggggcaaattatttaatttccatgtatttgcataattttgagggttttgttggagttgctttccagttttatttcactgtggtcagagagagtacttgatataatttcaattttcttaagtttattgagacttgttttgtggactatcatattgtctatcttggagaatcttttatgtgctgatgaatagaatgtatattcttcagtttttgggtagagtgttctgtaaatatctgttaagtccatttgttctagggtatagtttaagtccattgtttctttcttggctttctgtcttgatgacctgtctagtgctgtcagtggagtattgaagtcccccactattatcatgcttatgcctagtagtaattgttttataaatttgggatctccagtgttaggtgcatatatatttaggattatgatagtttcatgttggactagtcttttttctcattatatgatgtccttctttgtctttttaaacatttgttgatttacagtcggttttgtctgatgtaagaataactactcctcttcacttttggtgtccatttgcatggaatatctttttctactcctttaccttaagtttatgtgtgtccttatgtgttagatgagtctcttgaagactgcagatacttggttggtgaattcttatccattctgccattctgcatcctttaagtggaacatttaggccatttatattcaacattagtattgaaaagtgaggtactcttctattcactgtactagttattgctttgataccttgggtttcttttttccatttcattattgttttgtaggttctgtgaaattatgctttaaggagattctattttggtgtattttgaggatatatttgaagatttctaattccttttagcagttcttgtaatgttgacttggtagtggcaaattctcttagcatttgtttgtctgaaaaagactatatgttttcttcatttatgaagcttagtttcactggatacaaaattcttggctgattagttttgttgtttaaggaggctaaagataggaccccaatcccttctagcttgtatagcttctgttgagaaatctgctgttaatctgattggttttgctttacaggttacctgatgcttttccctcacagctcttatgattctttcctttgtcttggctttggataacctgatgactatgtaactaggtggtgatctttttgcaatgaatttcccaggtgtactttgagcttcttgtatttggatgtctagatctctagcaaggccagggaagatttcccctattattttctcaaatatgttttccaaactttgaaatttcttttcttccttgggaacatgaattattcttaggtttgattaacataattccaaacttcttggaggctttattaatttttttattcttttttctttgtttttgtctgattaggttgatttgaaagccttgtctttgagctctgaaattctttcttctacttcttcaattctattgctgagattttccagtgtattttgcatttctctaattgtgtccttccttcccagaagttctgattgttttttgtttatgccatatatttctttagagattttctcgttcatatcctgtatcatttttttgattttttaaagttgatattcacctttctctggtgcctccttgagtagcttaataattgaccttttgaattctttttctggcaatccagatatttcatcttagtttgaattcattgttggtgagctactgtgatcttttgggggtgctaatgaaccttgttttgtcatattttcagaactgtttttctgatttcttctcatttggatagactgtcagagggaagatctgagactcaggggctgctgatcagattttttgttcccatgtggtgctcccttaattatggtgctctcccccttctcctagggatggggcttcctgagagctgaactgcagtgattgttatttctcttcctggtctagccacccattggagctactgggctccaggcaagtactggggggtgtcttcaaagagtcctgtgatgtgatctgtcttcaggtctctcatctgtgaatatcagcacttgctgtggtggaagtagcaggggagtaaagtggactctgtgagtgtcctttgttgtagttttttttaatgcaatggttttgtgttggttggcctccagctaagaggtggtgctttcaagagagcatcagctgtggtagtgcagggaggttacaggcttgcactagtgttgcctggataagtattcagatttctcaggcagtaggaagagctttggagccccccagtaattatgtccactgtctttgactaccggggtgggtagagaaagaccatcaggtggaggtagggttaggtatgtctgagctcagaccctcctttggtgggtcttactgcagctgctttgggggataaggatatagttctcaggctgatggagttatgttcccaggggaattatggctgcctctgctgcttcataccagggaagtggggaagtgggggaaagctggcagtgacaggcctcagccagcttccatgcagcctgaagaacaatttcactcccaccatgccccaccaacagcacagagttcatttcaaggcagccagtgagcaggggtgagaaggtgccccaggatacaagcctccctgctgagaaagcaggcagggctttcaggcttcacatctccccatttgctgcagtttctgtgcttctatgtgcactccccatttgtcccctcccccagattctgtctaggaaacttcatgttcagtcaaaattgttacaaaattcagctggaagtttccttctccttgtggtctttctccaattccactggcagacctccccaaggacccctgtgagacaaaatcaggaatgccttccctggggaccgagagtgcccacagcactcttccagctgcttcctctactcttatatttcactttgctctctaaattcatctcagctccaggtaaggtcaaatccttctcccatgatctggaccttcagattcaccagtgaggatgtttgtttggaggtggaccttccccctcacactttggttactcacagtttttttggccatctcacgaaacctacagtggcaagccacttttttcaaagggtctgtgaattctctcagctttcctggtatgtccctgcggtagttcttggagcaagagttcacagtatgagtctccacaagctgctctgtccatccgagtgggagctgcctagtcctacctactattagttctacctacttttcaccattttttttgactgacagtgtcttttgcagagcagaaatttccaattttactattaatgaagttcagcttatctattctttctttcatggataatttattttagtttttgtgtgcctggttctctccctctactgctttctaggttttttaaaagtagagatggtttggatttatatttccaggagagatagcacaatgcctgttgagggaatcttcaatgtgtgaatgactaggcagtgatctcatggttagtagtgaaatacaaatgaaagcacaggtttcttgacttgctgacaagtggttctcctaatacatttttactgcttctctattttaatttgagtttcacatcataagtgaattttaaagtcatttttaagaggacattttcagaagatgtcaacaacaatgaaaagcttagttgagatgacagtgtaaaattgctagtgaatgggtagttcagaatataagttttcaaagagctattagctttttttttctaaaaactaaaaaaaaaatgagcttcatccttgtcctctttaataatttgactaaggatttatatccttttaatctagagtgacactcagaacctggatgttccttactgaaattgctgaagtgtagagaaaagataacctaaatttgcttttcatgtcaatcactgggaacaaagcaaaccttccgtgtgtgagaaaagattttgttggattgtagttggaaggcaaagattttgttcattcttaaataatactgatttcctctgtttatagggctcttgctggcttcaaagcataccacatatgtgaaaaaaaaacctcttagcatacagaagggtatggaattataaatctgcaaaattagatacaggaaacagtaaaagttcatccttgcagggaataatcacttcttaatattaaatgacttaatgcctctcttcatctaaattttttacatatcacactgtacaatacatttttggagttggaaagaaatctagagattcttctaattttatagttgaggaaactaaagtccaaataagtaaagtgctttctgaaataatattcctgaccagttaggaccaaaatcaagatatcctaggtcagagtccaatgccacattgcttctctgatgagcaggctttcattgattatgtcataagtttcttctataatataacaatataaacatgcttttagctgatgtcacttttttctttactacgatattaaatgccctaccatcatatatcaccaactttatcccacagatgataaattgtgacttagtgagattaactgatttgtcaaagatgaaaccatcagtttgtgtcagtgcaagttctagaagccagagcttcttacctccccatccagggtttatctctcctaaaactgtacttggctctccattagaaaaaaagttaagcacacatacacacatattcacaaagagacaatgtcaaatgtttttacaatttccaataagtttatctaagcctggactggaaaaaaaatgttaaatttactgtttttatttctttcttttgagaacccttgtagtaaaccattcatttattcatttgttcttcaattattttaattttctattttggctctcaaactgtgtctcaagctggatattcatagattaaaagccatagatttggtccacaaaatttagtaggggaaacagagatataaaaagtaaatataaaagacaattacacgcgttacagagataagtaagaaattgttaatcagagcagggaatggttcagtctacctaacgggctaagtaacagcttcctagagtagaggatgtgatgctctaaatcttgaaagattaaaagagggcaaggaatcaagaaacagggagatggacttggcaaagacaaagagatgtgaaggtatgctttgtataagactctgataatagtttatgtgccttcagtgtaggatgcaacacatgtgcacaggaaagtgaagctagagaagacgaatgtaggctgagggaaggatgcttttgcaatgcctggagtttgaattattgtataaaaaatgaagagccacaaatgattctatattgcagaattacttttagaaggatcttccatggtagtatgtgtgtgtttatgtgtgtatagggaagtaagctaacaagtagggaaataagtcacaggctcttgtggttttgcaagaaagaaatgttaaggatgcctaagctaaatcagtagaagtgaagttgtagggaagagaggaaaatcaaaagggtttacaaaaggcagacttacagggatttggtgaccaaagaaatgaggggtggaggagttaatggaactgacagtgaactaactagaaattaagagaagtgagttctagttagctatctcctcctctctagctctgtgatatagaattaggattatgttttctcatcaccagttccctttttacaaaatggcaagtttggactttatttttaagtctctaaaaaaatctatgattatctcttagatatctgcattacataaatatatacaagggtctggtttagatgttattactctccataataattatagctaacactaagtttaagcatctttatgaaggttagctcaatttaccctcattatagcacttaatggtaggtaatatcacaattcctatttcacctatgaatagctgatgcttacagagataaaacaattttctcaaattatatatttccgttctctgctctttctacttcctatgtcatttcccttaagaagcacttgagctgcacccaactccttcctaagtccattactaggaatatcattattactaggaatattagttaagctaaggcttgctactataacagatatacatcaaaatcattggcttaacatagcctatgattacattggcttaacatagcctaaatgtatttcttgcttatgtgaaatccagctggtagtaggggtgggtctctcctctacatagtcattcagagactcaggtttatggtagctctgcaatcttctacacatggtttccaaggtcactcttggcactaacatctacctgaaaggagaagagagagagtgggtgatggagtgggaggtttttataagcctggacttgaaaaagcataacttacttctgcccacattctttgtgtcactgcctatatctaactgcaaggaagactggaaaatagcctagctgtgaagccaggaggaaagaaaaaggtttgatgcataggaaagcactttcttctaaagctgggacttgaacctagaccatctgacttcagaatcctcagccaatccactgtcctatattactatttgaactagatctctctcgtggaattgaccataatcaagctgttttgtacataaagaagtgtgggtgcggattgactttatagtgaatattatactgtgcagttaagacttataacttcatacagataagaaatatatctaaactacaaatttcataaactcctcagtttctcactaagtttagggactaaaatgaagttaatttgttttagtttgaaggggttaaaaatctgtaatatttagattttcattttctgaaaggtttaaaagattgtcttcattttaatgaaacctaatcattttacaaattcattaaacttttgaattgggagaaatctctaagtctaaattaactccaaatctagtctgatttcttcattttacagataaggaaagagatccagagacctaaatgccttactccaagtcacactcttcagggacaaacaactacacatgagagccccaatcctgaatctgtcttttcaacactctttctcccattgggtcattccctcagaaagcacttggtctgcactacactccttcctaggaatgcttataggaataatcttaatcataaaagaacaatgtgattcctacaatgcttgggaattggggatgttctatttctttacagttttgtataatttaagattaatcagaaaattttcttttcaaactttgccattaaaaatctatctatctatctatctatctatctatcaatcaatcatctaatctaaaatggaccatttctcctttattgtaattgtaaatggacttagggtcatcatttgaagtatcagttttcagtatgaggtaaatgtaggaggtgtgactgttagattatgtttcctggatcctacttagaaggtaggaatttgtctttttccttttaaaaatgaaggtggagaatacttctggctgataatgagcttttgttaattatagctttaatttaaacaaggaaatcatttagtcagcacagttttggatcaaggaacagagacatcatcaagttacctcacgaaaaaaaagggggccaattgaaacatattctggaaaatgttttcaggaattcagaaaaaaacaggaaaatctgcagaagggcatacaccaaggcagctcatggaccacctgctcccttctctctgacctctctttgctgctgtgcttggttccctttcctgattgcttcctccgagctccatccctctttaccgtgaggcatgcgcgaagctttctgtgggttacctgactcctgataccagacatacttttggctcatgtgtcaatttccatgtgtctgttctgcagcttttactttaaatttctgaagagatggatttcagtggtctcgtacctcttttccagaacaggccttacaagcagaagttgctggacagtgtataaagggtccacttattcctttagatacacctttcttaacatcgactgtcatttaaaatgtgggtgggaagatattcatgattgaggtgagaggcaaagaatctaagcattatcccatgagtgaatctccctttgttttgtcgctttctcttaaaagagactgggggacattctctggttgagaatttgcttttgttaatagagaccatactgttaaattgaaattttatggatattatcctttctttagtggcaatcttttcccaccccaaaatttcattttcttttttccatataaaagtggaacagttttaaaaaacagaatttgtaaacatgtcatcggcacttggttgtttcctcctgatcatcctgacttcataaattatgagaacttttgaaatttcattgagctatttaaattactatttctgttaattagattgcttcagcatgaaagtctaaaaaatatgagctattttcccattctaatgaattaaagtgagaaattagctgtctcagaaagttttgtttcagcacattttttcaatttaaagtgatttacagcaacctaaatccactaactagctcgcatttcagttgcctattggtgcatgtaggtgatgctttatttctgcttagaaggtacaatatagattctccagggagctagtcaggctgggtaaactattaaataggagtatatagagacaaacaaaatttcataatcaatgagacaaatcagaatgcaaataagaactgaaatctagtgtagaggaaaccaagtaggaacaaattcacaacttgacgctaaatttactctcttttgtagatttgatgtcagattgatttttttataggcatctcaagtcaacacaattaactgtatgtgtatgtatatatatatatatataaaaaatgaaattagaacttctatagaatgtagataacttcccctaacagccacttctttgcagcttatatgcatattgcattactttgatattcgttaattacactaatcataaaaataaaggtaattaacatttaagtaatatataatttaaaggcagcttcacacacattatctcatttggtcttcataaagactctagaaagccattttagaggtgaacaaaccaattctttggaaaaggaataaacttgctttagagtttattcacatatagtataggtcaagctaagctctttcaaggttatcaagcactatgtgtaaggacagtgatacacttactgcattcctccacataatctggaattggagtctgctgcatgtgtttagaacttcaggaaggcatagaaaggtctttcttgcatagaaaggtctgttctcacactgctagaaagaaatacctgagactgggtaatttataaagaaaagaggtttaattggctcatggttctacaggatgtacagcaagcatgatgctggctacctgctaggcttctggggaggctgcaggaaacttacaatcaatcatggtagtaggcaaagggggagtgagacatctcacatgcccagagcaggaggaagagagagcaagaggggaggtgctacacacttctaaataaccaaatttctttcacaagaacaggactagggggatggtgctaatccattaggaactgccccatgatccaatcaccttccaccaggacccatcttcagcattggggattacatttcagcatgggatttgagtggggacacagatataaaccatatcaggcattataagataatggtcaagatcatgatttctggaagtaagttatctggattcttatctctaattttgtttcttactcagtattttatcttggccaacttacatttctgtgtctcttaacatttctgtgtcccttgcaaattggaggtatagtttccttgtcagtggttattgcattgataaaatgaaataatgctcatcacacaataaatattcagtcaatgttagcaatcaccattatttcataaatggtttatggagtgtataaattattttcacatatagaatgtaatatacataagttagtgctcatattaagctatggccagtaactactatttaaggtgaataatttgcataaatattattctactgtgaacccatattttcatacccatgtatttatggttggttcacaagtgatcaatcagatgtgaccatattatgtatatataatgcaatgaatattattatgtataatttttaaaaatctatgcctgtataagtcaaatgtcatttaatttgattttcttttttatgaataagtttctttcactacatcaaaaaagcagcttgaagcagaggttttggtaaaatgcctatgggacttcgtttcaaaatataccagtcataatagcttcagaaaatatttagaaatctaagatatgatttaagaggcagtatcctaaggccgtgtttctggggtaccatagagccaaaggtcctattgttgaaatgagacataagggccataaccttggaaggcagaaattagagctgggtaagactttgtatccctgtttcatgagaatttaatgaaatctatatgtctatgctgtcatttcacaaaaaagtaggagggaatactttgtgtttatgcatcacgtccatggaggaaaaatttcagaattttttttttttttttggtgacttgggaattgtgacatgaataaaattgtttgttctttttcatttaaatcttctccgggggtcttgcatcattttaatatgatactaactgatcttctgtgaagcctattttgttaatttggaaagcactaatattcaattaggttagtttatcacaagctctgtctgaatctgtgtagagaattctagtaactgcttgaatttcctcccgtctcattaaccttttaaagaaaaaccacaggaattagttttatctttttaaattgcttgtttaccatttattaaacacataccacatactgagcagtttacatgaaaaattagtctttgtctacaagaatttggttatcataacaagactttaagatatacagcagacaaataagaaaactaaacgtatgcatacatatttcatgttcaaatcctgctaggctaatttccttctttgaagtatctcacttcacttgacatatttactggcgcatatatatatatatatattttgatatttttcctaccaatgccaatgccttcaaagtttttgagcacaagattatctatctatcatctatctatcatctatttcatttatatatttagctatctgtatctatcatctattctatttttaaaaggttacctctcttctcttccccataaaaagttttacaccttcagttttaataagaaggacaaaggctgagagaggtttttacaaagttcatttctcaccaggaaactaccacatgtttctacattttgttcataggcagtgaaaaaaaaaaaaaaaagcactgggcaggaaagccctgcatctatcaggctaccatttgtcccttcctggtcaactttactattaatctcctaacatctagcatcatgctctctgaaggagggcatacctctctttccctactctccattgtgccctgtgatcatcatttcacttcctttctcttccaagaagaaagaggcacactttcttcaccagagctctggcatgccaaacttacccaatgtcattatcccattatagaatagtttctcagaacccctcacattatagaaatatttaaatattttatttttcatcttgactctgcattgactcaaataagctaggatgacttgggctttgggatatcatgcttccctgacttattctccgactaatacatttggaaagtgtaccctcctgaacaatctgagaagcagtgaaagtattaccttgtagttatagtaggctgagttggtcgcagtaacaaagaacatcctaattttagaggtttataacaacatggctttgtttctcactcatatgcccatcatgatcggtggtgagtcggttccatgtctcttcagttggggattcagattgatgtggcctccgctatcaacaacataattcgttgctctggctggtggggagaaacatgctgaattacacagtagctcttaaagcttccatatagaattgatattagtttctcctcataagtggcccatattactttaactttcatttcactagacaaagcacgtcatgcccttatatctaaattaaatggagtggtgaagtacagtacaaccttcgtccagaagggagagaaccagacatatttggtcaacaggactagtgaatgccacagttactttgtcctcttatttatttagtcaggcaaaatagaaataaattttgattttgtatggaaatggaaaacagatgagttttcacttctcctttctttttcaacatataataaaatctccttgaaatacagaaggaagctggccttggtgctagaatggtgcctcttttctcagaggagagatcaggggaaactcaccatgtgctcctggctgttataggaccatgaaagagaacagagccctagccaccataatgttctcccagaagctatctcaccttagtgatctgcctactgatgtcactatctgaagaagccctaatcatctttccctggcttccattcagagatttagaggagtaatctcatcatgactcacatccctggttccctaaatcactctcagaagtccaagcatccccagaaatctatcatcttagagatgtttatctccactctgctctgcagtctcactccatctcccattctgctgtgttctctgcaattcacagtgtgcatcagctaactccctgcctggtattcctaccactctttcctggtaaattcactctttcttaggtatctatttcagaccctctttttttcttctccaagggctgccatatttcttaggaaaaatagatgaaatcaggtaagaaactaccttatcttctcaccaccgaatccactcacatctacctgactctgtacctacatatcccaccttcctcttgttaaaatggattgtgtcctcacacaaatctaatgtcaaccctccaggggccctggatcacaatttacttttctttcttaagaacattctttgttaatgatctattttctctcctgtgttgtcattttccctctctactagatcactccagcaaacaagcatccttttaaagcatccgtttaaaaaaattcccttgaccccatgattcattccagctcttgcttcatttcctttctcccttcccagaaaaactccttgaaagactttttataactataacaaccttacctttccttctctactaaacttacttcaataatgcttttatttttttcatgccactaacatgatttttaccaagatcaaatgttaacagcaatagaaatagctaacacttacagaagtgcctgctacggggaggcagtgtcctaaacactttatacatgactcatttaatcctcagttaatcctatgaagattgtgctattaatatccctcttttagacatgagaaaaactcagctgcccatgcataatagataacgtaccaagatcaagtagttactagaaggaacttagattcgaatccaggtactcggactttggagtctatactcttggccactacactgtattactttttaaatggacaattatttctcttcttttaattggacctttcaacagcatttgacatagatgatcaatctctcctttttgaaaccttttattcttttgtcttctatttcttcattccttcacacacacatttctttatctttttccttttgtgcagctccttatcggtcttcttgctgtcttcccattccagatctagattttagactgttcttttttcttctttttctattggtgaaaccttttccgtggtaatcttgttcagtccatggctttacataccatctgtaggcttagatcactcaagacggcctctgtagcccaaatatctcccctaagctttattttataaatgttgttgcttgatttccatctctgcattggtatcttttaagcttaacatggccccaacagaagtacagatatactaacctcatccatcttctgacaaattcctctttcctaggccttctctatccatcagaactatcaacttctcattgctcagtccaagcttaggggtaattcttgattcttctttccctcatgacgcacattctacccactggtaaatcaaatcaactctacactgaaatatatccaagctgctacttctccccatctctgctgttgttaatctagtctaagtctcatccttgatcacagagactcctacacctcttcataactggtctccactcttgccttcttcatcccaatctctaaagagcagcatgagtaaaattctaatagatagatgatgtaatactatttctacccaaagatttcccatgcaggaagaataaaatccaatctccttaccatagtgtaccagcctttccatgatctgcttatgtttctgatacattgccctcaaactttcaattgtttagccacactccagccaccctggccatctttgctgccctggggatataccacacttccccctacttcatgaccttgttatttgctgctctaatatttgttcctcctttcttagatcttcatattagagacttccttctcattattcagctcatgattcggattatctcctcaaagagagatgtttcctgtgacacttgaaaaaatatgcattcccttcctacaaaattactctgaatcatgttactctactctactctactgtattttcttcaaggagcttaaaaatctaacattgccttaattattaccgtgggtgcttattatttgttttctcctcagaaacataagctctttgagggcaggaacagattgtgtcccttattcattgctgtgtttccagtactcaagaccatggctgatgtgtggtattcactcgcttaaaatgtgacctaataaagaaatgtagagaaggcagaatattaacgtgtataatgtaatataaaccatttggcaaattaaaacaaatggactcattcttagctaagaaaatattcacccagagcacgagaagatagggacagaagtctgcctcttatttttttgctttcatagagatagatttgtgtttgaatcaaacacagaaaacattccaatttatatctacagtggcagaaatggtatctgcctcttgaaggttctattgaggattatatgtcaaagctgtatgttacacttgagtttcttggtctcacacagaaggataagaggtaggaaatatgtgtgatttgctctgtcttagaaaaatctgagcgaactacttagcctgacttattgcacattggtttcactcatcttcaatgggaagattaatataaatgtatgatgtgccgatctcatttgcaatgggtctccttatgtttatgccattaaacaacttaagatctcctgcttttccattgtaatatctgtttttataacaattacacttttaaaattactgaaagcataatcttttaacaaatgtttgattttaagctgtttttaattttagcaggcaaaagttttatcttttcacagtaggattactatttgaagaagaaatgctgaaaaaaaataatgaagacaaactagaatcttatcataatatgatgagtaaggtccaaaattttcattaatccaacacacttagtgtccttattcaaggttgacaaaatgaatatggaagcctgacagcttattggactgggtttacaggcaattggctgccagatacgaattatccaagttcatggtaccatttggtgacagttgccctctcaggcaaaattgaaaggaatgactctggcttctgggactggttggatcttccagaaaaatggtggcaatttcaagaatcactggatttgttcattttcagggaaactgagcagaagaatactgagcatgtgggtgcccactgtctgcctccacttcctgcctagtcctcttactctcccctagaagaacacaagctttatcagcaaccacccactttgagaatggggctggcctcagtcccattgcagggtacctaggccagaggtttattttactttgattaatgcattgaacaaaaaggcattaaaaagtcatatgcaaataaatgtttttgatgacggcacatactgcttctgtatcagacttttaacagcttattctaatctagtcactaattgttcctgctttaccaagcattcactgacagaaatgttcctaccacatttagaaaagaaatcaaatctgcattatggagttagcatcattgtatttctcgtttcatgcctggtggaccccttatagagctatatttaatgtactgctaattaaaaagaagggtggggggaagtgtccaaagctttctcaatgttgtcttatcttttttgtttgtgcagctcaccatgttaaaacgggaacttgtgaggtggtggcactccacagatgctgtaataagaacaagatagaagaacggtcacaaacagtcaagtgctcctgcttccctgggcaggtggcaggcaccacgcgagctgctccatcatgtgtggatggtgtgacttcttccattccttattgtaacagcacagccaaggatggcttagaactagaaccccactataatgctctcaatgggaggtcaatcctgggtgaacatactacaaataccatgataagttgaaactagaatatttgggtggcattttgaaatctaaaatcctctggaaagaggtctaaaatattatgcagttctgttacaaaaggcattataatgaggttccattaaattaatgtgcatcttattttgataccatgaaatgttgatttctcggtggatggtgggaggtggattatgtgtaaattaattggaaaaggaaagatgaaaatggatgatttaatattatgggttcttaaacccatggatattcttaagaattaaaaaaaatagcaccatgtatatgagtgaacatttagttgtggatagaattaacataaaatatcaacttttatgatgatgcaataatatattaatttttttccttgagggttcacctaattatagtaggacataaatctttatatgcatttatttagttgatgttaccataaatagtaatttgttaagtgctcatattactataatatattgcttgtgatgaggttatagcacacagttaaaaaaattatgataactctgataaacaccctcctgataaccatcttattcatgggaatattatattgattataaagtgttgactctaaaaactggtcataggtccattttcttatatatttatataaattggtgcatatacacatttgcatagtttattttcaatatcttagctttcatgaagtctattttcacatgaaaatcctgtaatattgtgtctatagttaactatactgcattctacacttacaattttattaagtggatagatctcatgttaagtgttctcattacaataaaataaaaaatgttttaaagaaaattattttagttagaaaatcttgaaaggttttgtccttttgaacaaaaagaaaggcatacctcaaatacctgtattcccactggtaggaaaaattagtggcttttgttcctctttaaaggtgaacaagagaaataagtcccaagaaaaaaatgttgagtcaattttttttctctcttatagcttcaatagtggaacagaaatggtggtgccatatgcagccatgtctagagggagaagaatgtaaagttcttccggatcggaaaggatggagctgttcctctgggaataaagtcaaaacaactagggtaagtggacagcaagcttgggaaaacagaatgtctctgaattaatagagaacggagcttgtgcagtaaccaatttaagtggcaattgtggaatggaagagtatagttttgcaagatatgttttccccatttttttcttagttcgcttttttcataaaacatttttatttcactcagaacaacatcttccatagagtaccatcaactgtcatattatctgatcaataaacactgtttgctccttcataaaatactgagggtaatgtgaacctcctttccccactgaggatgcatgttaaattctgggagggtgaccccaatcctttatttttctaatgtatagtaatctaaataaattctgaaaacattattttatatattacttttaatacagttttttaactgagattcttttagttttatgaaagtaattattttgatctccctgatatctgaatcattaaatagttttctagtggttaagatttacaattattgtaatgggctactaggaagagtttcagattctcaagatcaatacaaaaagaatattcttaagacactgatgtatttcagctttgtaattactgacctctcggtgatggtagagaactgaaaaatagctttgttctttgatttcctaatttgccacatgggtattccagactggcagaatttgaattcttttctttatagaattagcaaaggaaggttttgttttgttttgcttttaggaaaagcatactataaattagagttgaatatttgaagaatagaacagagtaatggtataaattgatgttttataaaaagtaacataaaagtagagactggctaatttacaatactacttgatatagcagacttttaaaccttgtccagacatatacaagaggcttattttatgatctcatctagatatgtaatttagtctgccaagtaatatatttaatacattgactgatcagacatacacagaagtgactaagtttcaaatggcatgaataaaaacatatttcatgaaatttttcttgactctaacctgttagctaagtgtcacaccttttcaaaacccattggatgcatgatcaattagttaggataattatattattcagtgagctagcacatgatataatccgtattaatttgttaaaaacattctggcaatgtaaattttccttataagctatttataccatgaaaatattttccctagcactattaattctcagtccaaaaacaggacttaaggaaattcattaacgttttgagattctgaaacaaatttttaaaattgtgagctcttgacaaccaaattctttgtttttattacttcagtgaacaaggggaagctattatttattgtatacttaaaacatatgccatacactgaacaaaatgctttacatgagttagctcacttaatcttcctaatagcccagtggagaagatagtgttattatctccttttacagatgagtaaaccaaaacttccaaatgttatgtaacttcccaaggacatatagctaattaattaggaagccaggtttcaaaacatgtagttccattccaaaacccaatcttttaacctgtactttgtactaataatttaacttattcttaagcaataatggtaaaaatatcgtatagttcttttcttaagaggtcgacctttaaaaatatctctaactttctggatcattgaaatgaaaaggtcaagaccatgcagtctaaattctcatggaaaaaaaaaaatttggaagtgctgttttactcccttttggcctgttgaccatattctcaatgacccaaatttaaaatggagtgtctgcttcacaaattcttccaaatgtaatgaaacaaggtggatgagagactgagaactcatgagtagggaaaatcacatctacatcctataatttgttttagttataagacattatcctctatatagaggatagcactttctatttttctttaatctcttttgtcccaaagaatagctggtaatggaggaccttatttaagacattatagagggttttcatacaacagtaggtgtttagatttagtttcttttaagataccctctatttctaagagtctgtcactcccattttgaaaagaaaaatcatcatatataagaggagagagaaagacttgaaagaaggagcttcttgagtacaaccaaagtaaattcttatccttttattctttcacaagaaaaatgctgcttgtgaaaatggagctacttagacattttcaaccaaaggaacactatggcattccaaatagaaaggcaaaaatgtgcaatttagtttggcccaccaaacaatttgggcaaatttccctggtgctacaaatgaagcaaaaagttttcaaggtcatcaggctattattgctcagccatctccactgaaatagtgaaaagattggaggcgataagaaaaattcttaaaatagctctaggcatgtgttactttgcccacagtggaagtgttggatagaggaaatgttgaatagaggcagatagaagaagtgtttccatcatgcataaatagcactacttttgaaaacaaatttgagtcattattttaatcattggtattactgtccatatgtctgttttcaataatgtggttgtgatcaccatgagccaaaaagccattgaactcctgatttggcaggtcccagccacaattggaaaggccagaagttatgtaggaataggttacaaaataactcaagagctgtctcagccaaaagctatttgctttgcttatgcaagatatgttggtcttatgggattatcactgcaagcaaaatggcttgagaaataattaaaatatgcaataatgtacactctcccttataatggcccatagccaatctggagtgcttgggtaagcctgttaaataaatagcagtcagccagaaatagtaataaggcttgcatggcctcagcagagatgagtggcaccttcccgaattgactacaaatcagggtctgagtgatttttccacttaagactaattttgagcctatattgtacttactacaaatgtgaattatactcttcttctgtttttctatcggattctggaatttttttggttctgacccatttcctattggtgctaacagggggaaaaggtaaagaatagacagtcatttttggaacttgagtgttttgttgcatacctgttcttcacacacccaagcatttaatttggaaagagtggaagatgcaacagttgtttcccaaaccccatttctcagtctaaaggtggaaaatttatgactttctgtgacatctataaccgtctcttttattacttttaagatctcctaagttaaacagaaggaaaggaaaagtcattcaagccttttgatttcaaactcactttcaaagacaaataaagaacttttcaaagggtcattaataaaagaatcatctttccagtgtgaaagagtgcataattataagctaattatacaacacaaaagtaacaggggggaaagatgctgcagagcttgtaaaatataagaaaagaaaatatttaacatggttgaaatcatcggaaaaaaacagactgtgattctgtgtgtgtgtgtgtgtgtgtggggtgttttgatattctttcttcgtggaagatctaaaggaaataatattctgtttttaggatttatagtccttgcctaatggtatggacaccaagctacaaaatacagtggtcagtgcagtttttaatgttgattcttacctaaggatcaggttagagaaacttggtctcttacctaacttcgtattatataagactttacattgtttttaggaagattacctttatgaatcatatgtcccaggtctattgacttttcatatacttaagaagaaattttctggctaatttttaactaattgaaatctttcactttatgcatttatttaaagtggcttgagcagataagagctctgtaatttttaaatgttccttcaaatataagttgattttaaaggtatgcattatgatattattttattgtataatgcaatgaaaatcaaaatatattaagaatttcctatgcagcacattttatattaatagtactcatattagaattaaaacaacaaaagcaaatacagaagcatttacttagctcttactgtgatctgggcactctgctgagtacattgcaggtattatcttattcaatttacccaaccatagtagatactaaagagaatgcatggcttgatccaagcccacaaggagtatgccattgaatggaggaatgagtagtgtacagttatgttattcttttctttttttctcctttttttgagacaaagtcttactctgctgctcaggctggagtgcagtggcacagtcttagctcactgcaacctccacctcttgagttcaagcgattctcatgccttagcctcccaagtagctaggattactggcatgccccaccacacccagctatttttttttttttttatttttagtaacaacggggttttgctgtgctgcccaggctggtctctgactcctggcctcaagtgatccgcccaccttggactcccaaagtgctgagattacaggtgtgagcgaccacacccaaccacattattctttcctttacccatatgcagtctattgacaacaaacactggaatcagtggtaaatataagttaagagtaatattgtaacaatagaatagcataagaatgaggaagttgtgctagattcaatttcaaatttctctaaccaaggtttattcttgggttccatgtgacaagaagatttctaacttcctttccagctacatttaaatgacagtaataactgaaaatctcagaagatagataagtattaggtttttaatcctttcactgtaaggaagaaaagaaatagcatcttgtgatgctttgctgattaaagcctcaggttgtactcttccatttggatttcataccaaatctcagtgactctgctctgctggtggatctaaacagtgtccaggggtgctaattcagacccatgggaaatgatgtacacagcaagaggaaaaaagttcatttccttaccttaaggtggtgcaattcgtgtaaattcttcaatcatcatgctctctctagccttgcaaatttaagtacaggtttagaatagtgtggttctttcttgatcagctctttcttaacagacacatccccattcatttgtcttcatctcacttccagtcaggccctaaattacattctggtccacagcacagactgtaatgacctttagcgtttttctaattattttaatgcaactcacagtaagaaatacatcttacttagtgatctactacacacacaacatgcatatgcacactcatgtatgctacattaaaattaaggttgcattataatgttttgattttattatcttccctccctctctccctccctcccttcctcctttccttccttctgatgatctcaacctcataaattgctgttatcacctgtttatgtgttgcaacctgtagattgaaaaacactgctttaggaagtggtatttgactgtttcctatgtccaattcatagaactgatagccgctgctaacttgaagagaaacaaactactgaatgaagagctttcaaaacaacttaccttccacattttaattttaaatatttttatgcaacatttttgggctaaaaatttcttttttttttcttttttattattattatacttttaagttttagggtacatgtgcacaatgtgcaggttagttacatatgtatacacgtgccatgctggtgtgctgcacccactaactcgtcatctagcattaggtatatctcccagtgctatccctccccgctccccccaccccacaacagtccccagagtgtgatattccccttcctgtgtccatgtgatctcattgttcaattcccacctatgagtgagaatatgcggtgtttggttttttgttcttgccatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctatcgtgaataatgccgcaataaacatacgtgtgcatgtgtctttatagcagcatgatttataatcctttgggtatatacccagtaatgggatagctgggtcaaatggtatttccagttatagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggtcttgatttgcatttctctgatggccagtgatgagcactttttcatgtgttttttggctgcataaatgtcttcttttgagaagtgtctgttcatatcctttgcccactttttgatggggttgtttgtttttttcttgtaaatttgtttgagctcattgtagattctggatattagccctttgtcagatgagtaggtggtgaaaattttctcccattttgtaggttgcctgttcactctgatggtagtttcttttgctgtgcagaagctcttcaaaagactttgtgaaatacagattttgtgagaaagaatatgtatgctgtattcaaaaagtctttattgcctcctattgtcagattctattctgaattctggtcagagcactgaaaacaaaacaaaacaaaacaaactggatgaaaatccctgccttcatcaggcctgtaatctaatagggtatattcatctttttattgctgccatagcaaattaccacaaatttaatgacttaatacaatatccagtaattatctttaggtcagatgtccaggcacagtgtagctcaggtgggtctctgctctgggtttcacaagactgaaattaagggatatgtttcaccttttcacaacagggctttgtttctttccagagactttggggagaatccacttccaagctcattcaggctattgttagaatttgtttgtttgcaaatgtaggactgaggtgactgtttctttgtgtattagttcattctcacactgctatgaagaaatacctgagactgggtaatttataaaggaaggagggttaattgactcacagttccacattgctggggaggcctcaggaaacttacaatcatggcacaaggcaaaggaaaagcaggtaccttcttcacagggcggcaggatggagtgagtgcaagcaagggaaatgccagatgcttataaaaccatcagatctcatgagactcactcactatcatgagaacagcatgggggaaactagcctcatgatccacttacctctacctggcctcacccttgacatgtggggattatagggattacaattcaaggtgagattttgggtggggacacaactaaaccatattaccaaggtagccatcatcaggaggctctctggccttattcagggtgcctgtcattctaatcatatttcctccttcacctcaaaccagcaatggcatgttgagtctgtctcatgctctgaagctctttgacttccccttcccccatctgttccctttcttcctcttccactgcatttctcttgtgggctcttttggctttctctgccttttcggggtacagatgattacattgtgtcctcctagatagtccagggtaatctccctctcttaacatcagctgattagcaaccataattacatctgcagaatctctgtatagcagtgcttagattagtgtttgtttgaataatcaagggatgaaaatctcgggagtatatctttggaattctgcataccacatgggaggatacaaaaaaataaacaaaataagtaagtaaatatatagtatgttggatgttgatagatgccatgggaagaaaattaagcagggaagggaagtggggagtgttgctgagcaagggagtttgcatagttgattgaggtcttgggaggtgagggcatgagctacatggctaaatggaggacaagctatccaggcagagggaagaagtgaaagtacctgagatgagagctttgctgggcaaatcatattcaaggggtagaaatgatgcttgtggctggagtggagtgaactagggcaagtggtagaattaaggttagaaaggcaacatgagtaatgtcacaactgacttaaacttttgtcctaaacaaatagaatgagggatttgccattatgtgagatggagagaactgtgggaagagcaagttttatgttttacattaataactactaaatttaggtcgtttaacttaatgaaaaactaaatatggtataacaccttaaatttgatatttctgaagaagagtaggtagacttttttctatagtaatgagagattcagaaactaagtgatatttatattaaataatatttaaactcaaatgatatggagatgtgaaacataacacttaagggagcatgtagtcactatactaatgttaagttttaaagagatttggacaaaatggattaatatattaaggcaatctttttctttaattagatattgagttcaaggtagacaggacactaagctaggtgtccatgaagtagcattagtaaaagtaacatttttagactaggtgcagaggtttccagcactctgggaagctgaggtgggaggtgggaggattgcttgaggccaagagttaaagaccaacatgggcaacatagtgagacccagtctgtaaaaaacaaaaattaggcagatgtggtggcattcacctgtacccccagctacttggaaggctgaggcaggaaagttgcttgatcctaggaggttgaggctgcagtaagccatgattgtgccactgaactctagcctagacaacagaatgagactctgtctcaaaagaaagtaacattttaaacctgatattttaaatttaagagctgattacttaattaaatataatttaatagggccaagagtgtctaccttggtatttgtttaaagagttattgaaaaataatgcaaaaaaatatatcatccggctctatgtccaaaacttggcctgtatttttgtaattgaaatgagaaatgggcgatatatgtgtgcttttaagttcctctaagatgtagatgcttctgcaatatttgagccaggtgttaatctgtagatgttactccaaatgttgtgcttataatcttacagttaattgtgaatgttcacatattgtaataggaccagtttgagcaccatagaatttcatttacaactgcaaggtacatctttaggcgactgcttctgttctatgaactaagtggcgagagcaatatttctgtctcttacctgagggctgatagataaaattctgtcagggctttatatctaatgtttaagaccttgatatttgtttaaaggtaagcattcctgggagaggcaacacttttacctggttttggttactaaaatggcttaataaaagaaaaatggcacctcgtaggacttggggaatagaaaggtatgttcaagaagccatagttagtggtgcttctgtgcttttttcctctactgtgagtggcaaacctcctattaaaaaatatggataatctttcctatgtacgttctcccatggctctttccctcctgtgtccatcacacgttttatgtgaaatttaactcttgtaatcaatgacttcagatccaattttattttcttactctggagagtggggtgaagatgcagctgagaaataacacataatgttcccacaagttcaggatttctagctccctgcaaggctgttcaggacttgtcacttcacctgtgagtagtggagagttgtttgtgaagtgcacctaatataaagggtggtgttgagctttactttagagtgatcagacctcatctggatgtggtcaagaaagtcctggataccaacttttaatggggtagaagaaaagaggcaaatgtaaaggattttgtggagatttacctcagggaattaaagcactaggagcaatatgcgttaaattatttgatgatatagcatgtgaaagaaaaaaatgtagatttgttctgtgtgactacaaggaatacaactaaggctatagtaataactttctcagtgtcaactctagatgacattgaatgggctgccttaagaaacagtaatttcctcattttaggatggcatatatttgtgacttttaagggatgaacagaaattcgcagagttgtctacatcaagctatcaaaacaaaaaacagcttatatgaaggcatgacggaatagaagatcatatcttactcatggaattgaaaccatttcatggggtaacaatgtgtgtgaggggaagtatgtaatgaggaatccctgtgaggggaatcatggcaggttgagtttgtatcatgatgggcttttaaataccatgttaaaagatttggattttttctccatgcagtggtgaatcatcgaagaaccttaatcaagcaggagaggagaagggtctgatttatacttcataatgtctatttggctgcaatgggtcaacagaattgaaggaggtatgagttaatgggcctgaagtaaggtagggaggtgatggtagtgtgggtgcagagggaagggaattgatagggcttggtaattaattgaacatgaaaagtaaatgaaaggaaaaattcagactcacatacttcttacatatttcttgcttgacttattgttgcaatagtaattgctaatgagactatgaggtagagatatctggaggataatttgatatatagctctagaggtcaagatagaaatctggaaattattattccctaggtggtattgaaatagttaatcaagaatgctctctcaaaagaaatgcatagaaaaagaagagcgtcaaagacattttaacaactaatgtggaagaaagtacctgtaaggaacaaaaagtgtagacagagaaatagacagaaaaccaagaaagaccagagtctgggggaatgcagaaatagagttccagggatccagggctttcaattgatacaaggatatggaacctacagacaggttatgtggctttatgtctctttctgaatgtgggatttacaagaaatactgagttcttgtccattagatgaacattacttgttttattataatcctaaaacttgcctgctagttggatgatgtcattgttaacacattgtaaacactgcagaatatacatccatttaaaacagaatgcactgtttaaagtactttaaaaataagaataaatatgggctgggcacagtggctcatgcctgtaatcccagcactttgggaggcagaagcagacggatctcttgaggccagatgttcgagaccagccaggccaacatggtgaaacccaatctctactaaaaatgcaaaaattagccaggtatggtggcacatgcttgcagtcccggcctcgggaggctgaggcatgagaattgcttgaacccaggaggtggaggctacagtgagctgagatttcaccatcgcactccaacctgggtgacagagtgagactctgtctaaaagaataaatatgaatctccttagcagaattaacaaactctgtttaaaggaagcttgtctgttcattcattcattcactctgtgaagataaatcgaatgtactctatgtgggtatgtgccagacattgtgctagattttggggattcagattttttaaaaattatgactctttgctgtccaagagttcacaagttcacagtcaattggatagaaagtcagtaaatcattgtcatgtacagaagtggcaggacagaagtttgtgtaagtgccacgaaagcacattggcagtttaatattgcatggcccataactcttctaacactcaatgataccagattgtgatgccattcaagggcaatttacctataatttgtctccttagtatatagcaactaaatgcaatctaacagaatctaaatattatattccatgatgtcaagattgaactgaatttttttcttgcctttatatctgtatagtactatcataatagaacaaaattcaataaaatgctttctcaactagactatcttcatacacatatatatgtgtgtgtgtgtatgcatgtaaatatatatacacacacatgcaagagagatggagacacatacacacacacacacacactcacacacacacacagagcagagagagaggagagacaggggaagggagataatttgcatataaaaaattggggctacactaataactctaattaaattgaaaataatttaagattcccacgagcgaataagaatattggaacctgataccattgcacatatttttaatgttttaagctgataaaacactttaaaaattttgaagtaatgtatattagttttagcaaaatcagccattcagttgaaatgtgatctaagatataaaactcaaattgccaaattaaaacaaaaaataatacatatagcttatactaagccatagaattctatttattataatgtttaatattgaacttgtttaacatgagttatttagctgttaaatatatgctttgctctcatggttcagtattatggcatttttttttttcctattaagtagcaatgttggcttcccatgatttatggtaggattagcctaaagtcaataaaggattattttgttgaggttctgcttaccattggctattttacctttatattttattgcttattctcttctggtgacaaactttttttttgcatctaaaaaatttgcttatttatataaatttaagtgctacaagtgagtttttttacatgagtatttcaaataatgatgaagtctgggcttttagtgtaatcattttctgaataatgtacattgtacctattaagccacttttcatccttcactcccctcccaccttcccatccttctgagtctccagtgtctatttttttatttgtttttagactttttttttttagactttaagttgtgggatacatgtgcagaacgtgcaggtttgtacataggtatacacgtgccacggtggtttgctgcacccattaacccatcatctacattaggtatttctcctaatgctctcccaccccttgcctcccaactctgacaggctccggtgtgtgatattcccccccacccctgtgtccatgtgttctcattgttcaactcccacttatgagtgagaacatgtggtgttttggttttctgttcctgtgtttgctgagaatgatgggacaaacatattttacacttacattgcattttctgttctcttcttggtcctgttaaaagaaaactggtgagggcagggagaaggatggtagagagacagagaaagagaaagagaaactgggtaatatcaggcagtgtaaatttattttcaaagaatgcttgcaaattgaatgcaatctttgctttgcaactttaaaatactctatatttgaaaaggctgtttgagtaattgtgaggagagttgatttggtcagcctgtttctaagattcatatactgagatgcatttattctatcttgaaagaaatcaaattgaatattctcagacacattggccgacagtcaggataatctaaacaactatcatgattagaaatctcaacccccaacttcaattacaacatatgattgatttgtgagattaccgaaggcaaatgtctggccagacagtccaactattgtttgagattaaatttcacaaatgaaatcaacttgttgagagcactctgcctccagattatagctttgaggacttcttagatgggttttaagtgaattcccttatgaataagggaaattatgataaaagctgttaatggtaactttaaaataattcacgttgtacctacgtaatggtctaaggagatcctattcagtaaaactgtttcacatcactatatgatactgaaggtaaagataaatattcataacatgaaacaaaattgtttatataagttgattaaaaatgtctacagatcataatagaattattttctgtagtactgttgatgtctcactaagggtttagcctttctgaggttactgaaattagtgacagatggagacattgtcaaggtgtatcaggtaatttttgattctccatttcacccaccataaccatttgaggtaactgtgcaatgttacctcaacattgcacagtttacagagcactgctggtgccttcaaggatggcataatgattaagaacccagtctctggaatcattacttgagttcatatcccaactgccatgtattagctggtggtcttgggaaagttactttacatcaatactcctcagtttccacatctgggagatgatgacaataatatatctgccacatagatttctcacatggattaaattagtttatatatgtaacacacttaaaacagtttctggccaagtataagggctatatgtgcttgttaactaaaacagataagcaagttgttaataggctaataaaatgggccagttttctcataactcaaatattaacattattattccacagcagtcagtcttgttaaagaaatactaatgtggaaataactcaaaacttcctctactatctctattcatacttaaactagggctttgaagagaaagcacaaattcattggaggttggtctgtctcttttagaatagccacaaaatttcatcctagaaagaaaccatagaactgtactaaatggatttcagtgcttgagaacagtctccacctggcctcagacatggggccattctagttatttaccataggtgggtcaggtggggactgttggactacacaattgtaaaggtgctctacccaggatatgctgcaagagcagaaatgttttttcttatttatagccatcagacattgggttttcagcaacatctcttatggacttatcaggcctaccaggtgaaggagacaattcttctttttctgacaatcacaattattgacatttattcaactagtatttctatgtccagtggtataattcaaagatagcctcatatgcatgcacaaatcttttacgtttaaaaatgctttgttaactggagagggaggagtattagcctgggtttatgagctaggtttgtgtgtgtgtgtgtgtgtgtgtgtgtgtgtgtgtgtgttttcattttcattttaagtttttgtagttgtttgcctgttgcaattttagatgaggttagcctggagtggttgttgcagcaggaaagacttgtttattgaatgctgagtcacccttgcccattttgctattactaatataacgttaatgttcttactaaatcacaaaacaccaagtagaaactgatgcagaaagtgtttatagatattcagcaattagcagaggccaataattcctattaatggaataaccaataaaacctaagtgatttttggacctcagtacattttaaccaaaatatgttacaatatgtaagtttttgctcttaggagatgttatgtacgtagcatacattctttataatttgtcttgactctagtataatctcaaaaatagagcaagctttgttctatgctttgtgaaggataatgatagtattaaagagctagaaatacatttgtgcttactgccttatttattaaataattagatttcatattttgtagcaggaatagaataatgataattttaagcaaataaatttattttaaaaatacttatttcaaaatatgttttgaaaatgtttaaaagttgctgtttattatattcttgctggaggcataattgcacttaaccttcatagcagtgtaataagatatggattgtcttcatttataggtaaggaaactaagtttttttttttagtgaaataacagggccacacaattaataaatatttaagtgagcataatcccaagactagatgatgttcttaaccccatgctcttaaccactatgttatatgtattacccatctgattctctgaaaatctatattcatcattgtctttctcatcactattactattagataaacattcagtatgtgtaggacacattccattttagtcaaattttaattattcatggtaaagaagtgaaaaaaagttaggagaaattgaaaaagatatgcaattttcatgtttcaattttaggcaaaatcagaaaattttcattataatataatttttctttaaaatgtaatagaaaaaaacttaaaaaatctcgttggtaaactgaagagcacactaggtaatataaaatcccaatattgcagtgttttaaaatagacctagatttttttagatgcctatttgacctccttgttataacaactcttttatctcaaaggtagtagtgtgtgccatcactttaatgtgattctcagagttcaggaccctggactacaatactaactgacaatattatagtcagtctttcacattactatctctatgtctcatctttatgatgggaaagttgaagaaattagtgcagtgctatatctatatatacctcttcaatgccaaactttaacatttattagcaacttgatgtgatttagtggatttcagaaatgttttatgcttcaaggaatcctcttttttgcctatcacaatggctgaaattcttgcattagagagtcattcattcacagcctgaagactttacatctaggagttatttgttaaaagtaaatttccattataagaataattactctatgtgggtgatgatataatttattgtccatagtaggacatatttccaggataaactcaacaggaattcaggacaacggggtaaatcagagctatcccaagcaaaatggaaaatgtaatcattccaattgtaagtaacaattagctaatgtctattttaagtattagatgaaagcaagtttagaaagaagacagtctaagcatgattgcaatgcagaagtactatgcaggcagaaaaataccaataataaatttcaattattaattttatgaatgactcatcaataccaaattcatcagtaaagttgaatccacataacttgactttcagttttagtaatagatcaggtgatatcgttaagtttctcctcccctcatcccataaaagaaaactgaagaacttaacaaaatataagatgatatgtttggaggcattggaaagccaacaagaaagtgaagagttacttgtccagaatttaggaaggatgaagactaacagagattagtcggctcttggaaatcacttaacccatggaggcaattatcaacattagaggagtggctcagtggataaaagtgcattgacgaccttgcagaacccagcagactctgccatagtaagccagggattgctgagaaggggagccctggtaaatctctcttatttcctattataaacccaaagtgctacaccccaggaggaagagggaattaaaagtagaacagccctcacagggctcagtctgaatcactttaatacctgaaattagattgaggtgagcagatatgtttaaggcatgcttggcaaaagcaaatgtaattcttctctggaaagattatggccccagtctcacaatcactccacaaataattttgcaaatatattcagcatacaatgaaaaataaccaggcaaacatgaagataaggcaatgtaaacaaaaacaaaataatatacaatagtgaattattaagctgcagaactgctgcactaagacaaacattaaaaaatttgtgaaagaatgtgtaatttccaagtcaactaaaaaaaatggactaataaaaactatacaaaagaaggcaaaagaggagggaaaataaatctagaacaggtggaataaatagaagttactcaataatggtagctgcaactcagatatatgagtgattatatcaaatgataatggggtaaataattcaattaaaaagcaaataaataatgtttagaatgatgaatatgctaatcaccctgaattgatctttatgtaatgtatatatgcatggaaacatcacactgtatcacataaatatgtacaattattatgtgtcaattatgaataaaataaactttttaagaaaggcaaatacaaagattgccaatctggatcaaaagatcaaaacacaagtatatgctgtttaacagaaatacatccaaactataagaattaagaaaaatggaaaataagacaataatgggaaagatatacactatgcaaatatcaataccaaagaatttgcagcaaatactattgctaaagaaggatattttctaattataaaaggcctaattcctcaggaggaaaccacataaatgacttcctgcttgtgttagtgcctgcctactacttctattttcacaagaattggttaactctaattaagttctaactaacacttattaagtcctcactatggccaaacaactccaagaactttatacatactagctcatttaattcttacaaccaccccataagaaagacttgattattatcatccttttacagttgaggagattgagacataaagaggttgtcaactcataaaaatagtgagtatactggtatttggcacagggaaagaaggggtgatgaaggggaaaataatataaaggtagttattaccactgaactgtacacttacaaatggtaaagatggtaaattctatatgtatatatttctttatttaaaaaaaataaaaagaggttgcccaagttacattgtgagtaagcagtggaactgggatcaaacccaggctatatagcctccaagtcatgaaaataaatatttgactaggaagagcctaactgaaccaaataatttttggctttgtctctgctgcacatttcaaacaagtttgccataaatgggatagggcctaatacattcctttctctgtgcttcaaatattagtttagttttttttattttattattattatactttaagttttagggtacatgtgcacaatgtgcaggttagttacatatgtatacatgtgccatgctggtgtgctgcacccattaactcgtcatttagtattaggtatatctcctaatgctatccctcccccctcccccgaccccacaaccgtccccagagtgtgatgttccccttcccatgtccatgtgttttcaatgttcaattcccacctatgagtgagaacatgcggtatttggttttttgtccttgcgatagtttactgagaatgatgatttccaattgtccctgtttgcagatgacatgattgtgtatctagaaaaccccattatctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaaatggccatactgcccaaggtaatttatagattcaatgccatccccatcaagctaccaatgcctttcttcacagaattggaaaaagctactttaaagttcgtatggaaccaaaaaagagccagcatcgccaagtcaatcctaagccaaaagaacaaagctggaggcatcatgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgacaaaaacaagcaatggggaaaggattccctatttaataaatggtgctgggaaaactggctagccatatgtagaaagctgaaactggatcccttccttacatcttatacaaaaattaattcaagatggattaaagacttaaacgttagacctaaaaccataaaaaccctagaagaaaacctgggcattaccattcaggacataggcatgggcaaggacttcatgtctaaaacaccaaaagcaatggcaacaaaaggcaaaattgacaaatgggatctaattaaactaaagagcttctgcacagcaaaagaaactaccatcagagtgaacaggtaacctacaaaatgggagaaaattttcacaacctactcatctgacagagggctaatatccagaatctacaatgaactcaaacacatttacaagaaaaaaacaaacaaccccatcaaaaagtgggcgaaggacatgttagttcagatttttatctatttctttctttcagaaccccctaaaagccaagacatggcatgttttctcatgactgagctcaatttctcttggatttcattaacccaagagcagctgaatagattgagtgtataagagatgggggtatgccttcaaagatttcctcatggacagacttcttgttctagattggttttctatactaaggaatatttcaatatagctaaaatttaagtgaatataaaccatgcattcaggaattttctcccatcagtcagctgaaaacatttagcaggaaaatcttctgttgcttaacacatgcacgcacgcacgcacacacacacacacacacacaaaaaatcacttgctcactccaccttgtctctccccaaaacattgcaaaccatcaccatctgaacctccttgtctctccccaaaacattgctaactatcaccatctgaacagaaggaacagaacactggcctccaggacttataaatagaggtctgcattgtctctcatgcccatccaacctctattcagtttcaattccaagcatgaggctttctgagggaggaagttacaaagtcatgtgtgttaccggaaacttcattgcatttctttttagtgtgactccatgacagcaaggaccatgtctgcttttgcctacggtttagccttagtaaataacgtggtagcacagtaagattcattgaataattcattgagttattcatcgaataaacaaggaagtaaacagacaaatgaacaaacctgtgatctcatctcctactactttcttccttgcttatttcactgacaccacaccacccttttgtacttttttcatctcagatattctgcagatgctgttacctctgcctaaaatgctcttttcccagctacccacttgactggctctcttatctccatatgctcttactgaaacctcactttctcagcaagtcttcctcatctacatcaattaaaattgtacatccctgtctcaaaagtccctctctttctctcgacttaattcttctcttggcagggcctaaaatacattaaaattttatgtattatgtctgttgtttgcctgcctctgtagatagttccacagaggagtgatttttatctttttcttcacacctaggatagtgcctcccacttagtacatgctcaataaatattagctaaatgaagaaatagaagaacctagaacacataacctgtttcactggttttgaagcccaaaactaagaatcttttccccagactatttcttcctgcttccctgcatctttgggaagtttcacttaatttttctgaggttccgtgtcctcaactgtaaactggggataatgataattagtaacaaagactaataatattaatagcagtaaatcataaatggggactatctcacagaataattctcggggttttacaaaagaacatggaagtttattaagttgtctactgatgcaacaattatgatctgagaggcggaagtaaaagaagaatgagcagggtttcaggattccttgagtaacagaatgagcagcagttttaaccaaaacccaattttttggtcctagtctaagccaaaaaatgtgttgtacttctgctaagcaaaaattaactgctggaaaatggcagataggaggtaggactaacttgcagctcccacttggacacacagaacagcgtgtggagactaacattgtaaacttttgcttcaagaaccaccacaggaacgtaccagaaaaaacaaaagaattcacaagatgtagcttgttgccagtaaactccataagacagacaaaaaactcagtacccaagtttggaggggtaaagtccatcttgttcactggggaaactgaaaaaccagatgatgggagaaggatttaacctcacctagagctgaaacaaatttagagaacagagcaagatacgaaagtagaagaagcagtgggaagaaccctggaggtactcccagtccccagggaagccatttctgactttatctcacaggggtccttggggaaggcagtcaatggaattggggaagggccacaaggggaaggagacttccagttgaactttgtaataatttcaactgagtgctaatttcctgggcagaatcctatggtgggggtgcaaattggaagtgcagatatgagcacagaaggcacaacagacagggaggggcaaagcctgaaatccctgcctgctttctcagagggaaggcttgtagcctgggacaagatctcagccctgtacactgaaggcctggatgtaaatttggctctgttggctgttgggggagcatggcaggaatgagactggcctgttgactgtgtaggtgttgggtgatgcttgtcactgccaactttccccacttacctggtgacctgtatgaagcagcagaggcagccataatccccttgtaacatgaatcgattggcctgagaaccacatccccataccacacagtggctgcagcaagccctgcccatggagagtctgagatcagacacacctaaccctgcacccacttgatggtctttctctacctaccctggtaggcaaagacaaaagacgtaagcttgtaggagctctacggccccacccattgcctgagaaacccaatacttattcaggagacctgagggcaagcttctgtctcccctgtactactgcagctgatattctcttgaaaccaccacctccttgctggatgccaactaactcaagatattataacaacttagaacaaccctgctccgaggaagaaaaatacaccagctaattccactgcctataacatcctggctaaccagaggtcctgagtctgtccatgtgacagcttcactgctagcataatcagtgttcagaaaaaccagtgcactaaagaaaactgcagtgaaggaccccacagaatttaattcactcccttgctacatccaccacagcaggtgctggtatccatggctgggagacctgaagacagatcacatcacagtactccttgcagacactatccaatactggtccagagcgcagtagctctgctggatggctagatccagaagagcaataacagtcactgcagtctttctctcaggaagtcctatccctaggagaaggggaagagtgccacatcgagggatcaccccatgggataaaaaatctgaacaacagcccttgagtcccagatctttcctctgacatagtatacccaaatgagaaggaaccagaaaaaataattctggtaatatgacaaaataaggttccataacaccctcaaaatatcacactgtctcaacagcaagggatccaaatcaagaagaaatctctgaattgccagaaaaagaattcagaaggtcaattattaagctactttaggagacaccagagaaaggtgaaaacaaacttaaagaaatttaaaaaataatacagaatatgaatgaaaaatcaccagagaaatagatatcataaataaaaaacaatcacaacttctggaaatgaaagatgcacttagaaaaatgcaaaatacactggaaagtatcaacaatagaattgaacaagtagaagaaagaaattcagggctccaagacaaggctttcaaattaactcaatctgacaaaaacaaagaaaaaaatttaaaaaattaatagagcctccaagaagtttgagattatgttaaacgaccaaacctaagaataattggtgttcccaaggaagaaatctaaaactttagaaaacttatttgataaaataattgaggaaaattttcatggtcttgctagagatctagatatccaaatacaagaacctcagaaaaaaagtgggaaattcatagcaaaaagattattgcctagtcacatagtcatcaggttatctaaaatcaagatgaaagaagccatcttaagagctgtgaagcaaaagcatcaggtaacttaccagattaacatcagatttctcagcagaaactatacaagctagaagagattggggtgctatttttagccttcttaaatgaaaaaaaaaatcagccaagaattttgtattcagtgaaactaagcttcataaatgaaggaaagataaagcattttttagacaaacaaatgctgagagaatttgctactaccaagccaatactataagattgttaaaagaaattctaaatcttgacacaaaaccttgaattacaccaaaatagaaactttttaaagcataaatcttacagggactataaaacaataatacaatgaaaaaaaaatcaaggtattgggacaccaactagcatgatgaatagaatagtacctcacatctcaataatattcgcattgaatgtatatggcctaaatgttaaatattccacttcaaatatgcagaatggcagaatggatagaagtcaccaaccaagtatctgctgtcttcaagagactcacctaacacataaggacttacataaacttaaggcaaaggggtggaaaaagatattccaggcaaatggacaccaaaagcaagcagaaatagctattcttatatcagacaaaacagactttaaagcaacaacaattaaaaaaaggaggaagaaggacattatatagtgataaaaagactagtccaacagagaaagatcacagtcttaaatgtgtatgcacctaatgctggagatcccaaatttattaaacaattactgctagacctaagaaatgagacagacagccacacaataatagtggaagacttcaatactccactgacagcactagacaggtcattaagacagaaagtcaacaaaaaaacaatggacttaaactataccccagaacaaatggacttaacagatatttacagaacattctatccaaaaactgcacaatatacattctattcatcagcatatggagcattctccaagatagaccatatgataggccacaaaacaagtctcaataaatttaagaaaatcaaaatatatcaagtactctctctgaccacagtggaataaaactgcacatcgactgaaaaaaaaaaaaaaaacaaccctcaaaagtatgcaaatacatggaaattaagtaatccgctcctgaatgattcatgttgggtcaacaatgaaatccagatggaaatttaaaaattgtttgaactgaatgataatagtgacacaacctatcaaaaccactgggatacagcaaatgtagtgctaagaggaaagttcatgtcattgaatgcctacattaaaaagtctgaaagagcatgaatagacaatctaaggtcacaccataagtatttagagaaaaaagaacaaaccaaacccatacccagcagaagaaaagaaataacaaagatcagaactaaatgaaagtgtaactaaaccatacaaaagttaagtgaaacaaaaagctgattctttgaaaagataaacaaaattgatacaccattagcaagattaaccaacaaaagaaaagagaagatccaaataagctcaattagaaacaaaatgggagatattataactgatatcacagaaatgcaaaagatcatccaaggctactatgaacacctttatgcacagaaactagaagacctagaggagatagataaattcatggaaatatacaaccctcctagattaagccagaaagaaatagaaactctaaacagaccaataacaagcagcaagtttgaaatggtaataaaaaaaattgtcaaaaaaaaaaggtccaggaccagatggattcacagctgaatttataaaacaaagaagaattggtaccaattctacagaaactattccaaaaggtacagaaagagagaatcctccctaaatcattctatcaagccagtatcaccttaatttcaaaaccagataacataaaaaaagaaaactacagttcaatatccttgatgaacatagatgcaaaaattctcaataaattactagctaattgaatccaacagcttatcagtaagataatccaccatgatcaagtgtgcttcataccagggattcagggatggcttaacatatggaagtcaataaatgtgatacatcacataaagagaattaaaaacaaaaatcacataatcatctcaatagtctcagaaaaagcatttgacaaaatctatcatcactttatgattaaaaccctcagcaaaattagtatagaagggacataccttaagataataaaagccattcatgacaaacccacagccaacattatactgaacagggaggagttgaaagcattcttccccctgagaactggaacaagacaaggatgtccactttcaccacttttattcaacatagtcctagccagagcaatcagataagaaaaagaaataaaggacatccaaataggtaaagataaagtcaaactgtcactgttcactggtgatatgattggatacctagaaaaccctaaggactcatccaaaaagctcctagatctgaaaatgaactcagtaaagtttcaggatacaaaatcaatgtacacaaatcagtagcactgctatacaccaatagtgaccaagctgagaatccaatcaagaacttgactacttttacaatagctgcacaaaaaataaaatacctaggagtacacctaaccaaggaggtgaaaaccctccacaaggaaagctacaaaacactgctgaaagaaatcatagacgacactaacaaatagaaactcatctcatgctcatggatgggtagaatcaatattgtgaaaataagcataccgccaaaagcaatctacaaattcaatgcattcccatctaaataccaccatcattcttcatataactagaagaaaaaaatcctaaaattcatatggaaccaaaaaagagcccaccaattagagataaaacatatagaaaaaagttattctactcttaaaacattcaatgggtatatatcaaattaaaaaaagagtccctgaaaacatttctatattttagaacaatgtaaagaaaatggaggattagaaatgtgtaaatgatgttatttccccacgtgtgacttgctttttctaaaaaaaaaaaaagaaaaaagaaactcttctcagatttttgtgcacccattacccaaagagtgtacactatacccactgtgtagtcttttatacctcacccctcaccaacccttctccccaaatccccaaagtttattgtatcattcttatgcctttgtgtctgcatagcttagctttcactgataagtgagaacatacgatgtgtggttttccattcctgagttacttcacttagaataatggcctccaactccatccaggttacttgctttgccaaagcaagactaagcaaaagcaacaaatttggaggcctcacattttctgaacttcaaactatactataaggctatagtcaccaaagcagcatggtactggtataaaaataggcacaaagaccaatggaacagaatacagaacccagaaatgaagcaaaatacttatagctaaatgatctttgacaaagcaaacaaaagcataaagtggggaaaggacaccctattcaacaaatggtgctgggataactggcaagccacatgcagaagaatgaagctggatcctcatctcccaccttataaaaaaatcaacccaagatggatcaaaggcttaaatgttagacatgaaaccataaaaattctagaagacaacatcagaaaaactcttatagacaccagcttatgcaaagaattcacgacaaagaacccaaaagcaaatgtggcaaaaacaaagataaattgatgggacttaattgaaataaaaagcttctacacagcaaaagtaataatcagcagagtaaacagacaacccacagagtgggagacaatacttgcaaactatgcatccaacaaaaaactatatccagaatctacaaaggaactcaaatcatcaagaaacaaataatcccatcaaaaagtgggctaaggacataaatagataaaaaagaaagatatacaaattgccaacaaacataaaaacatgctcaacctcactaattatcaggaaaatgcaaatcaaaaccacaatggaatggccataatttaaaagatcaaaaaataatagacattggtatggatgtggtgaaaatagaacacttacactgctggggggaatgtaaactagtacaaccactatgcaaaacagtgtggagattccataagaactaaaagtagatgtacaatttgatccagcaatctcactactgggtgtatatacatatacacccatctggtgtatacacacacacacacacacacacacacacacacacacacacacacacacacatagacataccatggaatactactcagccatgaaaagaaatgaaataatttctttcacagtaacctggatggaggccattattctaagtgaagtaactcaggaatggaaaaccaaacattgtatgttctcacttataagtgaaagctaagctgtgcagacacaaaggcataggaatgatacaataaactttggggactcggggagaagggatggtgaggggtgaggtataaaagactacacattgggtatagtgtacactcttcaggggatgagtgtacaaaaatctcagaaatcacaactaaagcacttatccacataaccaaaaaccacctgttcccccaaaagtattgaaatggaaggaaggaagaaaggaaggaaggagagaggagagggagagggagaggaagaaagaaagaaagaaagaaaaagagaaaagaacaccaaaaaatataaaatgtgtcttctctttgttcatgcagttccacattcagaaactattatgagggggaaaccccaaatcaaagtatcaacaataaaaaataaaaatcatgccacatacatgctttaaaaatactagtctccagatttgataggaaaaataaagcaggagagaggtcagccatcctgaactgtaatatatacagtacataattctgtttgtgtgcatgcacataagtgattgcatgcacaatattattttggggcaatggtgaaccaatcattgtgctatttgtttactgtgttctattacaggaaatttgatgctatttcatttgcaccaccatatctgatgtcaagtgagcatgtaattccttggtgtagggtaattgtctcatgaaatatttcatgagaagaatttcctgacagtgttaagcagctgtatggaaattactcaggagataggtgtatttttttaagggatagcttctaactgaaatattaactgtaatgaatatgccagcattaaccttgatgcattcatttggacattttccacatcccaagtgattagtctaataccaattagagcatcacagattgctattatctacttgcatcattattttcatgaattaattttgtttttaaaatcagaccttttccaagtgagaataaatttaaatatctgaggtgaaaatgtgaagctgaatgtcaggacccatgtgtatctataatttcagatgctgaaactgcagaatcatagggataatcctagaaaaattaaagattgaggaactgaccctttgggtcacctaatcaccccccttgctgtttacagagaatccaaatatcgattctagctttccttcttctgaaattacttatcgcctttttccttatattaattcattcacgtgttcatttatttattcatctctccatgcatccattgtttcaatctttcatttaataaatattaggcatcatttatgtgcctgatatgctgcttagcactgacgaaacaaaatgtatgctaatattctttttctccaatacctcgtattttagtgagagaaacagattaataatcataatatgatgaaatatgttttataatagaactatgacaaagtgctgatcggataaatcatgaagtggccacatttcttctgggatttgaaacaagtgtattttaggcaaagctaaaacaaacacaaagatcaggggacatgaatgggcacatcaagtcctaggattaagtaggcatgactagagtggtgcatgcatgttttgtggagacattgggaagaaggggagatgaatctgggtgtttggggtctaatcatgaaggatgttatatatcataaataagtttatgtttcttcctgtaataggatagtattatagatttttcttttcaggatgatggtggcaaagaggaggaggaacagcagggaacaagacaagtcagggcattattgcaattatacacaccaggtggaataaagagtgtagtagtgggaccaagagtaggaaatagattagaaagatgattagaaactgattagagataagacatataggaaaaagttattctactcttaaagtgttcaatgggtatatatgaaatttttaaaaagtccctgaaaacatttctatgtttttgaacgacataaagaaaatggaggattggaaatgtgtagatgatgtatttctccatatgcgactcgctttttcttaaaaacagaaaaacaaaaaactgaaactctcctaaattttctcagtctttatcatttatcttcaactacatgtgtccactgcaggtcataacactgacccacttcacaactgtgttggctttgatatatctaaataaaggcatctagactcgactctggccagaatacaaaagttccactcttcctcaaaccatcatttaaatcttacattttctggtttaggagggagaggccaggattagcagtgataagaaaacaggggcctgttctaattactcaataacacaaatattttcaaaattagaaaatatatttttcttctaattacatgattagtcttttttcttgctattagttttaactattccaacctctcaaatttatgtagaaagtgctttactttacttttaacttatacaaccaaaacccctctattgtcggagcctaaattactattaatagccaatttacatacgatttattatttattattgttactcatattttcctctcaactactgaattattcttcaaatatttgaaattcaaatagtatgttttgatatcgctggagtactttggaaaagggagtataaataaaactttttttttttttgagagagagtctcactcttgtcacccaggctggagtgcaatggcatgatcttggctcactgcaacctctgcctcccaggttcaagcgattttcctgccccagcctccagagtagctgggatcaggcaaccgccaccacccccagctaattttttgtacttttagtagagatggggtttcaccatgttggtcaggctggtctcgaactcctgacctcaggtgatccacccgcgttggcctcccaaagtgttgggataacaggcatgagccactgcacctggccaataaaacttttaaacatctatctatatctataaaatatcataagttacaactgaaatatgtcatgaatctcattctgactgttaatgaggattacataattaataatgattagagagcaacaaagttggcttgaaaaatgaatgccgcccaggggtgactagatccatatgttggttaagtgacttggttccatttatcacccttaaagtgtgtatggttcaaattcctgcctcagcaaattataaattactctaggcatggatgatcaggcaaggctatgaatggttaagatcacaaatattttatctttgaattataatttattattactacctaatattgtttctacagttattttacactttgcgcttagatgactatgtcttgatttctgtccactttcttccttgcttttaatgaacttttttcttaggtttgtgcagaatgctccccaaatactcacaagaaatgcttactgtcctttttttttaaatttcttgtaaaaactgtttattttagtcccatttaaaggtgtgtgtctctttgaaattaaaaaatgatgtactaagattatataatcttctaagagagatacaaacctatccccactgtgagcttttttggaggtaaaggacattattgtcttgttgtccctttatgcttgttgtaatgtcccctttctcccaggtttgctttctgtaataatctgttaaacagtggagtgcctgacatgtgtttgttccttaggcaaacgtgtaaaactcttcaagttcgaatggagaagtagaaagagaaggtttctgctgtgcctgatgacaatttttgatttctccacactcaaaaaagttttggctccatgttggagcactagttgtggcgaatcctagtgttggtcggattctaaggaagggacagaagtttcattgagaagtaaagattcaaaacaactccagaaatgagctcccgtcttggtttaaagcagcaggtgtgtacatggtgctaacaggattaactgtgacctattctttcttgtggttaccattagcatttaagtgcccctgatttcagaggggacaatgaacttggtacagctttagggagtcagagggcaaagaactgcctcagtggtcagtaaagaaaggcattggattattgttattaaaaagtagagagaggcatcattctttaaactgatgtgaggcccgtacactgaataaataattggccacaaagagccattatgttatgtcacctacaatggctctgcagtattgttttccccaaaataggaaatggatactacaaaaatctgggtgtattcttggacttctgttagtgttcaaagtgctattatttggaaataagcatgaaaagtactgagccatcagactttcacttaatctccataaaccaaataaaggctgcattcttacctaatggtccattctttatatatttaaattgccccataattgaatattatttcatacctgcatctaagcattataaataattagatttaagcatttatattttgacacactttggaaattcaagattactgaactatgatggttgttatcagaaaagtccaaaaagaattacatctaggaaactgaaaaaagaaaaaaaaaagcaaaagcacccaacatgttaaacatcgccatctgtgttgccctatccttcagaaaatggattttagtttgaaatttacagaaggggatttttaaaataaaagatttaccacatatagaatgatcatctcttaattctatggaagatgatagggatggagcggagagaatgctccatctccatgtgctgcttctggcatgttctcacaaacttctggtactgcttttgtcctttcacaggttacatcaagtccttttaagtgacagcaacatattcttcattcagacaggtgtgtaaccgccctaagggttcttcttgcccgctgcacaaacaaaatcaattcatagagaccatggcattgcaataaataatttaattgatcagaggccagccatgccacacaggagatgaagctgttactcaaatcaagctctctgataatctgggggctagggtttttcaaagatagtttgagggaagggctaggagtggctagggaatgattgcttgctactgttggttggggatgcagtcatataggtgtgggaaatggtcctcctgtgggctgaattgcttgggaccaggtggagccattggtgtcaggcatgcaaaaaccctgaaaagatatctcaaaagacccatattaggttctacaacagtgatgttatctgtaggagtaattggagaatttgcatccattgtgacatctagaacaatggctggcaattgtttatgtctatgccttagcagaattcaggctcctctatcctcctaccctggtgatctttccttagctttacaaaggcggttgagttttggggaaaggctactattacttaaactataaactgaatgtcttccaaagttagcttggcttaaacccagaaataattaagatcaggttgaatgccaaaggcaagatagggtttggctagattagatcccccccaactgccataattttcttcctgatacagtttttgcaaaggtggtttcagtatctcaaggaaaggttgtccctaagagccatttgtgtttgtaacacaaaccaacaaagaagttaatagaaaatgctctctaggctgcgaaaaggaatttcttccaagtttcatatcttcttcacccctaactccaactatcttaaactcattttttaaagtacaatttttaaagcttctgtagtgagactggtgattcttgaccagattgaaacttataaagtaaagctttctggcagaaaggggataaaaactatcaattcaaattactcttctacaaatgaaagcctagtctaaaaaaatgaacttaatatcaaatttagcaggtaaagtacctttgaattgagttcagaatttcaactgtctgtaaaaatgtatgaactatgctggcatatagaataaatatcttaaaaagcctgctaagatttccttgaggcatttaaaataattgttttcctgacttaaggattttttgaatgtcttcaagagatttctacttattccatatgctgttgactttcaccattatcttaattttgtgtgtgtgattctgcacctgaaacaaacacagtgtgtgtgtgttggggtaccaagagaaggggaagcaaagtcttgtcttaacaaatgttttttaaagtgtcaaaggaatttattagctacttaaaaatcagaaaatgctttgttttgctagcattgaatgtcatccagagagaaacggctgatctgcttctgagtggatgaatgtgcataaatggcaacgcaaacagtcatctacttccatgagtcacatagaatagttcatggcaggcacactgtacagctttcaaagttccaagaaacagcgcaggtccatctgttcaaaagattcatttccagtcaagatcttcatttgcacagcataggaagctgaaagccattgacagatgttgtatatgtggtaggagctcactagttctgcattctgatataatgattaggccttttagaaaatgaagtcttcaaagtggttataccactgaagaatttaggccatcaaaacgacattttatcccatttagaagtagtgtttcttaagaaaggtcatagtagttggaggcaagaagtgagtcagaagctcactgactccaaccaatgtgcttggtagataaaaactcaagtttcaggtatttttttaagtgacttatccagagttctagaaccagcaggtagaaacactggtataaaaccctggtctcctgatttgcagaatgaggctgtcccattcaggcatatctggtattctgtttctttccagaagtctagaaagattatatgccaagtctggagactcacactgatttacacctaaatataatcagttagctacagaaatgctgttgtttgaaattactctttccactcacccaaggctgttaaatttttcaagaatttataaaatagataactgagtatagttcaaggtcctttagtggaaatgttgatcctagctgaagtattaaacatatctcaaagtgttaaaataaatgttcaggccaatctagcaaaagcagttctttggaggtaaaactaagctgtggtatgaaaatacaatggttttcaggtctctaggagtcacctccatcatcatgaaagtaaaatataggcttaattttcacatagatgagtatatttataaaagtgattcatatgtcattgtcttatagtgccttaccttacctgaaagttgtctggtcagcttgctcatgcgtgaatatcccagaccaataggtgtctttcatttcgtaatacctcattgcatgaggtgctttaagatatgacaagtgcattcacatatagttacgaccaatgtaatggcagcttttctcaagcttaaatgagaaaacctgctactgcagagtaatgatgttttaattgcgcatttagcacacaaaaagtgaagcaagagcttatttcatgtatgtgtaagagctacattaaaaaaatacatttgcagtgaagtagcaattatattcaaagaaaggaagagttcattcaaatcagcacttagaatgatgaaggtattctattcccccttttacctttatcgaataagttaaatttattgtaatgttagtttgaaattgtgcctatttgtgatgttattaagcagccatcttaaaaggattgaccatgcactgcatttaatccttctgcctcctcttagaagtattaccacattttcttgtcttccagttgtttaactaaagagtgctcatcagtccaaaaataaatgttcatctaataacatggatattttagtgaaaatttaactttttaaaatgaaattgactgcaatgttcataatgcattttcacttctattgttcataatgcattttcacttctattatataaatattgtttaatagttcctcataacatgattttaatgaacatattggagaaaagaattttttttaaattaagctaatatcatataagatttacattgatgctgtggagatttggcagtgatttcacaaatatgttgtagactagcaaatggaacaactgaaatttaaaaaaatctgggatatagggtagaactcaaagaaaaataatagaggaaccatcaataaagaatagggaaatttgcaaatctgcatttttttggcataataatatcccatttattttttaagtgtagataaactgaagtgccaacttcctaaatatgtatcctttctgcaaagtctgatggtagctggtttattagaaagacaaagagttagaaaaaaatggaattctgtatcagagaagactagtaacatatgtgcagaaacaatcagaggcaaaacctgggaatttaatacattggatggccaaaaatttacacatatctgaataataatagttaatacttctttagcactcattaggttcctcatactgttttaagcatgtaacctattaactcatttacttctcagctcagacaatctatgatgcagatgctaatagtatttctgttttacccagtaaatcatcagcagaactgagcattgaaaacaggcagcctaccttcatggaacatcaaagtcgtgcttcatttttttcttaatttttatttttacaatttttttttttagacagtctcattgtgtcatccaggctggagtgcattggcaagatcatagctcactatagacatgacctcttgggctcaagcaatcctccctgtagcctcctgagtagctgggactagaggtgtgcaccatcacgactggctaatttttaattttttttttttttgtagagtcttgaggggtcttgccatgttgcccgggctggtctcaaactcctggcctcaggcaatcctcctgcttcagccccttaaagcactgggattggctgggcgcggtggctcatgcctgtaaacctagcactttgggaagccgaggtgggcggataacgaggtcgagagattgagaccatcctggctaacatggtgaaactccatttctactaaaaaaaatacaaaaaaattagctgggcgtggtggtgggtgcctgtggtcccagctactcgggaggctgaggcaggagaatggcatgaacccaggaggcagagcttgcagtgagccgagatagcactactgcactccagcctgggtgacagaacgagactccatctcaaaaaaaataaaataaaataaaaataaatagattaattaaagcattgggattacaggcctgaaccaccacacctggccagtgcttcatttttaatatgtgacttttattattaacataacaagattatgaaaagaaataattgcaagatgaatcactataagcaacagaaaattaagtcaatatttttagagaaataagaagtaataccgccctccaataggtatcctatgtatcaccttttgtatcttgtttgagaatttctacttctaccacctactaatatttaaaagccatttaatgggacaagcactttgtctggattatctgatttaatcacaatagcgtattacacacagggaggccaagggtcagctagtttaaataatttattcaaccccatagtgttagaaagtgataaggcaaggatctgaacctgggcagtctgccgaacaaagcctgagctatttgtcgttatgcctctcaccataatatgttacctcctgcggataacctagtcagcaggacttgaacagggggaacaaggaattttaggcttcaatataatgattgtaagaattttaagatttaagaattttataaaaggacagaatagattattgaatttccttccaactttgtaatttaacttgaagattggcagaggaaatttcacaatactcaaacaataaaatggaaactgtataaataattgagttcacctaatttcaaatttaactaataccatatatgtcattaaccaggttttattttctcaatttaaattgttgaacagacttaaagacatgattttagcatgagttgtttagaaatctaatcagggccctataattgttttgttggcctgtgataagtgggtgccttgatcttaaataattactactttttgcttaatgttaccagattagcatcttcatcctggttgattgctaccagggtagcgtcctgcttgtgacagaaaagctattattatttctgcattttatatgtgttcagcagcccagtagtttcacttaccaaactggctggtgtgcagcacacacaaataagatttgcgtaaaaaagaacagctatgtaaaatattgcctttggaaaggcaaatttactgagatagtgattatagcgcatgaagctcaaggcataaccataacaatcatagggccatttctctccctcatgcagtattttatatctattgccctcagaacaagaagatagtgtgcattcatggtagcaaatgctatctcccatcctgtaaaactgattttattgcaacctcctgcttttagttactgaaaacttgccaaaaatcttccttagaaggtataacttagtacttggcctcttccaaaaaatacagtttgaatgaaagagtattatttaagttgtaaaaatatggcaatgcttaatttgatatattaacgattccttatactttttaaaatgttggattgtataaatattgcttaagcaaatcttgcatatcagggtgttccagtttagggtctacaaaaggtaaaatgacatttaaaatatgtttcccccccagcatgccagaatttaaacttgggtcactcatatttatttaaaataagcatacaaatcataaaaggttgatatttttgtttaattttaggtaataatttcatttgcaaatagtatttggaccttgcatagtaaactttttcaactggtgataatgtacctatatttagaatcattttcctatacatttttaaacctttggttttcccatcttgtttagtgcaaaccctgaggttgtcagggagggtgctggtagatatttatacatgttcatccttattttgtgttgaaaaggatgagtcattagttaggctttaattccttcaatgcagttctctaaactttcatgaatgtctgttagtattgttcaaagaaaaactttagccgaattaaattgagcaaagaacaatttgtgaatcatgcagtctcccaagcaagagtaggctcagagactccagcacagacacgttgtggaagatttatagacggaaaaaggaaagtgacatagagaaaacggaagtgaggtatagaaacagccagattggttacagctcagcatctgcctcatttgaacacagtttgaacagttggccacctttgattggccaaaactcggtgattggtgtaagagtgggctacattgtgtttacacctccatttaggttacagtttatgatgtacagagaaacctttaggctgaacttaaaatatgtaaggaggaagctttaggctaaatttaatagtgtgattctttcattctacttttagtggctctcttgttaaagatttatacattcaaaagcaaaaaaatccctcctaaaatccagaccttttatttttatagttggtcagggttgacaaagctaggtgttaaataacattataatacttgatcttcatggcaatactgccattctggcctaaatacagagctcttgatgccgaatcaccatgtgtcctcttggtcaaaatcaaataatcaaaaaaaaaaaatcaagtattagattgtatactttcatctaatattagaaatgatttataccatattcttcatctcatatgctaggatatttttaaaattagtaatccaggaatattgtgtaaaacttaggtgtgagaataggttgctttaattatgctgtaatccatgtgtgtttagacaattacttcttttagtcatgtttaagttttgtttctctagcaattatgttagctgatagaaagatatcatcatgaaaatggatgtttatgatgtttttgaggatatgggttatatccttatttatatgtgtttgtatgtttatgtgtgtgtatatatctatgttttttctctacagaaatggagaaaaaaattgttttagttttataagccttttgtattatacttttaatttagatgtctattttcaaaattatatgagagcaaagttttaatatgtaaatagctgagaggatcatttctcaactttatataaactagtagagtcaaatatttagcttgaaatgaagatataggaatgcatctattatactcactaatagattacttagaacctgagcttgaagtggatcaagaggacgtgtcacttgctatcatagagtcatggcaccacatttatgcagttcatttccgccatgtttctccatttggctacactgagcaacagcagaggctaaaccatttattctctctcaatttcctctctctctctttctctctcaatttcctctctccatcttttacacacacacatatagcttcccctctcttttcttgtcttttcagcattagttttgaaaatatggtccacattcatactcaatttgggagcccttcacagaaattgtatatgatgactcctgaatggcaggcagattgatagttgataattgataatgagatcaatgctatgcctaagatatctcctgctcccagaatctcaaagattcagtaggctcttcatgtgtttccaaccctccatccttggcacaacttcttccatggttctgtgcatgggagtaaaacacttcaaatatgcaggcaaagaactccttccttgggagtgctagcagaccactgagacagaaatgagatgactgtctccatgcatgaaaacacttttttgccttttgtaccatctccctttggtagtataatttgagactagccatagcaaagtctagaactagcttattattttgtttaatatattcattttttacataattgatcagaaaacaatgaaaccaaacagacttttgtaatgtttttcaaaggacaagtaacaatgtcacttaatagaataaaatcaaaattttgacaataattttttaaaatcactttttgttttagccattcctagaaaagaactgttaggtaactctctaaataccctgcctgatattagaatagaattagaaatttattaacacagcagaaatcgagatatttctgctgtgttggtaatctcttctcctctcccctctttctccctctatcctctctctctctcaaaatctcttttcctctcccctccttctccctctctcttcttctccctctccctgtgtgttttcctctgtatctatgcatacgtagatatgtatgtatatatgtatcaggtattctatctgtttattattcttttttcctgtacacaaatggtctttggactttagtaggtgtgaagttagtatgaatgtttttagtgatacttaaaatagcattaatagtatattccaatcaattttatgaaaattttggggcacctttaacatttggtacaacatttttctattccttattgtttctttcctcagatatttttgtcccccataaacagatttttttcaaatataatttttcaaatataatttttcaaatataattgactcaaataaaccctcaatttttaaactatttcaaaaatgaactttatggaaccaatccccaagggctttttgagaatatgatgtgactgtgttgctggggacaaaggtctttcttcactgaggcctagtatgatgtgtttgtgatatttgggttatggctaccaagcctgtgcaaaaaaacaaggattccagaatcactctctgggtgtgagagggatattgttgtcaccagttgggataattctagtcacagttatattcacttggataattgtgcaaatggctttaaaaatattgtgagatgataatgagaaaaaaagtatatttttatatgatggaaatacctgcatctgttagtcctttaaaattaagtaatgcatttgatatagcaaacaccagcattttgagttatctattaatttttaattgtgtttagttttaagattatcggtatgttatgaaatgttgactatattttctccttcctttgtaggtaacccattaacccaggagaaatcaagtgatcctcaaggctgatgacattgaacatgcgcatagaaacttaactcaactcctgaggtgatcttgaagatttttataccacttgaaagaggcgctcaatagtctatttccaagggatttcatggcctcttcttgaaatcaagactttttaaaagtcagacatgaacttgcatgtcatgaagatttcagcagatttgaactgtgttcaacttgtaaattgttaaaagaatttgaagtcactgtctgaggagctggtgaagagttgtttttttcagggtgatgttagagacagtcaccttttgagttattggctccagatgtgactacttttcttgtttctgcaagctgtatcccaagtgcactgtccttctgtcctggatgtgttcctgggtcctatgttcatttgctagtgggactacacatggctttaatgacatttcctttgagaacttttcctctggcatggtgtagactgagacaattttatttatatcctaatcttggagctcagaaagcctacatgttttaacatcttaaagttgcttttgttaaaggaatggaaatatatatccattggtaataatgttggcaagtaatagttatctgaataaatcaatcatataagaatgtatagacaagctgacatatttccctaaggctaacaacaccctgctgaagctctttgtcaaataggtagtagttagaactggattgccattttcattatataatactttgtacctctagagcactctccctttctgtttttttttaagtgagcttttctttaattttttatgtttacttattcccttcacagaaatcagcagtgagcagtcaagttaatgggtagccttcagtttcaaaaaaattgacagggatgcatgtgagtttctgatttcttagcttgaacattattcacttagatttcttccagtattttttaaaaaactgtcctatctcattttaaaagactttcttttgcttgatcccaatgactgtttgaatgcttatatatttgttcaatctgttgatagaaaaaattgttcattttcctcagtctcaaatttataaatatttgcttacagttttcctattcaaacaatttgttaggccaatattttgtgacatttttgtagcgattttaacgtttatggttttggttctacaggaaagtcataaatatttaaaggccttaaacatgtatgtactttttttttctaagttatagaatgtataattttgtactacatttattttgtttcatttgtgatatgaagggagagaagaaagaaaagtgcatagccattctgtaacaatattgtgtaaacctatagtttgaaggaatgcaaggagaaggatttctgtgttttactcattttaggctgttcagaagatgcttcaaaaattgtcctgttagaatttccatcatggaaggtggtatggaagaaggtatggaaatactttgtattctaaaaactcactgacgtggtcagttagacatacgttggtttccaggatagaggcccatatatcctggggagctttggtctattagtttgtgacaatattcaaaggccaaaacactactcagacactttcctgggaagagcaactaaaaatgtaaaattggttaaaaataaaatctgaaaagtatgtatctcacattgaactaaaatccactgtctcataagttcatggaatgaaatggctttctgcctccattttaatcatgcataaaatgaattagatggctttgagtggattttcacaatggctcaagactatatgaaattataaaaaaaaagttgccctggggtttctgcatcaattagaatatcattaatttctttgtaaccaagtgaaaaactatactttttggaaattatgaatttgtcctaggtttgtttgagatttgaaattatacatcatgcttctcattttttaaactatgttctttaaatcaacactggaaactctgtattatatacaagtgtaatacatgcatataatagaaaaaaaacatggaatttcaaatatactaactagattatccccagtagattaatgttgtgactattcagaaaaggtgaataaaattgggatataaaatggactctctttc

SEQ ID NO: 107 - DNA, 75508 bp, Homo sapiens
agtcaacctctggaagtaagtcaactccattctgaaaaagaagagtgtcgcaagaagtgaaagtgattttgaccagaggtcgcttgtctccacctctcccctcctctccagaaaaggatggagcagcaaagcggagggtgtgcgcgtgtctggtggaggcgggtaaagaaatggggtgtctttaaagcaatagcttagcaaatactgggactagagtgcggctcgagtccacttcccaatagtttggcgagagtccgccgggtgagctgcaacccctgttaccaggaagaatctttctgctttcattgctctccctaccgccccccataacacctgaatgggagggtctcaaaggtggtttgagcccggacttgatcccctctcctcaccaccgctaccacccgacgcccagcagtccccgtcacccgccctttctccacctccaaccttgactctgggtacaaacaggtcctcgcacaacctgatgacagaggagcttcattggttagatccaaatcccagcggaagggagggggccaggaggtaggaggacgaacactgctgtgggcggggagcccacttggggtcgggggctgcgaagccggaggaggggcgagagaccccgttcctcatccccggagttacagtcggaacaaacttgccgagtcttgcagcgcaagcgcgcggatacgaaccccagaaccttcagcgcgcgggcacgaaagggtgtggagcggtatacatagctctacatacacattgagcgctgagcgagaaaggagggggcgaggaaggcaggttccgcctcccctggccccgtgcacacacacgcccaccgcggctcgggctggctgagcgcgggcgagtgtgagcgcgagtgtgcgcacgccgcgggagcctctctgccctctcctcgcaccctgctcagggcatctgaagagcctggaaacgtgaacaggcttgaagtatggcatgttgcaaagatggtttctgccaagaaggtacccgcgatcgctctgtccgccggggtcagtttcgccctcctgcgcttcctgtgcctggcggtttggtgagttctctggggtgcgaggaggtgggcaacggaaagtggagaaatggctagctccgggacccctttggccactcgctcctccctgggtggactaggtcttcttatctcagctgtaagagcaggggccgaagccaggcttttctgtgaccgcatagatgcggagagcaccaagggcgcaggatccaagaggcgtgtgggcactgggggtcttgcggcggggcgcgcttttcctgaccatttctgtcttctgcatcccaacccccaacctcctctcctttagcttggggcaagcgactctttccctagaaaacaaacctgtttgcacctgttctctgatggattcttaaaataatctcctccgcccccggttttttttttttcgcttgcagtttaaacgaatccccaggacagaaccaaaaggaggagaaattgtgcacagaaaatttcacccgcatcctggacagtttgctcgatggttatgacaacaggctgcgtcctggatttgggggtatgaacgatttcaaacgcgcaagtgtgtcctgtctgtccctctcttggtcttcctgtctgtctgtctgtgggaatatcattaggtatgcctcacgtgcaaaaataaatctctctctctttctatctctcctctcttggtgagacctatgacaagaagaccgcctccacccgtactttcccatctccctgccccctcagaagctttgcctctcccccacactaattacctcccgggacctgactgctgggtgggggaggttggagaggaagagtcaaaaatgggaactctgggctcagctgcctggacgctcttcgctgagaatagtttccctgaacctggccacttcgctcagagcaggttgcattggaggcagctgaaccgaagtccctcatcctcccacgtgtccatgcctatgccaaaaccttggccaatgttctacctgggacataaatctggggcatgaagctgcctgctctgctagagaacccagtcctttccttttctcttctacagcaggatgcttttcttttttccctttcttttttggtgatgtgtcatttgctttcctcctaagactttaaagttagagatgttccagcttgctttcttcaacaaaataagtataaaggacttaatagaggtacatccattaacagcactgttgctgtttttcatattcatatttcctttgcatatataatggaaatctatgtggcaagctttgcgctaggtactaggtccacagaaatattaagatacaattcttaacctcaaacagcttctcagtccagttcaacgaggacaaatgacttgctagggtcccattcataggtttggcccaggtcctttgatctcaaagtccctgttttttacagtacactgcactaattacccttcagcaactgagttgaacaggatagagattctgccttaaaggagcttacattcaagtggtaacaataataacagccagtaatattgtatttatttaattaaatgttcacatataccaggcattttgtaggcatcaccactctgtttaaccctcacaacaaagctttgaaagccattaccatccccactttacagataaggaaattgagtccaagttccaagttagtaagtaggaggagaaggatgtaaacccagagcaggctgtgtatttaaaagacaaagccgtgcagatggggatggtatcagatgctgtgtgatgagtatcatctaatattagaagcatggagcaactttatacctcctattgagggtgtgtaggagatgacatgttgggagaatggagaaagtaagaatggggagcaggactgcctgtgatgtgaagtaggagtatggcctggggctagaaactctttctagccttcacttgaaatgtcaagtttaaaacctttatgggcagataaagtagagttgggtgtttctttggcatctggtctcatttaacagatggggacactgaggtttagaaagggaaagtgatgtatataagggcacatagtacatcaatgataggatgagatcaggtcttctgaattccaaaccattattttcttggattttatgagaaggttatgggaagtcattgagggtattgattcagcatttgtatatttctttttttttctttgagatggagtctcgctctgtcactcaggctggagtgcaatggcgtgatctcggctcactgcaacccctggctcccaggttcaagtgattctcctgcctcagcccccagagtagctgggattacaggtgcaagccaccacacctggctaatttttttaaatatattttttggtagagatggggtttcaccatgttggccaggctggtctcgaactcctgacctcaagtgatccacccttcttggcctcccaaagtgctgggattataggcgtgagccgcgccgggccagcatttgtatattgactgataaggatagatgagaaggatgaaactttctcctgcttcttttcatgttgcctctccagggataggttgcctacactgcatttgccttcatgcaaatctgaaaaggggtgaatcatttgtcaatgcatgatcttccattttagatcaaaaatagtgttgtggagaatcgttcagatgatgtgataccatttaaggcaatattatatcaataaaagaggatttatctgcccataaatgttttaaacttgacatttcaagtgaagaaaaaaaataagaaaagtatccagtcctatgtagtttaaatattcatcagaaaattgatataccaaaacataaatcaaagtgaaaagttagaactgaaactatattgtttgattataaatgttgaaagttaaaataagatgtgcccagctggctataatgcaagctgtaattcaaaaggaagaagggatccattgtatatggatcctttttaccatctactctctcccattgcataatattgacaataacataagtgaaaacaatatatgtgagccattactgggttttggttaatcgtaattctattaaacgtctcaaggacattattagtcatctaatttgtcactgccaaatgatctgcattacccacctgaaaacatttttatagttttatgggaaagggtcgaattaacattactcccagcattaccaattgattaaccatttaaacatttactaaatagcataatatgggttttgtttgtttgtttgtttgtttcttggctttgctgataaatgtttgtggtaaatgtgattcactttttagaagtgggtcattctctgtaaatgtgtagtattccaaatgtgacagagaaatagtgattctcacctgcagaaaatgtgttttctgtttatatgaagttgtaaatgtgtaccactgaaaacaatgagaaacttcatcattagcacagactcttagataccacaaatcagatgccttctatagtattggatactctgtggaaagtttggtattttaaaaataaaatgaaaacaatccagattttgactagtaggctataaatatggatttacttcctggttcctataatcctgcttctgctcttcgtggggcatttactttatatctgtttatacaactttgctgtgttccatttcaaacaaagctaaaagcaaagatttgaattgaaattggatggtttgtgattgctcagtaggccaggcaggggttgaaatagatttggaaactaaattacatatttttaactcagcagcacagcttgcgatagggaaataaaaggaactgaaatggtttcctttttttacatccctccaggatctcctctcccttgtctcctacattctcccattggagaagaaaaggggaaaaggcgagaagagagggaaggagtcatggtgacagaagctggtttccgacttctgagaggatgtagtcctctcaacctctaataaatcagttgctatcatcctgaagtagcttgcacctgtctagacatagcacacaagtgaagccttccacaaaggagccagaaaataatcccctagctctcgttcactttcaacactgtaacactgttacataatttctcaaaaatgcattgctaaggtatttactaactaccaggaaatggtttaggaaacctgccgtcactcattttccgtttattgaagggttgcacagcctttcacgcatctcaatcttttgaggcatatgatctagaataataaacgttccaaatacagatcactgcctttgaatcatcttccacaacctctctgaaatgggaatgaagcatttgagtcaattttgtaaggttattcactaacatagtaggacttcacattagtggacttcgcattatttactaagattattacgacaacacaaagagataaggcagacatcatcattctgttagaaaagaggctgagaaaatttccaatgaattgaccatcaattttatagctactccttggtgaagtcacaacacacaccctcatctttaaaaccttagtcaggcagctggtttattgctatatccacttccgaggcactctttcattgccctgtttatcaagagtcaaatttcctcaacataccttcttgctactaagttaagtaggaccttaaaataagcaaaactacatttcctctaaagaagtgagataagaacttttgttctaaagctttaacaactttcaaatagtaaagaaaacacagaaaattgtatgcatttgggttaagttggaatattttccccacaaaaatcaaattgtgtttgcagtgttttcaaatgatctatgtttctccacttaaaagttaatgtgtcatgtgctagccttattaattaaatgtcaatagagaaatacctttaaaaatacatagacaaaaagagcacttctcagcaacataaagcttcattctcttccaatttgtcccattctttcattcattcatttgtgaaacctatctgtattgagagaccactgtatgtcaggaaaaatgtaaggttgtgaagatatcattctgatctgatacgagccctcacagactttatagctaagcattatagagagatgaatataacaaagaaataataaaataattacatgaaaatgctatgagataatctaatatcatgctaaaagggaaaaaaaatgggtgagggatctatttcagatttggtgttcctggaagtcttttaagctaagacttaaaggtgtcagacatgaaaagagtaagagaaaagtaattctcagagagaacaaagcaattaagtgcaaaggtctgaaggtagataataggttagtgtgatgtagatggtgagaggagtccagtgtgcctgtagccagaatgcaagaagaagaatctcatgggatttggttgggatattaaatagaggccaggtctcatagggtctctggggaccctgtaaaagagcataacttattctcttagtgaacctggaagcaattggagttttctaaatggagggaatgacatggtttgagttagagtgaaaaatgctccatcttgtctgcataaaggaagacttagaaaaggaagtagggcaatttggaagcagggagaccaatgaagcttttgttacttcagctttagttctcttaagttgatggttgcttggaataaggtggcagatatagtaaagatggatatatgtaagttgattaaagtgagtttttggaggtttaattcaacaaagaattggcgattgacttgatatggatgttaaaaaaaaagagagagaagtaaaaaatgacttttcaatttctattttgagaaattgggcaaggttggtgttatttaaagctggggaggactgcacgatttcctgccctcataagttcacactgtggaagagatagaaaataagtaacagaaataagtaaaatatagtgtgtgtgccagatgttggttaacagctatagagtaatgtaaagcaggggagagggttgcaattttaagtagaataattagtggagacttcactaagaaggtgctgtttgaatactggtcgtaattcagtaaaagcataaaccacatttgggatggagtcttctaatgaatgagaaggaattctaagtgcaaacatgtaaagtggggaagtcagggtccctgtagtgaagtttagcagggctgaggcataaaaggggatcagtgtggtaagaggacaaggttgtgtacagctttgcaggctgattaggactgtgcttttactctgagtcagatcaaaagtgactggaaagattttagcagggacaagtcctgaactaattttaaaaggctctccttgtgttcagaacaggcagtcagaggcaagggcagatgcagcaaggttttccataataaaccaggcaagaaatgatggatactttgaccaagctggtagcagagaagtttgtaaatttataagaaatggttggcttctggatattttgaaattaaagtcaactgacgacagctagaacgtgggatgtgagagaaagggaggtgtcaaagctgattccaaagtttttgatttgaacacctagaaaaatggagttgtcaagactgtgccagaagtagaccaggggcatagatgagcaatttgtatgcaggtatggtacctttgggatgtctattgcatatcaggtggagatgaacctgaaattcagggatcatgagtatgtcaatatacatgatatttaaagctagaaatctaaaaagattacaggggattaagtttgatagggaagaggtacaaatattgagttttgatgtctccaatgttaggaggtggctccagagaggagaggaggaatctttgtcccaagaagacttaaaaggagtggtttgtgaagtagcaggaaaaccaagggagtgtgtataaaactaaagtaaaatataaggggaaaaataaagaaagaaaaaataaagaaaggaggaggggttgatttagtcaaatgctcctgacagatgaagtaagataagaacttaaaattgaccactgttttgactgttttgatggagcagttttggtggtgtgatgggtgtgaaagtctgattgagtgcattcgagagagaatggaataagatttttctgggcatttgtacatggaagcagagaaattgcgatggtagaaggaaggaggtagaaaaatgctaggaaaaaaatacttttaaagttggtgggaacaatgctgtatataaggaaaaactcatggtactgacaaaaggaagtggaccctaggcatgaaaaacaagttattgagatagatgatggagtgaataagaagaatcagaggtaccgttgatagatttttttcagaagttcaaatataatatagaagagaaagagaaaagtttgcctttcttttttcaagattagaccataacatgtttttctttctttctttcttttttcttctactgggataatctagtacaggatatttaacattagattggtgggaaggcatagctgaaagaaatacgtcttttagaaaacaagagaagtttgaattcagagtgcaactttactatcttatgttcttggtttaaaaaaaaagatatacaatatactggtgctataatatatttacattttcattagggttaggatgtatccattgcatttggtgtttcctgaaatagacattgtaaaatctagattatgggatattagaaaattggtggatatttgggtaatacttcactgagttgttagatttcttttagatgagaaaatacatctgattgcatttgtatatatcattaaacatcaccgccttatactctaagcctttcttatatatttattctataagccacagttacacagaattgaaacctgaattaataattcctggtatatgacacattttcattattggcccatatgtagccttctttttatacgtcttttcatctattcaatcatttattaaaatataataaacataccagttaaaccaccaaccagcacaaagtgtaggacttggacaactcttattctgctatgtggtctcctccatcctatcttcctgtcttctccgtccaaaataaccatgattttaagtccttttaaaattatttcttagttttcctttgaatgtcattttaggttgactgtctttattttaaaagtttattttaaatatttaattgttttgaacttgctatatataatctttcgatgcttttaacttaattatatattgctaaaaatcattcttattgttgcatattgcaatagatcattcattttgactgctgtgtgatattcccattgcatagaaaccagcttattcatctgctctgttggcagtaggctttttgcttgtttccaagattgtggtgctgtgaatatcctggcccaaatttcctgctgtaaatgtgcaagagtttcttttgcatatatatcaagaaatggattttctggatcttagtgtaagtgggagttgacaagataatgccaaactatttttcatgatgagtttacaaaatcaacttccatttacagtttacaatgaacatgacattcaggatccagataccctctttaacacaagatatatatatcttgaaatggtatttcttaaaatggcattttattgtgaaatgatttgaatttttctgattctcactatgttttaacgtggttgaatatcttttccaatctttattggctacgataattttctttccgtgaattacttgtttttattgtttgcccatattttatttttatttttgttgttgttcatgcttttcttatttatttgatggctgtaattatttacaaagtagaccaggattgatggattatatgacatgggaggcactaatctttaatgacttctaaatgaaagaaacttccagaactttatagtgttttctgctttctcagtgatatcaatgggtatctcttgtctgtgtttagtattcaggaaggcttgtatttgtatattttgtaaatgacaagcaaagagatttattaatgtatttcagttaggattccttgttgtatcccttcaagtgtcttcatttttggagatatgtaactagtattttgtaagatgatggtggatgcatggataaggtggctggaaaattagaaatgtttcctcaagtgcatggctggggaggcaatatggaaaatgaggatggactagtttcaagatcagcaaaacaccctaggttttctcatgatgtggcagcaaattagacatcattattggagatgaaatttcaaaaatgattccaccctttaaccatatctgtactgctaaagttaagtaaactgggaaattatctgattcatcgttaattgccttccctctttcccagcaagttagactcattaattagatgggaatatttccctgaatttgatcttgctggtcttggctctttctttcccaaaaactgttgaatcatcttgtttaccttacagactgtcaaccattaggtattaaaaaatatattcctactaccaacaaagtagaattttaaaataaaagatgtctttaatgttgcacaaatgcatatcaaattatgggaagaaatccttccaagctcaaaattatctggtttccatgtaattatactctgagtaagtttgatttgaacatcctaaactgtcgtattagaggaagtgtctctaagaattattcttaattacatagtgaccattattcattgacaactgatttatcagaagcctattacatttaaaacctgtgattggtcctgccagaggatacaaatacaaataagacagtttcttaaaatggggaatatttttagtttaactgctgtggaaagtaattctgttaatttttccttttgatgggtttttaaatcactactgggatgatattaggaacatgatgaaacacagttattcaacgcctaatatgtgcaaggcattgtgctagtttgggacttcaaaaaggattaagattttgcctttgctgttacagatagaaagacccaagcagtatgctgtaataagaataatagtaaaggcatgaaaagcgctttgagaaaatacttcagaaactaatgaacaaagcagggaatgtaggtatagcatgttatattctagatatgaaattccacatttgcttaagtaattaataatttattattggtgatataatgtagtatagtaaagctagcacatgctttggagatcaatacaagggggttagaattctggctctgtcatacattatttaatctctgtgaactcagtttccagatccataacattctcatgaggatagcgcctttggagggtgtcgtgaggattacatgaaatagtatatgggaagaacctaatagcctacctggcacataattcatcttcaataaatagtaattattgtatcttcgcttattgttctttggaaaataccgacaccctgtgagcataccagcccctcaatctgtccagtcttcatccccactgccacatccctagtccaagctgttatcaccaactctcgacttgaacaacatggcagtctcttagaagagcccttcttctacttttgcttccctgtaatgtattgtcaataccattgtcagaataattttgtaaaaaatataatctaatcatataaactcccttacttcaaaccctcagtggcctcccaatgactatgggatacaaatcaaacttcttaccacgacctataagtaaagacagagaaagactgaatatcagaagaagaaagctccaggaaagaacataggaaaaacgataaattttgggttctctaaggctgctataaacaaagtaccacagactgtgtggcttaaacaataggaaattaatttttcacagttctggggataccaaagtgtaggcaaaattggtttcttctaagtcctctctccttggcttatagatggccatcttctctccatgttcacattgtctctgctatgtgtgtgtgtgtgtgtctgtgtcctaatctacacttctgatatggtcacagtgatattagattagggcccgccctagtgaactcattttaacttaagtatctctttaaaaattctatctccaaatatggtcacattctgaagtaccaagaattaggacttcatcataggaatttggagggaatacagtttagctcataacaatactctatgtagctctccatcttttactgatatatctacaacttattttccttgtagttttaactacagtcaccatagcatatattataagtatgttgcttaaaagatgccactttttagaatacgagttcaggggtaggtgttctatccactgtactctggtttttattctatcattgtggcttttatttctcagcattctgtccctcccttgctttgcttcagccccactggcctcctttctagtccctgaatacactcagcccttttccggtctttgatcttgtcctcttggagttctttctgcctggaatccaatttcctgatctcttgcaatggctcatgctcattctccaagtttgagtttaaaagtcactgctttgaagaagcagctatgactgcaaatcaggaatgaccctcccagtctctcactcttaccatcctgtatttttcctcttagaaatgatagcattctgtcatttagtttatctttttactactgtatttatactctgactgccctaatggcaccttagctctttgagtcagggaattcctgagtcttgtttaccaatgtagcatcagagcctagcagggaacccaacacacaactggcactcattcagtaaacactaattgaatgaatgtctgaaggaaatccctttacaatcaaatgttttttaggatcttactcagtctcaaagatccataggaccatataaggcaaatactgaataatgaatgtcacaaatgctaaggttataattttgaacacaaaacattattcaagaatcattgagaaagtagcatgttatgcaagaattggaaaatgttcattattatcatggaatcattgtaactatagaactataagaattagcatacgcccacacactttaaaataaatgtataaagaaaaatatcattggcctaattcttttctcttctagactcctcactcccctgaaatacgtatgatattaatattttatagcacatggtgttgtaaatactatcctagaaaacagatgaacactgtaaaatagagtaaagtgaacagcctcagctaggaacttgttagaaatgcaaattgtgaggccgcaccttatgcctagtactaaatcagcgtatcagggtgtggagttcaacaatctgttttaacagacatatcagaaccacttccctaaaccaatcatcaaagtaacttttgatttctcaagaatcttgccaaatagtctagttgtcaggacataaccaaccttaattattcgagtaacttatcaccacttgccctgacttgcaatggcatagtgtttctgctttttaatactctggcaattgtccttaagaaactaacacagtgatttgtttcactgttgaacctacttgagtgaaattgctatcttctagggttcagcacacattacctgcttcctggattacctagctattcctggaacaatttgacattaatgagcttattactatcatgttttgctgttgttgtctccaatttttcattcaaataaaaatttaattaacttttctgctttccatagatgtagtcttgaaaacattaaatctcatgttagctaagcctgattcagactttttctcttactatactgcctaaggctctatttttcttaggatacttattcagtaaagaattttctcattctccctcgagctatctttctttgtgtggatcaatcttcattctttagaagaagaaatattcagattcatttttatgaagataactttggagctaaggaattaagtgataccaatttctctctgccttttttttttttttttggcataaatcgcatttcccaagcaagaatccaagtgagagattatttcatcttcatagcagatgtcattcttcccagttacggaatatctagcctctggctatacagtactataaaccattgtttaaggaagttatgttcaagggcaacaatttttatatttttgttgtattagaatgctgtattatgcatagtaatgactactgtcattattgagcacattatgttctagagactgggacaaatgacttacaagtattatctcaattaatactcattaatatctttacctatgaggatatgtgacttgaagatgatattactagaagatgttagaaccaaatttgaactccaaactttctgattttaagcttcatgctaaactcagattgtgttaaacccagattgtgttcccttgtctaaaatctgtgtcagccatattgtcattatgctcccacatttctcttctgccaaaacaccagtgtgcttctttacgaactagtcttatttagatacgggaaacagtctcagtagtggccactgtcagaagcaaagggaacctcacatggaatgagtactttcatgagagagtcgttttgctgagcatcttatttcagcaatttcatttgatcgctatcaaaatcttgcctgatggttgtggtggctactattgaggagttaaataacttgcacaagattgtacagctagtaggtggcagagtgtaagtatctgtcacttgtaagaaagtttgtctttgatcccaatcagcagtggatggtgtgcttgttgataaaggtgacatgaatcatttttaaaattatttactagtatcctcagctctccaaggatacattccttacagctgttatggtttttctcttctttgttgctgtggccacacttcccctttttaacagctcacttctttattagaggccaatcagatgatggactataaaatatcgcaaaggttaaaagcttttgtgtctctgcattgcctgttgtaacagtacccaggggtgacgtatctttgaagaaacaaggttcctggtaagtaattggggtttctttttgcctgtaagtaaacactgctttctggtcttgttgcgctttggtctacatttgttttgtagagattcattatctcactgaaaatgtaagatgcttgtaaaaacatgatatatcatatctgtatttactctgtaattatctaaccttcccagcctgtaaaattggtaattattttttcacacttatttacttcatacccgttaggtcctgttacagaagtgaaaactgacatatatgtcaccagctttggacctgtttctgatgttgaaatggtaggtattttcgaagtttaatgtaccttttgagacttgaagaaaacatgtagaaaagagggcaattaatatttattttgttgtcaatcacacaaagccagaaacctaaagaatccctaattaaacttaagaatgtatgaagagtaagacattgaatctcattcaatttgcatttcagttgtaacatttgagtacttgttgatttagggtcattctaaacaaagagaagaactttcctattactggttcctatagcacaacctagggtgcagcttttttgctttcctttttacttttcttttctttctttctttttcttttttttttttttttttttttttttgagatgaagttttgctcttgttgcccaggctggagtacaatggcgggatctttgctcactgcaacctccatctcccaggttcaagtgattctcttgcctcaacctcccaagtagctgggaatgcaggcatgccccaccgtgcctggctaattttgtgtttctagtagagatagggtgtctccatgttggtcaggctggtctcgaactcctgacctcaggtgatcctctcaccttagtctcccaaattgctgggattacaggcatgagccaccgtgcccggctgttttttctttaggaaactattgaggaggagaaaattagaggtgataattagtttcagtatgaactagtcgtgtacactattttatagttttcattatatttagtatttcatgttgatctaattgcttgctgcccatcccagcccttctgcctccttctcactcatgtttaagagcttagaatacgaagcactggtcaggaagaattcatccatacagttgtgctctcttatattaaatatatttagtttgcaagacaaaaaacttactttagtttattcattgatttaaagctcctagtaatttgaaacccttgagttatttgactcattttaataaactttgtgaaaataaaatatctcttacacatattattttgtctttaaaatgcctacaattacacgattaattgtgcatgatattttttacactttaactgatttttgctatctagtctaaagtaaaacacaattgtaactacctggtactggcagttttcttaaattatagcaaatttattattaaattattagtatgtgtggtaatttatttatcttatgaatgtagaagatgaaggtatcaagatggataaaagttattctaattgctgagaatctttttgctccattgattcaagatcattcctgctcctattaattttatttggagtggtatttttttatgagcatgaaggaagacagaatttaatgcattattttcacatacttatgtgtagtcatttgcaacttaaatatgttccaaaataattgtcctaggaatacacaatggatgtgttcttcaggcagacatggattgacaaaagattaaaatatgacggccccattgaaattttgagattgaacaatatgatggtaacgaaagtgtggacccctgatactttcttcaggaatggaaagaaatctgtctcacataatatgacagctccaaataagctttttagaattatgagaaatggtactattttatacacaatgaggtaatatttttttttacttcttcccttccttttttattcttttctttctttcctttcctttcttccttccttccttccttcctccctcccttcctccctcccttcctccctcccttcctccctcccttcctccttcccttccttccttccttttcttccctcccttcttccttcctccttccctcccttccttcctattttagaatctaaagtcacaattattctttaaaagggttgattttatttaattgcatttttcatcatagactcaccataagtgcggagtgtcccatgagattggtggattttcccatggatggtcatgcatgccctttgaaattcgggagttgtaagttataataaaaattttgctagaatttatgattacctcatgcaagctaatatttacacatgtattttatttttcataatccaacatttaagtcatggtccataacaaaaactgtccggttttatttctggagatttcattaactaatattttataataaagaaataaaaacaacctcctttccccacaacaaacaaaaacctatttatacagataatctaagtagtcttagtcacaattggctggtgatcagtggtgaaatttagggacctctgaactctacatgttggtagtgttacacagaaagtacaaattatatagataaatatatatataattgatataattataacacatatcacttcagatagatagatagatacatagatagatatatagatattctattgtaagcagtccttcatagctaacttggaagaagtccataaaaggttcagagcttcctgacacagtataggttaaaatgacagaagcagcactgttagcataacagtgactgaagcatggcaaaagcatggtaggggtgtggtctgagttaatataatgccttatacagcacattaaggagtttggattctatctaaaagctatgggaagcctttggaaggtttgacaaaacagtgtagctttctttgacattttacagttccacttccgcttttttttttttttttttttttttgagaatgggtggtagagaggctggagtggaagcagcagagaagaaatggaggctgttgttttagtacaagcaaagatggcagtggcttagactaggatggtactagagaggaaagtgtgaaatagatatgtttgggaaattttgtagaaatgaaggcaacaggatgagatgaatggatagaaaacaatatgagattccttcccttaagctcccttctctgagatggcagcaaaatgtgattgccttttctaaggtctgcctcacattttcaattcaatcagaatctactaaaaatagatgctggcttttactattgcttcagattcttagtcgcactgattgtgaaactgttgcctgctgttatcatcgctcattgcttaacttaatgagaatcggcagtcactattctttttataacccctagtaatcacaatattcagtgggctaacttgaagccagagagtattatgttctcttaccaataatttaatgagagaagataaaggcagaaaaatacatagacagggtgatctcattggggccagaattaaaatccatttgtgctgtaatcattcaaattttacccaaattagttctcatgtagaggaagtccttttcactccccgcatcccaacctctagttctcagaaaaagctctcttcagaaggacttgaacatagttcgtgttcaatcagggtttgtataaaataaagaaattgcacattggaagctgatgtttttggattgggaattaaaaagagaggcacaccatactcagcaggtaaggatttttaattaatctggaaagaggaagaaaacacaaaacactatttaaaacccccatgcttacaattcagaggaattagaaaaaccaggaaagaaaaaggttattctagcaaggtagggtagccaaaggaaggatacttaatttgcaatatcatagacaagaacatagtatacagaggctgtaacagtttactgaagtgtgaatatatttctggaaataaatgctgacacataatataactgaatggtgctaaaatgacaacacaagcctcatagtttgtttcataaggtgctcttaggtgtcaactccttttgaagaattaaatgattccattgaggacctactatgctatagccattttaggatggtttggagggaggttggcacacaattcattttggttcttttgaacttacttgtgtgtgagccaagctgtctgttatgggtagactggtaagcaagcagctgttctccatttgcacagagtgccaaataatagaaaatgggcttaaattgccaccgggagagatttgttgaagatgtaaggggaaatgtcctgattgtaagaaattaaaggtagtggaattggttgtgtaattatattccctggacagctttacaaacaacatagccagttgtcactgtacaatggtccccaaacacagtggatattgcccagaggcagagtttggaacaggtgaccccaggggagctctcctaacagtaggatttgtttggttttgttattgtattattacaggcagcatttctaaatagcagaactgtgttaggatggtattggtcaagcattggaagtgagttagaagtacggctttgggagttcaatatatctgcttttgaactgtttatcctactggcatggacacacatccaagtgtattcatgcatatgtagcattttagatgcttcagttttaatatctcctcctcctttatttggcataaaaaataaatactgttgagttgcaggggtatttacttagtctctagttttctaaatcttaaagatgtttgactaaattatagtgaactaaattatagtgactaaattatagtgaacattgttttcatttattccatctttcttgaacaagtactgtttttaagtgttgaccactgatgtggatgaaaaaggagcattgactctaaccacattctgtgctctcttttagatgcctatccaaagagtgagatgatctatacctggacaaaaggtcctgagaaatcagttgaagttccgaaggagtcttccagcttagttcaatatgatttgattgggcaaaccgtatcaagtgaaaccatcaaatcaattacgggtgagatgtgtaatgattaaagccgacatgctacttggtgttagcaataaagttttctcctgactttttcattgaaatagttaattttttcaggagaacaacaaacattttccagaaatagagttgatgcatgagttatagctcataatttctttatatttataatcttactttagtttaaaataaattctgatttagtaagatgctaaaagtgagttggttttcttattcagaaatgaaagccagtaatcaaatatgttaaaattattttcacaaaattatgtggtaggaagtctgatcttgttttttgtctttgctttgtttctgctttcggtttttgatgatttttgtggggctttccaaaaattttcctttatcttgcccaattttgtggtgccactttctctcattttctgaaagtaaacaaaaatctaaaacttaattacaaagtatattatgggtatacattaaggttatcacatgagtaggggggatgtttattatttatgattcttggtctctcttttcttttggaatgtgaataggaagaattatagaatttagtttttaatcatatttagtggaaaaattagctgattattgcttgttctaagactgttccttacatacacatatcaccagaaaaaatattttttatgatagttaacttagtttgtttgggccattgtaacaaaacaacacaaatagggcggctcataaacaacagaaatttacttctcacagttcaggaggctgacaagtctaagatgaggtgcagtcagattcagtgttcaatgaggacccatttcttcgttcacagaatagtaccttctatgaataagtcctcacatggggaccccaaaggtgtagggagtgggtgctcacactggggcctcttttataaaggcactaattctattcataaaggctccaccatcatggtttaaacaccccaaagccaacctcctattattacattggctattatgtttcaacatctgaactttgaggaccacaaacatttagaccatagcaatagttaaactttattcagcaatcaccatctgatgggcacccttctaaattatttccatgtatttttttctcataaccatcccatgaagtggatactactataacatttattttatacacgagaaaggtttaagtacaatgtatttgcctaagtcatacagctaataactggcaaaacccaaattcacatctaagtgttatgacttctgagtttgtgttcttaaaaggtgttgactgcgagataaaatgctaagactgcattagtagaaaatgagtagttttaagatctggagcaaagatgtgaggtaacaaagtttttttttgtttttgttttaagaaaaaatggataaagcagtgttgtgaagggatgatgaatctaaaatagtcaaactgaaaggcagtgagaggaatggtggtagtcaggggcctccgggaggaggaaacagcgaggtattagtcaaagggcatagtatttctgttctgtaaggtgaataaatcctagatatccaccgcatagcagagtgcatatagtgaacagtactgtattgtctacttaaaaatttgctgagagaataggtctcaaatgttcttatcacagaagataataaataagaaggagggaacttttgggggtgatgtatatatttgtggcatagattgtggtgatagattaatgagtgtatacttatctccaaactcatcaagctgtatatattaaatatgtacagctttttgtatgtcaatcatacctcaaaaaattggttaaaaattaaacataaataagataaaatagaaatttattatggataaataaaattaatacataagtctttgtttttaaaaaggaatttagcccactgtctcttctattaaaactgctttgtataagtcacacactgtctttgtcataaaatcaatggcactgctcctctctcctaaatttccattacttttatctttatgacacctgtcatgactattatcattttgaggaaaccttcttcacatcaattatgaaacaatacagtagctttctaaagggcaccttgcctctcatctgtccaggaaaatttatttttggaagggcatttattttccagtctgcaaatgggatttagaacacatctggtaggatgtgaggtttctgaatgctggcctcatggtttgtgaataaggccactgcttcctagataactttcttcacatattcttttcagaggtaacagtaaaaacacttatcaacagctaccagaaatcttatggtttattgtacttattagtttttcaggtttttgtctaaatgccagtaaaacatgcttgaactcaggggtgttatatatgcctgtatgttatacacgtctatatttttcttcatataaagaacatttagaaattcacctctttcctaaaactatggtagcctctctctaagcttgtgactgtgtatgaaatctatatatgaatgaaatttaaatatatttatatataaatatgtatatttattactttctaaaattaaactttatattttcataaatgtgtgtgtatgtgtcagtgtctgtgtatgtgtaactgtgtgcatttctatttttttctagtggtttttcatagaagataggtctaaatgctgtttctaaaaaacgctgaaaatgaaagctaattgccttagcaatattagaccatcaaaatagaaagcactacagaacatttttaaaagttttagcccaatttgttaaattgcttaatcattacacggaacaaagagtttttctgtataataacgttcaatatcattttctccctcgttaggaaactacatacttattgatgtttgtgtagctatgcacaaaagagaatttctttccttagaatcctgtttgttagtctgaaatatgtttatgaagccattgactaattgcctgcagaaccgataacacattttcctcctgttttcttggcaggtgaatatattgttatgacggtttacttccacctcagacggaagatgggttattttatgattcagacctatattccgtgcattatgacagtgattctttctcaagtttcattttggataaataaagaatcagttcccgctaggactgtatttggtaattgcaattcatttcttgggcgtttttgttcacattacattttattcatgattcatgggatatttctaagaaaatcttaaaccctaatacatcaggctatcctgaataaggaatcacatggctttcatttttatctagccagtacaaagtaataaagcttggggagatttgggcatccttcctttcctctggggccaggcatcagatttcccttgttgagaaccagacaggcatagaccaaatgtgaatctggacataatctcactttcagtgatattcttgggctcctagtataatgctgtgtaattgaattaaaattatatctccatgttaaaaagaaatgcactggcagcttaaaataaaacaaataaaagtcatggctgaatgaatatgaaagccttagaataatttagcttttaatgaagaggaacaaaatgcaaacggtttaaatgcattgaattggaaggtattatatgcttagtttataagctcatatatttacttacttcttttttttctaaacattggtttttctttttgtttttatagtggcttcatatatactgtatagtattctgaacaatataaagttcagagcatatgagtttacaatttttataagttaatgtgttctacatgtcagtcatgcttttaaatagtataatttgttataattatatttattttagttaatgtctttctctattctttttctgttcattgtgagtaacaaaagcattcagtagtagaataagaaggaaaatgatcagaattgctctggaatggtggtgtattcctcacaagagtgccaattcctctttgattttctacctagtaggatcacagccatggtataatatcctttatcacacaatagctgaagagatgctggtgcgaaggaactaaatagaacgggaacttttcatcctacctccccatccttttcaagaactattgattagggtgtcttagtgtcctcaatggatctgaaatactctaaagacaactatcctccctttaatcttaggtttctctaagaaggtgttggagtatgaggatgcattaaaaaaatagaaagaaaaagtactggaagtatactggagaaactcatatgggggggcaatggtggagggagggtgtgatcttaggaaagcagtgaggaggtataatggtaccttaaagagttataagggttcaattaaagaataactgcacaactcaaagtgttgaataaattttagctcttaaatataagtttgaaagcagaagagagaaaaaaacaaatctaagctgtaggtgtcagcaagtctaggtttaaacccaaatctgccacttattttctccattcataaaattatgataatacatctcaccctcatagactagtgaggatttaaaaagttatgtatcgttctcaatatagggtatctggaccacttagttcgtattaattactttctccaatacttctcttatctaaggaagatagattttgttcagacttagtttccttgacttttaagtgttttaaagaaagcataactttctagtgttgtactattggatgctctgctaacttcttgatgttcattatctcatttaacactcaagctaattttgtgtctttacacatcatcttttgaagcactctgactaggcaagaagtatctactgaaactgagcatccaaagtctcttaacttttttcttgtacaaaaaaatacaaatatttctggagctaccctcattaaaaatttaaaggaaaacccagaagtttctattatattttacgcataaaaaaactcatgtatacatttttttaaatgatcctaaagagtgtgtagaacagcaattaacgatccatcataggtgcctgtaatcaagaggtgatagtgtcataagtgcagaatgtggaggcagaaagcctaccttctaaccaagggactatcacttattagctgtggaccttcaataagttacatttgccagcttcctcatgtgttaaaacaggatgaatgattgcacttacctcacaggactgctgtaaggattaaatgagttgatttagaaaagcacttgaaataatgcctcacacatagtaaatatgatttaagtgttatttattagtatggcattccatgctgctgtctacttcatttgagaattattacttgataggttaatgtgactgtctgccatatattattattattgtgatgacttgataaccttttatttatttcttgattgattacaacatgacaggtactgttcatctcacttgtcccaaaataatagaaatttccagtggtgtggggaaggctagtattgattacagctgtactcacccaacatttcctatccaaacaagatattttaagaaaacgaagtagcaggaagtaaggatattagtattactagtaccaatgataaacagatttgccaaatattgttaaccttaataattactcagcaaggtagtcattatttttatagttaagggaaatgactcaaacatattaagaaacttgtataaaatcaaattgtaattggtggacccaagacaatttctgtctaactttgacaactcagtcagtctgtcttcacaggaggtgtggggatgtgggggcttgtggagagttccagaactgctgagtgagattacatggatatgtgctaaagatgctttgtgggtgttttttttttcattagaaatttacccatcttttgtgcccatgtgccaagatattgttttcagttgagcagacaaattatgtctgtaattaagtcttcaaagacctaagatgtgtcagattgataattattagactatcattgagggcctatgaaggtactttcttagaaaagttaagttttaagtatttaggaggaaattagcaagctattttcatatgagatttaggtaaatattaattctgggcaaatttttttctttcctaactcttatttccctttccactcataagaagataatttgttgggtcagagacatcattagagactgtgtaaaaacaaagcaaaaaaaatcagtgtaataaaaggagcagagtgtcctaaaaatctctccaaaggccttctatctccaaagctgtatgcctctaagttttctaattattccagtatagtaaaacattaaacacaagtaaatgccagctggcatatcttaatcattgctatttcattttctaggagtggccagccaaaaattcactcttgtgtacagtctttgcctactcttacacatcctcactcagcttctgggccagccaatatggtgcatattcagcatgctaaatgcagggaatggcatcaataattggatatattttttaaaatatggcttttaaatgtgttcagggtagatgccggctaagccatacacgacagatgaattgtcttcctggatgcagaggaagcatggattcttattctgaagagttggtttctgtttgctattccactggttttcataatccaccagtataataaaccagtataatccacatcaccacttaactcatgaacctggtgatctatcctcctaaacaattggaaagtaattactgaatttatgggtcaataactgcattagtattctgtttgcttgacattggtaaggacatttattcacatgataagaggagaagatgaagaacactacttctgatcaccaagaaaaatagtcctattacaaaaaaaaaaaaagttcaaagtaacatagggaatcttaagttgcttgtatttgaatttgggtatcctttttggttatcacactatggtgtgtgtagaattttctgagtactgagtagtattattatttatactgcactgttcatattttattctaactgcttttagcattgtttctatgacattagaggaaaaatattgcttatatatctgagaaagttatagaacatttttgaattcttaataccccattaaatttaaattgttatgaacaagaaaaacattttcatctattgtcaaacgtagctaaaaattttcagttattttattgtttattcatatatctcacagccaacatgggagtggtgccacttttctgagattcaaaatgaaggcctaaatgttccaaggtccctttctgaaataaaacccaataaattcacaatatagcattttcatagatatgcagatatttatatattgaataaactcattttataatctattttagactaataagaatgctaacaatgtcacaaaatatttttaaaagggagtacaaccaaattctcaagtttctttctctgtatggattctcagatctttataaatgatgtgtagctcatgtgttgcacagttgctccaatttttcatgttctaagcattgaagatttagaagagaccgaatttcagagaaaatggattggtgaggaactggaaaaatgagtttttatttccatgcatttatcttgtgcctagcaccatgtgacatattataaacctgaagcaatcttaggcttgtctaccctcaagaagactatggttaataaagctgtggaaatgaggattacacacctgtatcagttaaggaacagtagtaggcagaatacaacaaaattctgaattgaggagacaatattattttctccaaatcaaaataccttattcctttaatattgcatcggactcattatttctttggttgaacatgcattatttgcctttcagctggggattggcatggattacaatatgcagtttaaatgccttcaacatcattgttctattattatcatcatcaccatccccaaatgtgttgtgtgtcaacttcaggagctatcctagtcattatatagaatcagtttaaatggatgtagcaaatcctcacaaaaatttccagacttaactgcataacatggattagacagacatatatagatgcagaaatagacaagagttcaaatattaacattcttaaataatgtgttactctatagtaccagtggcaaggagaatttttctgctaagagtgggaactgacattttttccaagctaaggagaaagcgttcctggatgtggtgcttcagaagcctattgatggaggagaagtacttctgttccttttgcaaatattttccagccagttgtaaactgatgggtggtaaaggtccaatatttataatgccaaattgctctggaaatctattcgtccagtaatataactttattgttttataaaaatgaggcttctgcacaactagtaaatttagtattttaattcaatagataatatttaaagataagaaagacctatgtataattcatgccttttctggcagtggttctcaatagcagtgggccatgcttaactccagaaattctgatgctcaaatttaggaggccagtgttgctcactttccattcctggatgagagtcagtgcttcagtgagttactcttcctgagaggtgtgtgtctgttgagtccgttgggtgtgttggctcagtttccaggatcatcccactgtgtgctacgtgcgttacatgcttttaacctttatagaaaacccaatcagtgggtatcaaataaagcccaaagaattttccaaactcaaggcaggacatattaagccaattatgagaaaaactaggattagaaccatatctttcactccaaagcctgtgctaattttattgaaccactaagattccaattctccatcaaagatggttttctttgagttattgtagttttgttaaccctattccacatgattttctaggtttttgttggtggtggcggtgctttttaatacaaatgatggtaaggtgttttgtctctctgctcttttgctttgaaggaataacaactgtcctcaccatgaccacactaagcatcagtgcacgacattctttgcccaaagtgtcctatgctaccgccatggactggttcatagctgtctgctttgcttttgtattttcggcccttatcgagtttgctgctgtcaactatttcaccaatattcaaatggaaaaagccaaaaggaagacatcaaagccccctcaggaagttcccgctgctccagtgcagagagagaagcatcctgaagcccctctgcaggtatttgacttaatccaccttcagtttaagattttagcttcttggtcaaatttattttgtcagggaaacaaactgagaacttaaaaatcctgatatcaacttgtaagtcatttaaaaatacagaaaaacataaaagtaactgtatgagcttaaactttatgttggtgattaacagcttaaaaattaaacagctgtgacagagctagatgtaggcgaagctaattgtttgaaagtttctttcggagttacaggttttttttacagaaaggggcaaaatcccatgtatactattaggaggaacctgtggacatctttaagtgagttgaaaaaacattttaatagagttcattgtgcaaagcaaagcagcagttagtttttgtttgtgtctttaaaaattgcttatgtttaatttttgtgactacataatagatgcatatatttatgaagtacatgagatgctttgatacaggcatgcaatgtgaaataagcacatcatggaaaatggggtagccatttcttcaagtatttattatttgagttacaaacagtccaagtacattctttaagttatttcaaaatgtaaaattaagttattattggctatagttgctctgttgtgctatcaaatagtaggtcttattcattctattactttgtacccattaatcatccccatcttccctccaccaaactcccgctacccttcccagtctctggtaaccatcattttaccctctatgttcatgagttcaattgttttgatttttagatcccacaaataagtgagaacatgcaaggtttatctttctgtgcctggattatgtcacttaacttgatgatctccatttccatccatgttgtagcaaatgactggatctcattcttttttatggctgaatagtcattcactgtatatatgtaccacattttctctaatcatttatcagtttatagacacttaggttgcttccaaatcttagctattgtagacagatctgaaacaaacataggagtgcagatatctctctgatatactgatttcctttcttttgggtatacacccagtagtggaattgctgaatcatatggtagctttatttttagttttttgaggactctccaactgttctccatagtggttgtactaatttatctccagtgtttgctattgcctgccttttggatataagctattttacctggggtgagatgatgcgtcattgtagttttgatttgcatttctctgatgatcagtgatgttgagcacctttacctatatctgtttacaatttccatgtcttcttttgagaaatgtctgctgtattagtccattttcacactgctgatcatgacatacctgaaactgggaacaaaaagaggtttacttggacttacagtctcatatggctggggaggcctcagaatcatggtgggaggtggaaggcacttcttacatggtgatggtaagagaaaaatgaggaagaagcaaaagcagaaacccctgataagcccatcagatctggtgagacttatgcactatcacaagaatagcacaggaaagactgtcccccatgattcaattacttccccctgggtccctcctacaacaagtgggaattctgggggataaaattcaagttgagatttggctgagaacacagccagatcttattatctattcaaatttttgcccatttttgattggattatcagattttttcctattcagttgtttgacctctttatatattctgattcttaatcctttgtcagatgaatagtttgcagatattttctcccaatctatgagttgtcacttcactttgttgattgtatacttggctgtgcagaagctttttaacttgatgtgatcccttctgtccattgtggttttggttgccatgcttctaaggtattactcaagaaatttttgcccagaccaatgtccaagagatttccctcaatgttttcttgtaatagctcaatggtttgaggtggtcttaattcattttgatttgattcttgtatatggcagagataggggtctattttcattcttctgcgtatgaataatacagttttcccagcaccatttattgaagggaccgtctttttccagctgtatattcttggcacctgtgttgaaaatgggtttgcttaggtgtgtggatttgtttctgggttctctattctgtttcattgatctatgtgtctgtttttatgccagtaccatgttgttttgattattacagatttgtagtataatttgaaatgaggtaatgtgattcctccagtttcattctttgtgcttaggatatctttggctattctgggtcttttgtggttccatatacattttaggattgtttttgctatttctgtgaagaatatctttggtattttgatagtgattgcactgaacctgtagattgcttttggtggtatggaaattttattaatattgattcttccaatccatgaacataaaatctttttccattttttggtgtcctgttcaatttatttcatcagtgttttctaattttcattatagatatctttcatttctttggtaaagttaattcctaggtatttaattttatatgtggctattgtaaataggattacttttttgttcctttttcagattgttaactattgacatacaaaaatgctactgatttttgtatattaattttgtatcctgcaactttactgaatttgcttatccgttctaatagttttcttgtggagtctttaaagcagcagctcttaacatggccacacattagaactaccccatggggcagggtggggcctgtgcctgtgtattaaagaagaaaacaaaaccaataagcaagaagttagatagttgtagtaaatgtacagtcaaaattaggaattctcgacctgaagggatagatctaagacaatgtggaaagcccaataaaagctattgtattttacatttgacacatcagtgagtctgtgatttaaaacaaacaaacaattaaaaagtatctttttcttcatggagtccaactgtacaaaaatagtcagatcctcataaaaacatagaagcaaacaagcagcgcccctctcactctctttcctcttcttcctcttcttcttcctccactactcacctatctccttctctctctttctctctcactatcactctactcagcttcttttttgaaccagcagacaaatgcctgtggtcacttaaatacagtctatggtatttgccacatatggtagtctaagactccctttgtttgcatatacccaaatcaacacgtatataaatcatcaactttatttctctatagataacagatcggtcccttattcattcattaattgatttattcactcattcaacaaatatacatttgtgccaactttgtgcccgatttcctgtttagaatctgtgagccgatagtgtaccaaaaaacaaatatcctgccaggtggagcttacatttacttgtgtggggcaagggagaggaggcagacaatactgaaaaacataaataacaaaacaggtgatgtgttagatagtgatagggctatgataatagtaaagcactaaaggggacaggaagtgcgggaggaggatgaggaggatgggattctgttctcagagagatgccagctgaagaaattaggttaggcattcaccctggcagggattaactggtcagggtcctgcaatttatagctctgctcctacagggcactgggccctttaagaatggcgtgtgtgcaggtgaaaaattaatatctttccactaagtaagtttagatagtttatattttcctttaaatgaatcaatttcatcacgattttgaaaatcatcagaatgaattttacatactatttattagtttagaaagtagtgattgagtatgcagttttattttctttcccattccccataggtaaatttataccctctgtgcttgttgttttattttgctttgccttgttgtattgaagccatgatagaagattcttgtcatggaaactttcaaaaacttgagtcttgaatttatttatttatttcattgtttctattttctaattattgagtcatgattgtatttgaattccatctttctgcaagttagttttgttactccttttctagctccttgagtttgcctcttattagtttattttcactatgttttatttaaataataaatttttcttattgcaataagatttcctttgcaaacaactttggccataattcatacctttagatatgtaatattattataattatttgctaaatattctataattatgttgctacttttatctgtgaactaagaattatttggagataatattttcaaatgggatttttgaaaacttcattgttaatttttattagtattgcatatgttcagaagtattacctatacagatttgaatgttacagatattttaactgtgccctgagctatgctaaaaacttataaatgtttgaagccaaattgaaaaaagttaatttttgattattaaaacaattttacttaaaatatgatttcagctgtttaacatataaccttttattatcttgatttttcaaataccaagaaatatttgaaaaattctcccactgattttatgagatcatgttaatttttttgcattttatttttattttatacattttaatgctatgatattcaacatgtaaagacacataactgctttatttctatatcattccaggcctctagtaataaaataaagttattgtttattcccatataatgttttttcctcaaattctatttgatctgattttagtacttttgatttttatatttcttaatattaattttgctattatatttttatcactaaaattttccttattctttctttcttcatgtattttggaagttatttcatatttgtatatcactagtagttaactttaagttttaaaacaatgtatttcaatttgtgattttctaataatgttgaaattataaaatatactgactgtctcatgtagctactaacactcctcaatgccaggattgctgtaggtccacgtattccagttttggagacacactcacacacacacatacacacacacacacacatatatatatatatatacataatttttgtgttatagtgagttgatagagttttcttttcttttttttttttttttttgcaaagtgatgagactcattatactagtgctatcatggaatattctaaacacttcaaagtactacttaatcagaataaaaccattctgctgaatttccaaagatgggaagagaattgataatcttccatgggctccctgaaacatacttcctgactacagcaattgccattacagtaaatggttggttgagctcattccattggctaagttcattctgatttagtaactcctttttcagcatgatccacatgctgtgtgcaaatggcacatccaaggtcaagaagatcaaatttggttgtgaaggacataggattataccatttaatcattgggaaagactttaaaataaatatagtcaaaatttgcattatatgcttcatatcctctacaatgtgtgactatgtatgtgtaatgacttagatctccacagtggcttacttgaagactatctgtggtctaaagacagtgattaatgggttggcccacccatcctcctgattctagatccctgccagagtgcagctggttttacagtatcacttgtcatcaaatgccttcagtatcaagtacaactttaaagattaagaacacatcaaaattaaaggacagagagagaaagagaaataagaagaaagaaatcaagaaggaaaaagtatgttaagagcaaaatgttacaacgtataactagaaagaaatatttattctaagaattataagttttgaatttcagtagagatttcaatcaggaagctgaaatttgcttattcaaatatgtgttccaacttgtaaagctatttacttattcaaatgatactgcctttgcttaaaatgtgtttgaactcctcactttgaattgtctttagagtctacatgacatttggtatttcagtagacctttgggtaactcactggtagtttgattcatcatcactatatgtgacctatggactgttgttgataacctggcacaggcttatggtgatcatttcggttctttgggaattggaatagttcatggaatattcatgaagcaaggagaaaagtccaattggtggaatctaaaagcatctatgggtagcttgagtatgtctttgggcgtctcagaaggcaaaccagctgttctgtttctgctgattattaccttgatgctgcatttgtccctgttcttatttgagttgagtctcattcttgtggttctttcctttcacattctcatttcttagagtacctactctctcatggatgcaggtgatttggattaatagaataattagaaaaataaacaactatagaacaaaaaataaagctttcttaatgaaatgatatttttaaaaatcacttcaatcgtatattctttagttcttatccagccacaaattatgcattaatatatgcacactgtatcttatgaaaaaaatcagtgatataatgagatggctaacattagttatgtcaggtactatataatgtgctttatgtgtattactcaatttcaagctcacaataactattttacagatgaagaagctgaggtttgcagttgttaggtgatatattcaatataacacagacagaaaatggtaaacctaatatcgaaattaatttggctctgtctgaatgcagagctctttttcttaaacacaattctatggcatttaatatttaatatctctattaagaatagacattaaactgtatgtattttatatacatataaatgcacacatatacatatgatgcatgtatatatgaatacagaagataataagcccaatatagaatatttttgttcatatttctatgaataattaatagcttaatattctgaatgctttctatgtaccagtaataaaaacttttacatttagtctatacttgaattctaacaacttataaaatatgttctatttttatccatgtttttaccattgagtaaattattagttaatgatcaaataatcttcccaaggtcacctatctagtaagtggcagggctgagacaggaagcctcatgcttttaagcttcaagacttaatgactgattggatatattgggtgagggaaatggaggctgagatagatggtggtggcatcaatcactaggatagggaagagagatgaagcacatttaatgaagaagcaaattaattcaagtttagataagtggagatttccatagcaggacaacttgtcctttcccataataacgactttcttttttcaaagttcaagtgcaaaattctctactgtatgcatctcctttttgatctacctaattgctatttctctttatttccattttaccctaaccataactagtcttcccagacttttcaattttaaagtccatagattcttacaattctatttgcaaaagtaaagagctattttctctgcttagactccttaagaaaagattatgttaaaaaaagaatgtataaataataattcaagtactcttatgataattttttttgtatttatccttcaaagtcaaactgtagccttattttcttttgggggctcattctgaccgagctctaggatcttgaggatatggccttaagtattcggatccttaaagtgggggtaataatataatctactggaaaggcttataataaggattaagttatgtcattccataaagtacccagtacagtgcttagtgaccagtaaatagtatctgtgattattactttttatttctttaggcatcttaaataaagtatgcatgaactcatttatcactttataatattctgtggcattttgcttaattgtttcctatgtgattgctgtacttatttagcgctatggcaagctcattaataaaatgaattatagcttcatacagcacacttattttcccatacagcacatagcataatgcttaacaattacagttgtttattggttggttatgaaccaactataggaatctgacaataggaaatgtggtacttttaaaaagtaatatatttttccccagttttcaaaaagtgagtctttgatggcaattttttttacctgaaataaatgtgagcataaggcacatgttaagtggtgagccgcagcaggatttctgtgaccatttaggacagcaaatactcattcttagcgttctgagtcacattttcagcagttggacttggctgatgggcagaaatagagaactgaggacactttgggggaaaaaaaagcaaaacaaagaggctcggcaaatctacgcaaacagctgtgcattataaggaaagagtagttggctatcataatatacaagcttcattccattcctaaagggtatataaactaggtcagtttcagattttcacttcaatcattctcaaaattcctcttaaaaatgctgttctttaaatagtttaagctaacatgcaacaaatcttattttattcatttgtccttatttctttcatttttaaacttggttttgggcagtttgaaaagggacatgaggcagtaccgacaattcatctgacatttaggtgtgtttatgacaggagtttagtgacattctttaaattttatataaataagtacctccccaaactcatacctgttttaagtacagaatgttctgtaattagtaatgctctttaggcaatgagtgattgtttaatgcacaattactaaattgtatgttttaagtgcccaatatattagaactaactatgtttcatctccagccattttttatgttagtttggttatttttcatatgtagagaaatgatatgctaagcattagaacagatctcagctactcagatagcaagtgtttaccaggcaactattgtgaagtcacctgcaaagcactgaggattcaaagacaaaatctaggaacttagccttataagagagacaggctattaatcttgttagtggctgtatttactatataaaagtatggtctgagtattagttttagaattcaagtatgtttgttcaagtattcaagtatacttactgccagatttttactgccaccttaaacctgtctcctgaaatacaaacctttatattcagttacatactgggaacctgttatatttatgaaatacctatcaactgtcagtatgttgggaatactgtgctccttccttcatagatatgagggtggtaggaatgatagtcattcaacaattaatttaaaataaatagtgacaaaaatgctgtgaaggagaggtagaaggggtaataatacattgtagcagagttgagcttcaaattactctttgaaatgcgaaaaagtaataaattaagtattaccattcaaaatggcaaagagaagaagaaatcaattttagcagtttattgaaccaatattttgcatattttggtaatcattggcaataatgtcacatggaaataaaaatgccaacattcgcatcaaaattgaagatttaggttctttccttttccataaaaggaaatgccataagtttagtgttgcattaagaaggctatgtatattaactggtgatcaaggagggagtaaggcaacatagtataatatggtagggtgtgtatgtgtgttatgtggtataaacatagatgatatagatgaatagtatatttgttcatttattttcatgtgttctgtgtttataaatagcatggcaaatgaagaagctgtgaaatgtatttagcatagaatttagagagcagcatgtcatcaacatcatcatcatttattgagtacctactatgtgctacatactgtgctagttgctttacatgaattatctctaatctttataacaaactctgccatctgttgttatgttgttatacacataattttatggttgagcaaactgagccttggtattttggtaagttgcctagatcatatgtgtagtaaatggtagacttggatttgagccctgcctgtttggcatcagaaagctggatggtttcagattcatggtgctgcctctcacctagaaataactgcaggcaggcattaagggattttgtctctctcagttctccagtgtagtgtagctttaatcacacaacctaatacttaggtttccatttctccatctgttaaatgatgaagtgaggcaagattatgtctaaattcacatctaattaaaaatgtctgtattagtacaaactcatccattctttgtaactaatgcaagtttgctctgcactctttttttttttttttttggatggcgtttcactattgttgcccaggctggagtgcaatggcacgattttggctcattgcaacctccacctcccggattcaagtgattcttctgcctcagcctcctgagtagctgggattacaggcgcctgccacaatgcccaactaattttttgtatttttagtagagacagggtttcaccatttggccaggctggtctcgaactcctgacctcaggtgatccaccagcctccgcctcccaaagtgctgggattacaggaatgagccactgtgcccggctctttaacaagtgcttactttagtacaaatgatgtatgaagagctgattagaggaaggatggctctttgtggggtcactgagtcagatcaaattaaatattcaggttattttatactcacctctacagcagaaatctacactgctccaacagcaataaaaacatcaattatactgtgcttattacttgctggagaatattttaagcacttcatgtatattcatatagccttcacagcaatactttttacagatgagaaaattgaggcacagaaaggtctaagtgatttgcccagaattacatagctgttaagtaacagagaccagatttaaacttgggggtctagatccaaagtgtaggttcacaaccactacagactgttgtccctcagttataacccatcacaaccactgctgaactctgctgtgtccctggccccatacttactccccaactatccacaatttttctgaagattgtcttaatgtttacattgttagaagtgtaagccatactttgaaactctatcccatttatatacaagccatacccttagtcagtggtttggtttacgtagaaagcggtcagagaaaattaatcacattttttagatcatctacttttcataaaatacatgtggattttgtcaactctaaaaatcaccaattaattttgcacagttattttaacaaattgtagactaactaatccacagttttcccaaaatgttgtgacattttaaacatttagaaaactttagaatatattaccattattttgatttgaaataatctattttatgtgcatcaacatattcaattaacaatacttatttacaacatctgttgttttaaaagtgggaaaaatttccaagaagtttaggaggtagtttttgccctgaaatactacatcaggagacagagtatagtgatataaataatccagaggaacagacactgtatttggaccaagggacactacaaagaagcatgctgagctttagggggtgagggatgctggcagaactcagattggtggtgaggtgtattttattgatcgtcagcagataaaggagagtagaaaggataagccagctcattattatgaatatcatgagttggtttgtaatgtttatggtctagcttaagaatcattctagaattgctatctaatttataaacaattaccatattattggaattgttattacttctccatttactccgtcacttccccagcacatctggcacatatttcctaacacatagccaggtgctcaagaaatgcctgctgattgatttcattcctcatataactgagatatagacatggttgctggtgatagcaatatatgaaaaaactacacatttccattggtgaaattttgttattaaaaggtttttttctggtacttcaatattttatttattttataatcttttttttccatttatatcgcaatgtgagtgggccagcacttctttttagaatggaaaaaatcagcttcaaaaataaacaactgctttaaacaactttcctcaacatttagttatattttccaccaagttctcatccctaagctactgagtaagattattcattccttctggtgtatttgactaagctgccaattttcccttttgctattttgaggagctaattttcccacaacataatatacatcgctaaatctccagctttttgctcagcctcagatgatttagaagtttcaagaaacatcagtttgggtatgacttattttatttcacttaaatgaattagaggatattatgtatgaaaaatgtctttggaaaaagaaaatttttatgtattttgatcaattttgcaacagttttagaaagaggacacttttcactcagattgtatggcatggcatgcttttcttaatattttctagtatttcagatgttacaggatttttttagcttcctagattctttacttgactaatacatcatgtactttcccaaactgtcttttgctgccacgatgaataatcctgaatttttaacttcttagttgttctgtaagactatattccttctccctcagtctatagctcttgaatttgagttcaatttttataactctgatatcttcatatcgatgaccagtatggagatttctttatactctctagtctcaccaatcccaaacaatgtaggccactaaatttttcttctctctcagactctctgtctctcttttgagggtgggttggctaaaacaagcttttaaaaaataaatacttttaattgctttttgttgtctaattgcaaacagttttaggcttcctagtgagagagaaggccattcttaggggattcacagaagcagtagtcatgtgggcactctatttttgcctccctgaaaagtttttctaagtacagtcagtttaatgtggatatcaagataccgcttgaaaattatatatatatgtacacacacacacacacacacgtacacacatatatatacacacatatatatacacatacatatacacacacacacatatatatatataacaaatttcctagtattttattatacatattaatattaggaaaacggaagagctatagaggaagaagaagccccaccgtttagcacatctgcactttctctttgtctaggtccctggcacttggagattgggattgacatctccaaagagaatttggcaaagagtggcaaggactctgtattcaaaaagcagaaagtcaactctttaattacaaagtgggaatattactatctccagcgtaacaagctatgaggacatatgggtttagtttattgggcagatttatttgaaaagtgttttgaagagtatgaacttgaagaccaatatttagtggcctggcacccaatatttgttgattgagtcaatgaatgaaagactgtatgaatacaatgtagtctttgtaaaatattaattataaatacatagtatatatttaataatatataaaatattattaatattaactggttagataacataataacagtaaaaagtcccacaaacccattcaacattgttaattagctttttgagggtcacatataggttttggataactgaaggaaatctgtgtaactcttctcttaaccacaaacgacctaatttctttggaactcacccatatgaagcaagtgctattcctgtattccactggcttttcctctgagccttagttttattatgccggttgtctctgtctcccagtgcagataggtatgagatagaaagtaagagtcatgctcaactctgctggtcagggatacctggggccccagtataggttttctggctatgagtgaaggaaggaatctaatactcgcctgctctaataataatcagatactcttctgagggctagcttggctggaagagctctgataaggatatcttgctttgaaggagtaaaaacgagattttcttggagcttgaagcttcttgcttccctggagagtaagcaagagctggacaagcatatagtaatttatttatttatttatttatttatttattttcttagagaatatcattagcttaaaaaaacgtgggagggcaatgataagtggaagcctgggttaggcacttaactttcacatgctgcttcttccatgaagaaatgagcctgagatttgttttgagaaaagctaaattttattaggttgagccattagaaaatgccattttgctagagaaaaatggcttttaaagaggtggaaaatggtcttttgaagtaaaggtgaggcccagctctgacataaaattgccttattagtcgcttctttttaacagcaaaagagataattaataagaatttgtcatgaatgatgatagtgatttgcatttttaaattcgttaggttatttgttttgaagacagagatttaggctgagctgagagtatcaaaaccttggagccgtactttgtgtgcctgggcctaatgggggcacatcctctctgggcatcctaatggtctcagtaggatcgttttgttagcttgtttgctttgctttattttgacttgaagcagtttatgcttgtatagattctgagcttcaacaggcactctctcttgtgcttagctcaccatcactgcttctgcaagcaagaaacccactgtgctaaagccttagctgatcctgaaaaatgttaacatgctttctgcctaatgtttgccaacgggctgatctaaaaatggcaccaaggaggttacctgttatacatagaacaagaatacattttgggactgaaatagatcatggtcaatggggacctgatctgctgacagaaagttattttagcatccccaacaattcataaaagtagagtgagatttttatatggtgaatcctatttgttattggttaattaaaaaaaatgaatctctccttgattagctttcaatatctaatttctttttctttatacttattttcccacagtgtttcttatgaattgcattcatatttcaaaattcaataaatcattcatttttgcacatttgcaataggtaatatcccttgcatcacagtcaaatctattttatcaaattcattactacaaatgtttcaaagaagtgtaccaatatattattgagataaaatatggaaaagtttaaaacattttttcaatgaaatatacagatttttttccaatgtgatcttcaaattcctagcaaatgatttttttccaattaatctacaatggatagtttgattttgtccctatttgcctgcaattgctggagtttatgactattgtccttgtggcctacccaggttagcatttgttctgaacaaaaaatgtccttgcttgaccaatagattaggtaatcaccctaacaagggaacaaatgtaaaagatggtcttctagcagtgaacatttgctaaagtatttaatttaaatgtttccaaatagtaatctagatatatgtgactgtaatagacatactataatgggcttaaaggttagtagtacaatcaaaaaaggattttagaatcccgtaagaatgtgtgataatgtttgattgcagttaacttactgtccagtcactttgtagccagtaagtgcacctagctactcacagttttagaaatcatagcactatgaagtttctaagcttcagagaacataaaattgaggggtaagaaggatctcaagtctttattacactacaacatctgtgcaaggtttaggccaattgttctataatgtaagacggttaaatactgtctttaaatactgctgctttgttctcagagattttgttaccagactatagtcctcatttaggaaaagaaaatatatggaaaggagtaaaatttggggctgaagcaagtaggataaaatcacaaatatgaaggtgagaggtgaaatcctgaataagatgtcctttattccacctgctgggatctagcatgtgcattacctaagtgcttccatttttaggtctattttgtaaagcagtcatcaaagataccttaacgtttcatcatatttgttggcctgaatgaaaatacatgctggacttttactggggagagacagtatgaatccaagtgttacatttggggtagaaccctgctgttgtttgaggtaatggtaatctgcttgatagaccgaattcagtactgtgtagtgcagcctaattcattacagagttgttcatctcagaaatagctacatgaaataaaatattatatatgtttatttcaggccaatctggcagcacagtagagtgagcacaatcatctactctcagcaatgcaagcaatgagatgtaatttgcttctgttttactagctcaccataatattcttccctagtttgaatgctccccacaatcagattactgtgtttcctccatgatatttctttgtcattaatatcctcttttctggcagaggatctctttatttatgataaagtttaataggtttccaaaggataaacaaatctgattattttcagggtaacacacagattggatgttcagtggaggacttaagattttttcagatcacctggatggggttcaaagtctaggtctaccaggttcactattagaataattttagggtgctgtgaaaatagagacattagccaaaagcctcttgatatattgagagtagttgataaagtaaaataaaaagaatgcagcccagtgtggggtaagtaaaaggatgcagtaatttatttggtgctgctatttccaatatactgtaaggcattctggctgacagccccagcctcaactgccaggcctgggagtgaggacatcttctgggtgattccaacccagcccttctgattgaaaccacatgagagactctgagtgaatgctgcttacctgagtccagccagcctccaaacccttgagagataaaattaaaatgattgctgttgctttaagccactatgtttaggggagatttattatgcagcacaagattaactgggaaacacatgcttttaagtcacatacaaccaagttcaaataatgactctgcctcttgctagtgggatgatgtcagccaagatcttgactttttcttattctgtttgttcatcttacagatgtctaatctcgaatgctgcaggtgctcaataaatatgtttctcttctttccttcctgttttacttccttccttccttttttgcgccttttcttctttctatccttctttctcccctttgcttccttcctgctttcctcctcttccttcccctataaatttaactaagtgcagctgcttttgtggtaggccattttaaactggaatatgttagtgccaggtgtggatttaattggacctttacttagaacgcaggcagacagaattcaggatgcatttattttttcagtgaaaactgctgaatcactggttccaaaatcggcataaaatatgcccagaccttccacagacggcgtgtgtgatgtgatcaagtgccttaggggaatggggtaaacaaatttttaaaaaaggaatgtttccatcagttcacagcgaacattatcagaattcagttcaggcaaagaatatcttaaaaagctagataaaggaaatgaaggcatgagcaacatgttatttgtaggaatgacatacattatctccttggcaactgcagggtggcatgcaatttggcaatctatgttgtgtcatcttggatgcctggaagtcactgtttcctatggaaacaaaggaaagaacaacatgagaaaaagagttctgattttagtattctggaaaagtattttaaaaccaagagaccagcaggcttccacggcataactagaactcaaaatggcattaaatttttatttattaattccacaatgctttagaacatgaattagatccaattatttttgaatctgctgcacttttattattgctttgtgttcaaaagatgacttaagaaatttgtgtggaactttcaatgcaccagtgcttagtctttcataaacatcagattctcaacttacgcacatttatttatctattcattcaacagatatttgttaaaagactaatttgtgccaggcgttgtactaggtatcaaggctgtatagactccttatgtcttataatcatcctttcctattcgcagaatgttgtggcatttctttatttgaagtgaatcaataatttagcaagcactgacttagccccacagtggagtccctattatattgggaactaagagttagcagaaatgaaacataaggctacacaatacttgatgggacacaaaacaattctcataatgctgtttctttggttagtcatttgggaaacctttcttgggtgtagaaaagtgctgtttttatcaacagcctccaagtaaatggctccaaaatatttataatagtgactcacgctctatataatttcatttgatagttcatttgacagaaattgaatgtcttaaatgaaggaaatgaaggttgcaatatagctggctagaatctatcagtttccactttgatgaaattcaaagaagtatcaacattataaaatgctacaaatgcagcttaaagggtttcagtgagactgcctggtcacagcaggagaatgatatagccagttacatgagattaaagcatcacatcagtcttgccaggatcaccagtggcctatagaaattttttgttgttgttttcaaaatagtgctggagataagaacttgaggttttattgtggagcagaaatttgggttcaacagtcagctcttcccaaggacaatgttacctctcattgatttgtttactgtctttaaagcattgctttgactgcttattcttcatctcctttcagtctcttcctagaaaaaggtgaggcatttatttacattcctggagactattaaggaatgattttgagggagattgctagtatctaccaaagtctccacaaaaagcctgtaggctactttttcaaatggtgttttaaggtgttcttttagctcagaagagtggaagctatatgcctgattttataattccagtattaaaattaacaaccagatttcacttcctgaattttcctcctatagggtcttattttactatgtcctctctaagagcagtatttcagtttagaattttcttgggtttgtggagatattcatggaagatttaaatagcattgcagctgtacagaaaagctgttctagtgtgtgctttaaaaatcagcttttcaataaacgatagctttagaactatgattgagaggaaaaaaccagtccttgttaaacaagctatcacagctacaggctacatgtcccaagcagtttgaagaacaggctcatatttctcatccctttgctccaggagaggcaggttggtgtccatgggcctcatgcctttcctgtgtagcctcaaagggcaagaggaaggtgcaggttgatgtaggagttgaccctttccaactcagtagcagtcactcaggcatacttttcaacaggcagatgtatgagacaggagaggaaaagcatttcattctggttatcagttaatattccaggactgactcattaaacagtccattaactactatcatggcccaggaagtataatctgggtagaatgaaagactgtcatctggttttcaagtggatttaaatgtgctacttttgactttatagctctgccaactacttacttcctaaacacattgtgtggaacattttgagtatacaagagagaatgattttgttgttgatttattttaatactgtttactcatcatttatttttcatcgaattcatttgacttactttcattgaatactttccagtgtttggtactgtgctagttggtagggaaaggaaaacagttagacactgttgaggcccttaaagaaactcacagtctggaggggcactcacacaagcgtgctgaatgctaggctaggaaaaagcattaggatgcggtgtgaagatgcaatggtcctgatttgagtttatatggtgtaagatttgatgagggtggtggggtgtcagaataaacctttcaaaggaagaaatatttagatactatcttggaaattataaaagggaggtaaagaagatgaaggagagaagacagtgagaagagaatgtgcaaagaaccagaaggaagggaaaatggctcacatttctagaactaaactaagacatcctggctagagtccaggtgttttaatttgggtttctctcagagcagactctgttgcaaggatgtgtgcaagcaatttatttttaaggtgttctcaagaagcactgtgagggaagtgagaaggaaaagaagaaaagccaatcaagtgtcattaatgagcgggtttaccactgtgtgctcattatgcttgggaccttcccaaagtatgtgggggacaagccttagaactgccccctggctgacaaagaagttggagtacttaacaattcctgtcttttgttgattaggttcacttagcagtgttatttacattgaaaatgtatatatttaaggtgtgcagcatcatgttttgacatacatgtacatggtgaactgattactacaatcaagctaatcaacatgtctatctcttaacatagatacttttttgtgtgtggtgagaatatttaacgtttactttcgtgcaaatttatagtatacaatacagtatgattaaccgtagtcccgatgctgtgcacttgatctctagaatttactcatgttacataactgaaatattgtaccctttaaacaacatctcctcattcccccctggcccacaccaccactggtatccaccattctactgagaaattagttaatgggtacaatgtatgctatttgggagatggataccctaaaagccctgacttgactactacacaatctatgcatataacaaaacagcacatgtatcccataactgtattacacattaaaaatatataaataaataaataatgtttataaagattctgtaggcagtatgtccctcaggcagagaaaggcagtaagttaccagcctatgtggagtaacctcctgggtaagccaagtgaatatggaccagatgctgatagcctttgctaataccagggtatctgaggtggctgagagggtggtttggggaaaggaaggggatgatgaggctggactgggaggcagggcccaaatcatgtagaatgctatgccatataattgtttcccctgaaaacaatcaggtgccgctgaaaaagttttaataagaaattgacatgatcacatttatagtgtgtaaatattattttaatgaagagtagagagataaaaggtgcataaggatgttaagtctcaaaatgttaataggttgtgcaatagccaggtgaaaaatgttgaatgtctttgcaagggctgtggagaagaagagacagattagaaaaatactgagaaaaactgaaaggaaaagagaataaggcagaaggaagcagaaacagctgaagttttgtggcttgaaagctaggtggatagtgtgctaatctctgagatctaaattacagcaggagatatatttgtttggacaaatatatcaagtttattagatagcaataaattcgtacctctattagactttgaatatgggcaagaatgtaagttccataagggtaagaactttgggctggtctctactctcctattaccagagccaagaacagtgcctggcactcaataaatatctgaagaattgaatgaataaatgggtagatagatgaataaataaattaaaagtttggtatgactctaggatatctaaatgatgtcttgctggctatatgcgtctagatgttagaaaaaattggggggagaagacattgattttatgatattgatataaatattgtattcaaagcaactgaacaggcccattcacctgaagattaagaaaactgtgataactgacagctaaaccctatggaaaaataacacattagagttaggtagagaacaagcatcccacactggagactcataaaggcaaatggaacattgctagaatatagaataatgggaagaattgaaagaaacaaagaattcattaacagtgttacatactgagacagtatgtaagacataattttttttttttttttttctgagacagagtctcactctgtcgcccaggctggagtgcaatagtgcaatctcagctcacagcaaactccaccttccgcgttcaagcaattctcatgcctcagcctcccaagtagctgggattacaggtgtgcaccaccacgtctggctaatttttgtatatattttttagtagagatggggtttcactgtgttggctagactggtaagacatagatttttaagtgctaattatagtgatccacaaataatttcaaaggaaagatgggagaataatcaagtaacaatgagttaaaaagtgagtgacagacgaagaagtggaaaccataattgtagactatttttccccagactggtagtggtagataatagctgctggaagagctcacagatttgaggagtctcatgagtggatgttccataaagaaaagaattttgtactgtttttctatacttgtatcaccagaaccaagaagaatgcctggaacataaataggtactcaataaatatttgttgaataatgggatgagtaactagatggctggatgaatcaacaaattaaaagtatgttatgcctttaagacatctgattggtgtcctactggatatatgtttgcttatttataacccaaaataaattttagcatgctatattttgagtaagtgcaaatatttttaagttgttaatattaagtagaataatatccacaggattcttgatttgatgcctctcttgaagcagtcaccacccccagaggaaaccttttaagccttttaaaccttggagctcttaatcatctctttacaattggcagatctgggcaagatggtaagagttttagttagttcttagtgttgctccaagaatgctgattatgtccacctaggaaaactaaataaaatgaattttgaacatggcacaaaatacaggctctcatacatttccaacatttaccgaagtggaaagttacactattatcatttagttcggttgaaaaatacaaatatctgagtatagaaataatggacaattctatagtaatattttacctgacaggggccatctacagatctgagttagaatattaaatgataacaatagaataaaaacatttaacaaatattgatcatttactatatgctagagcaatgtgttaagcactttatggaaattaccacaccactaactctaagtagtagttattgttattattctcactgtactcaggagaaaccttaagcacaggaaggctaaataagttacccaaggttatcaagctagtatctagcaaagaagtccaaaacttgaatctatctgatttcagaacctatggttctgactttgtttttttaagtactaacataagaatgataatgaatgataatgatagttcatagttttggttttaagatttgttttatacaagttgatagagagcacatttcctttactgcctactagatatttgggtcttctagtttctggcctgcctggctgaagtggttatattggcagtatacattaatgtgctgatgagccatttgccataaattgcaactcagctactggttcaattcatgctaaatttgcaatctgcctttactgaagtgcaaaattggctttcttgtcataaagtggtagaacatgcaaaatagtctaataccttattttctagctcaagtaagattagctagactcagagaaagttaaaaaaagtttcactttggatgaacagctgtttcagcttgagagccttgttaaacgttgaatgttttttgataatgcccattggaaaccataagctgatagcttagagcttactcttcaggacaagttaaattattttctggaaaacagccaaatggcttcagcaattttttggggggtgttgagagtggggggtgtctgtttaacaatgtaagtgctaccaatcggtgtcacagtagaacttgagtttgttctgctgacttaatgtgctgttttactatagatggagtagatttgtaatgaatcgtgttaataggctaattcaacatatgctttatgaccaattgactacttccattggtaaagactaggggggagaggactgattttaaaaatataaaaactgacacaataggtgacttaatgaatcctcttctgctacatatacatgtgtacacacagtttctttatacataatttggcaaatgtgtaaatgaactttattaattttaattatttgtagaaaattttgagagtgattgaagaatcattctcaaatcagaaacaagagatagagctcatgttgataccttctctgggctacagatggagctgaaatttcagtatcctatgtaccaaaggaaaaatgtttcaatcagttttaccatatatcttgaatagtaaatttttaaatagctttttaaagtgctatatccaaatttcagggatagtttgtggaagaaagatagggaatagatttcctcttgtagaagaacatcataaaaatatttttatcacatagaagatgcagattttgagtagcgttgatgcatttttaaaataactcacagggaaagtgtcttcaattaaaaatacaactttgctcagctagattgcacttgttaagatacagttttctgtagaataaatcaactaaatgtaagcctatttataaatatttatttatgcctgaatgtagaggatatttgtgatacaaagtattatctataagcacttcatgacagtcaagcatcaaagtagaaagaatattatgaatgggagtaagaacgatcagtaagaacctagaacaattttcacatgcaatgggaagaaaggattttctaatcatgagaaaattttttgtgagatacaaaaaaagttagtacagtatttagcttataatggaaactatgtaaatgtaagtcaaatccaaactgtttacaaagatcacttaggggttattgtggacaaatttcagataaacttttttctgtttttaaaaaaatctcataagcatgtatttttaattccatgagtatatatattttctattccaggtggcctcttgaagtggttaagagtatgtatttgggattcaaataatgaataacacattttaattgtatcatgctgggagagagaggtgctcaacgttttaggtttcagtgccctcattgggaaaatgaaaacattagtactatctcatgggttgttgtaggaactatgtgaggttatttgtgaaaaccctttgggtagtgcctggcccatattaagggctcaatacattgtagaaatattgatgatgattcaggatttctgcctggaaattgatattatcagatattaattatgttagaatagaatgcattataaaattgttcactttaaaagaaaaagtaagaagagaagggaaatttagaatatcttcaagaaacctcaaatttctgttgacgaggaagagtatcggtctgccttatccttataccactgagaaaaatctttgaaaaattgtttctaatatcaacagcatcttcttccctcaccccataagggaatgaggagctcttttgcctatttaaaacttacttgttgctaatatctcagcttaagtattacttccacaaagaggttttcccatctcccaggctgggtaatgtattctctagtacctctaatttttctttataccattttgtgtttatttttttgtgattcttgagagaaattgcaaggagtgtattatttttcacccctgtgctcccaatgcccagcaaaataacttgaaacagttgaatgaatgaatgaatgaatgagttgaatcagtgtctttaataagaccttattacttgtgtctttaattgtggatcttctagtacccacttgacctggataataaactccaacaagagatgaaacatggaacttgaactatttttcactaaaaatagatctattacagttattataaatgtgtatgttcagtaggcaaacattgtctggaattccaaagaaattgaaattggaattggaattggaaattggaattccaaattcagcaaggttcttggctcatcaaagacttcctcaccttgcatagctatgattttacagaggtacatggcttataattcctgagctatggaatattttctccccaacaaaaatatactgaaaatcccaccttgataaatgattgtttttaagacagtgcccctgttgcctttgctgatgtagatgaaattgtaactcagactacttgctatgcgagcctcctataggattggcatggacttgaatctttctggatggctattcatcatagcacaatttcattgtgatcaactcatatcaagtctatattaagaataaagcattgtgcaaatattgtctgagtttgaatgtaatttttgaatatattgaagctgaataaaataattcccataggataatgtggatgctgtaaaggtgaatttacttggccatctaatttagcattcttttgcaatgttttatgagatctctctctatatatattaactccactttcaaggattaaaaatattcttaatataaagtgtgaaaaagaaaagttataaattatattgttaattacatttttcaatatttaaacaaatgcatgctttgaaatccaaaacacatgtacacttgcacacatacacacagaaacatacttattcacattatgagtgagtcataatcactcactgtctgagtgaaaatattcagggaggtgaagatattcagggaaaaatatttggtggttgaagaagcagctcaaattatgtctaaactctgaggttaaataaaagctccagttaaccgaattcccctgatttgggttaagaggtgctgaaaataactcaagagttacctggaggaatcttatctaggcaattttgaccaaattaggaagaggatgtagatgccacctagtgggtgtgaaagtattttctctcatcaaccacaagtaaaaatattaaaaagaaattaatgcttaattcttgtcaaaagtattttagcttttctgcatgtattttttaatcttggctctatctagaattttggggttaccagaaaagtatacccactcagtaaagaaggcacaacagaagagactagaaacaaagaaaatacctgaaagaagaaagagtgatacgttgaggtggtttttttcctataaaaaagattagaaattttggaagactgtgtgtcttgaatttaattttattgacgttagattattcttttagtttcctcaggttgccataacaaaatagcacagacaggctagcttaaacaatagaaatttatttctcacagttctggaggctagaaagtctaagataaaggttccaacagggtttggtttcttgtgaggattcctgtcttgatgtgaagatagctgttttcttactgcgtccgcacatgatggagaaaggtggaggtggtgagaagacagagagaaacctggtatttctttttcttttatgagggcaccagttccatgggacagggctccacctttgtgacttcactgaaccttaaccacctccttaaaggtcttgtctccaatatagtcatgtggagagttcagttttcaacatatgaatttgggaaaacacattccagtccacagtaatgattaaaacctcttaatatttgcatttttgacctttgacatttgttgcattctgccatccctagtctggtgggctacactgccccatttcccacttgcaatttatatgttgaagaaagtccttttgactactataattgacataagagataaagggaaaaaagtgacactatcgtgccagaccaatagattcacagatacaattcttttaaatattccaatatatttagaaagaggcccagccaaactgggttgccagtgttgtaattgtgagccaatgctatgggtatgtcttttcatacataatgacatatgaatattcttgtaggttgggattgcaatgctttctccaatctgtgctgtttccctgatgaccactttctggattttactgatagttggtaaagtcccagaaagaaacagtgatctggccaggtgctgtggctcatgcctgtaatcccagcactttgggaggccgaggtgggcggatcacctgaggtcaggagttcgagaccagcctgacaaacatggagaaactctgtctctactaaaaaatacaaaattagccgggtgtggtggcacatgcccgtagtcccaggtactcagcaggctgaggcaggagaattgcttgaacctgggaggcagaggttgcggtgagccaagattacgccattgcactccagcctgggcaacaagagcgaaactctgtctcaaaaaaaggaaaaggaataaaagaaacagtgatctgatagaatagtacacaagatccccttcttatataacccacatctttttttagacattgaaacacttgtggctgtagtctttcctacatggcacatgacattaggtgtagtagatagttcagttaaaagcatgttagctgagtgccaggtgcaaaagaatcactcaagaaaagttaaccattgttttggctgttgttgttattgctactttttcctgaagagctttttgacatacgtcttatgcataagttataaggtttactctagtgttaattcgcacccatactacctatatgaattttgatttttctattgcattttgtatttatttgtatttatttctcattgtcaccagcaacatcctttccctgactgacttcaccatagaatattctttttttaaaaactttttaaaattatactttaagttctgggatgcatgtgcagaacgtgcaggtttgttacataggtatacacgtgccatggtggcgtgctgcacccatcaacccgtcatctacattagacatttctcccaatgctatccctcccctagccccccaccccaaacaggccctagtgtatgatgttcccctccctgtgtccgtgtgttctcattgttcaactcccactccatagactattctttccttcagtgatcatttgctttggtaattattagacatgatggccatattttcatagacgtataatattgtcttctaaaattttgtttcccgtaattatttatttctgtgacatatcattttcttttggaggcagaatcttattatgtgacttcagctgggttctttctatgtaatattcgtttgaatcctactatgtgctagacattaagctaagtgccttacatgcattatcttatatatttattaggaggaaggcagcattattactcctatagcaaggactttgaggttttgagaggctaaataacttgctgaatatctcatagctagtaaatgacaaattcggtatttgcaaccaggtctgtcttatttgggagcccacaattttaactgtttagcaagtgtttttcaatttctgatccctggatcactggcaatggcatagctaatgaaaaacacttcctgcaaatagggcttgtttgagactttgagtttttaaccagtctcagattatttttataaacactttgtatgaccacaatactgcttttctacattgaataagaaaagattcatctagcatagtatctgtatttagaggaagtgagtggagtgtcctttgcactcttttctctccagggttatgttggcggcattgatgaaagcagttcctggcatgatttcaggtagcatttgaacaagtttgcttaatcaagctaagaacctctgctctgaccaaagaagtctctaacaaagcggtttcctccattggagccatgtgtctaccatacaaaacatttacaaataaaaaggaaacactaggaatcagtatgaaacaaaagtaatcacaaagtcacctatcttaaagaaattctaatgttttaaaccctcaactctaaatatataaagggaaaatgaatggattctttaagatttctttttctggtaatcccaaatggaaaacaaaagtttatcccagtgcctgatattgaaagtagtatttctgtaacttatggaaatacaaacattgaattaaatgccaacattgggaggaaattaaatacaataaatagggaactcagcattttggtttctacattttggagctcaatatatgatagagtgccttggtatataaaatatttagcatgtttatttggaggggatgtgttaaaaatttctacgtgtagcacgttctaaaaatgctgttgatatttctcagtaaatcattaccttggagtttagttctagctgctctaccacatttgtttatttccctattaaataagatgtgtggcttacccatgaagtcctgtccaaatgatcttgaataaatgtctttatattactagattctttttttttagtatgtgactcattgatattctagaagataaacctattcgttatcagtcttgttagtttttaatttacaaggattaagttacattttattaaacttcattagcttctcaagcaagtaatatgaatgtagctgtgtgcattctgcagacctaatcttagtcactttatctcattgctgctagagtcataagttgagatgagttttttttgcagttgataaaaattatttagaaattgtgtcagatcacagtcatgactgacgaattgcctggatctgctcctgtttgcctgttgctgctttaatttgttggtaatgtttaaatctaccaccttgcatctcttttcttgcttcaggctattgtgactaatgacaaagtaatttcaaactaaatcattttttaaaattcaaatgaagcttaggtgctttttcttgttcgaaaccactgtgcatcagctaaatcatgatagaaccactgaagtctctacactctgtacgaaacacaacatcactctgacacattagttgcaccaaaatgtgaaagctgggtgaatattcttcccagtgagtcgtgtgccagatagatcagcagataccttattccttttgtggtctgtcatcatggaaaatgactacttttaacagagtaaaacttgagacataactgcaaaaataacttgagtgtcatttaactgcttggcagagagcaatgatttaagcctcaaatcagtctaattccactttcctttatgtaggatatgatatacagaatagtgaaacttctaaggcattctcagccagacttgggattgagtcaagataacttaaatgccttaggcactacctgcaatattctaaagatgtgtcccatagaaaaagaaataataaattggagatcagataaaaatttttgacactttctaatttgaaaaaggatcttgattctataggatatccattttaatgcaatttatcaaatatgaaataggtgcctactgtgtgcattaatctacaatgattgataagacagtctttatactctagctcattacttcttttaaactggaataaaaacacttgatctttgttttcagacagtaatctttttggtactgttcatgttgcacaccccactctcaaaaagtctcttacttcattgttcttttttctaaccaccttagactgattctttttatttttgcttagactctcctctttctctaggcatattcttcaaatgtaagattttatttcttcgatatttataacttatccaatagtagatatcatcagaatatagttttccaactgtcaaaagcatgacatacaaataatgaatggacaggtctccaagattggttcaattgttaattaatgagagacccacttagatggtaaaatggattcaaaatctttttgaggaatggctacgtataggcaattttttaaaaggaaaagtaaaataagactggtaggttaaatacagaagtgcttaatgtctgacaaggcaataaaaccataacctttcatgatcttttgtactagacaggaatccataattgaatatgttaacttgacagtgtttgggttctaataaaatattaaatggcaaaatcaaactcaagtaaattattctaaagacttaataatccttgagtgggcttgttaaacaatactctattatgacattgaaaggacatgctgtatttttttctgatgtccaagtcttgtataatttttcttaacattatactactatgagtacttgactgactcaaatatgtgcagcttgttaagttctttaaagcctcctccacatttgtgagtagagaacctctacagtgaggcagaacagacaccaagtaagtaacttgctgtatgacttccagtgacctgtaacctttctgttcttacttttctctactggaaaatgaggtaatggaataagttgatcactgaaatccctttctgttttaaaatattgtaattcttatagagtgggattatgaagggcaaaatatgttggtccttcagctagcgtgtggattaggcaacagtgccccctaaaggtcctctatgagttctgggcaggccaatcttctaagtatcccagaatgtctgaggaacttccgccctcacgagcccttggcagcacctcccatcaggacctttgatctaactcatctatctattatctattgccacaataatattgcataacaaaaaaaatgatacttcaggtacacacaattaatatttatttttgctcccaaatctgtggatcaactgtggattctgttgatgttgattacgcttgctcgggcagctcattttctcttaacggaacactcatgaatctagtgtcagctagttgttggatgttctaggcttgtctcattgtgataactggctattctccaaatgagctctcaatctctagcaggctagcccaggctgacctgttcttatggtggtggtgtcagtgtttccagaaagagtgtaagcaagtaagaactgttgaggttaagaattggaaatgacaaactatcatttccgccacatactattgaacaaagaaagtcattagccagcttaggaaaaatagactccaactctggatgggtcaggagtgggtaagctcctggacatgaatgtggagcatgaatatggaggcaggaatataaagagaaatgatgaattggtgtcacttttgaagccagtctattatatagaacacaattcacaagatttcaggacattccagaagcatactggtctagaacgaaagaacttaaatgttttaatactttgttttggggggcagtaaagttacttagagtcagtttgatccttcctactcttgctcttaaaattcattagacaataccagagcagtgtttgaggctatttatactatactattaagacaggaacttctacgtactctaccaaatgctacatgaatgttgacattttctagtgcagcaggtggaaacatgcactattcctggctttgggtgaatgtcaggtattgtttcttctaatcattttggacggttcctttcagccttgggtagttacctcacacccataaactgatctttgcttagtaaaatactcaatggggactctctttagatctttggagttctctctttgtttagcattcttatctctggtactttgtcctgtgaactctagccatcttggtctcccaagactctcaacttcatctcttcagttcaggaagcctgccagtttttttctgttttttcctttcctaaaccacagcatggcaactctctcaagtttgtttcttccctctcggtgattatggttctgtgttgtctaatggccagtttcttcaaacaacaggttttttttttgcatttgttttaagttttgggggtcattttaggcaggaaagtagacttagttcctgttacttcattttggctggaagggaaagtctccagtccttagaatttggtattaggaaacatacagatttctaaaggtcatggacaacctaactgactgaaagaagaagatggtatgcaactatcatattatatttgaaaaaaaaatgtatttctttcctgtttgtccaatttatcattttactctcttttcttctcttcttgggatattcagcatttggtcatagtttggttcttgaatatattttacctttcattatattttttattgtatcatgtgtgtatgtatgtttccttgccaatgattatatatgctctttaaattttgaggatataccttgttctttttttatgttattcaccatgtatataatattttaggatcaatgataatcagttaattactatccttttctgtaacaagagattcaaaatctgaggattaattaggtgacatttacaatgttctgtatagaggaaaactgcaggataagtaatggttcttcagctttcaggttgatgtcaattttgatttcaattttctccacccaaattcagtgccatatgttaggctacaatttctcattagttcaactgcaccctgcttagaagaatactacaagctgacatgacgaatgctttctacacctgtcagagtctacactggctctgttttgtgaggctgtttttccttctctactcagcgaccttgaagtcatgatttatgagatatgaattgaactttaaacatgctagatgagtatactaaaaaagaatacatttgtagaataaacctttatgtctaaagtgagatttcaattaattgtatataatctacccacttcatatattattagtatctgtgaattgccctttgaggctggcttcttccaatcacccttttattagctgctcttctttctctttcctctatttctccattttttcactcaccatctacttcatgaaatggtaaggggagaagttatggaaagtaatgatcatctaacattactatagctaagaataagcatagttagggaggacaaattcctgcaaaaatataatagtatattctaaaaactcagacgtgggtatttcagggaacatctgagaaattactgtccttcattagcatggagaatctataattaattatgtatatagttatttattgtggctgtcaatattataagaattttagtggtttactgcacaactttcttcaaatataatcttgttctacaaacaaaataatttgctgaaaagcagtgaaatatttcaatttaatcactctttattggttaatggtttgaattcagatatttatgcaactgttggttgatgctgtttataagtctaatacaacctttttctaattaaattttatttgtattttcatcattaattgaagtgaaaaataaaatatgtcagtattattagatttcataataatgtgtactattatctatgcttttcatgaaagtaaattgaaaggacttagaaatcaaagtttttggacttttttaaataaaggaatgttaggtacgtatggatagttgttattgttgatattctgtgtacatgactaggtatagttctccctgtttataaaacaaacacatagaaaactttgaaatgtatatgacatatacagaatattatttgcaataaagctaaacaaataacttttacagcagtattcattaactcttaaaatgcaattaagcatgacctcagcttgtagttctaacaacttgatcttttttctatagatttaaggtttaattatttataagaatgtaccatattttgaaatagaagatttttgattcaaagtttcaaatgtatgcacattatattttagttatgtattttaaaggtttttaaaatcaagatgactacagcttattaataaagttttattttatggaaatgactaattttaagaattttgatccctttaaattttgtacaaatctgcataaagttacataaccaatatattttttcatataccttttcagaatacaaatgccaatttgaacatgagaaaaagaacaaatgctttggttcactctgaatctgatgttggcaacagaactgaggtgggaaaccattcaagcaaatcttccacagttgttcaagaatcttctaaaggcacacctcggtcttacttagcttccagtccaaacccattcagccgtgcaaatgcagctgaaaccatatctgcagcaagagcacttccatctgcttctcctacttctatccgaactggatatatgcctcgaaaggcttcagttggatctgcttctactcgtcacgtgtttggatcaagactgcagaggataaagaccacagttaataccataggggctactgggaagttgtcagctactcctcctccatcggctccaccaccttctggatctggcacaagtaaaatagacaaatatgcccgtattctctttccagtcacatttggggcatttaacatggtttattgggttgtttatttatctaaggacactatggagaaatcagaaagtctaatgtaatttcgttgctatagtagtttgctaaaagatgatgaaaatgcagaatgtctttttaaatgtttttaaatataaacaaatattctttactaaaataaaaactctgtgtaatttttccatttaaagatataagccagttattgggagagttaattaattcctgagtgaaaaagtgaactatgttttttttcagaaaaattattttaaaagaactcagcattcagttagatagaatacacaccatcctggaaagttgggataagagaaatagagctattagagacaagtggcgcatattttttcattgatatttgaaaacagactatgacattttaaaaatctgccctatgagtatcaacctgccaccctaaatttcccagtggcactacccttaaccagaattgtttattagatgtcatatgcagtgacctttggtgatcttcttaggaacttcaagaaaaggaattttcctgttaaattaaacattggcaaaaggaaatggaatagtataaacactgatcaatagagtaaaatatctgctgcataaaaaactaagacaaagaccagaggaaatatcttccctttcttatgttggctaaacagtacttaacagttgacttgaaattttgttctctgagccaaagtttaactcattgtatgaattctttttcatggtagttcattcagttatgtgtttatttactacatagttattcagagcctactgtgttccaggaactatgctagaaactgtctctctaggaaagctcttgcacctttatctacaatattacttaaaaagtagaacagtcaatgcatgccaaagaaccataaactagcagaggacattgcattctttagtgaaggacatttatttagagtctgacaacatattcaaaatatttttcagcctctactgatagtggataacaaatatatttgttcacataaccactttgatgtcagtacaacttcagcaattggttttcaaaatagatgagaatatggtacagattgttctataagtgaaaagcattatgtacttgaaagtaaaaatcagggcaatataagacttaatagattaactgtcgcaaatttgatcagagtcacagagtagaatttgatcagaatcacagaatcatcagacataggaactgagcacaggctttttcaggtgctttccccaagatagatctagatattagctagtgaaatgctaaattttgaagagttttgtgtccgtagttctgtaattctgggcagtcatcatgttggtttttttgggagtttttttaaggtttaataactaaggggaatattttaaaattaagagagcagcaaatgaaaggagtaaagaaaaaaatagctgtcgggtaggatgccactgactctgctatgtgatttatcagggttttcatctactgacttctttctcattaggtaggcttaacaacttacttgagaattttgcaactgtctatgcagctgaatctaagtatggttttttgtcatattgcctctagattttcttctgtgcttctctctatctgctctggaatggatgagtgaatgtgttctgggtgttttagggaacatattgatagaaatgaccaccttgcagacaaaatctctctctctctttttgtttttatagaaaagaagtgatagtagttaattggcatcgatttttcagatattgcactaccttataatggttgtttttgatacctgaaaattgtgcaaatgccaaatattaattgtaagtcatatctgagaaatcattcttggctgtctttctaggtattccatagaatcaacacattttaaggctgaaagatactgtcgaaatcacccagtcccaaccccccaatttaaaattgattctagtaaaattaggtccagtaacacctgtatatatgtatatatttaataaagagtacttgtacaaaaaagcttatcataaattatttcatgaatgtgaatagatttctggccttgaggacgatgtttggaaatatggttggaagcacaattcattcgctactagttattcagagcgtactttgttccaggaactatgctggaaactgatagttcactattctgatgaaaaggctggttttgttgttgttgttgttgttgttgttgttgtttttggtgaggaactcttactctttgctaatctattggcctatcttaagaaataattatttggttattcattggcttcctttaaaaaaaagtgttcttctacaaatcttacagagtgtaaagagataaaaagaaatgattttttttcttacctttacatatgaaggtttaaaaatacatcatgtggccaaagaatgagaaaggacagaattaaccaaggattcttaattgttaatttgaagaacacattaaccagaaagcttaaacattattattaaaataaattatttcatttgcacacaatgataataatgatgataataataataataataataataataataataataataataatatgttgtttgctttccttaactgaatttcatcaaattcattcagtgatttttattttggtcattatttctatcttcccaataacccagaggtacatcaagtaaaaacacttttgcaaagagccagtcacttttccctcttagaaaatctcagaagaatgattaggggcacccaaagttctggttatctatgaataataatgaataattttggctgagaatggtacctttatataactcttttaaagatgaaattcagaataattttattcaggacctagtatctgcagtccatgttggccactaactgctacataattactttcaatttcctccaggcatgactaggtataaacatatatttacatgattaatccacattttaaaatgacttgcacttgtgcatatacatagtactttgaataatgtatattttaaattggacctcacaaatcttgtattaaagtaggtagagagtagagtcacactttttttgatgaaatgagtcacagagaagttacatgacaaagataaaatcacagggttggaaagaactttgaaaggtcatttttcaataatctcaccttaaaagtgaccccttttcaaacaaagcataaacaatttatttgtggcttattttacccatgagctggccaatacttcctggcctagaaaaatatctccactctccccattcctgttcttaatggtcttctcttctcaatttgtaaatattctccagtaaaagacaccaggtgtggagatgggtcacttaatttcaagttctgagtgtcttgtggttttaaacaagtctcttaacctctctaagactgattcctcatttataacagggaggaggtggattatgtaatatctaagagcttttcagttttaatactctctgattctcatagtaaatacaagcatactcttgtaagaaaaacactgaatactttgaaccacaaataagtgtttatggacaaaaatttagttctactgcttgattactttaagttcattgcttgcttcaaactaaggtttccctaccttcaaaaatatatataacatctctccatttagataaagtatattcttccccagggaagactgtattctttaaagacagtagaatattggctatttctcttttctgggatttcctgggcttttattcactaaatgggctcctgcccagtttgggtactgtgctgatttttagatatacagagataaaaatagcccctttccttgcaggtagtcacagtccggaagagatgatagatgcatagacaaaaaattatgggatgtaactaatgcttcagtagaatacagcagggccaaaactagagtgatactcatctcaggcacaaatatatatggggacatcaaaacttcaataatcaagatacctaatatttaagtgaatatttttaaaactcaaaattaatgcaaaagatttatgatgaacagaatatacaaattttaaataaattaatagaatcagtagtaataatattttcttctgcctcaggctccaaaattgctcagcatagcactgatctagatagaggtggataaaagatccacataacttaattacattgttgaaggagaggaacaagagtgatagcagagaaggtttcacagatataatcttaagctaaattttatagaatgatttggagttcttatagcctccattcccacttccacaaacaaacaaaaaaatgaaagcgcaattttatcagcacctgaggcaggagaagagatgaggatgtggaaagtcaaggggaactcttactacaaattcttagttctgtgtttggaggtaagggtgaatgcagggaagtgagagttgttgatgttggaaagacctaaagagcctggattaggaagagttttgtgtaaattactgaaggaatggaatttgatcaggattagtggcaatttattaaaaatcttgaagaataatacgatgaaaactaacatccttatttttctgttttagagaaagcacctgattattgtgtgaactatggtttggagggccacaaatctagaggtagtggaacagttgagatctcttattttttctttcctgtcttaaactttgccttctattccttttttctttttttgaccgcaatgacttcattgtcatttgtaaaagtgatacatgactgttaaagatagacattgtagaaacttaaaaacaatctcaaaattctaccacccagaaatcagaaatattttgtatttggatatgtttgtctagaagagtagattgcttgattaaaagacagagttttataaatgtagaagccaatatgacatacatgctgccattaaataataaaaaattaaattgacttttatctcaagataagattaaaattggagggtaaaactgaagaaattgttgaaatttggatggtgcttctttaaagcaagagatttagagagtcagagctttttatcccaggtttcaatctttatttcaggaaaattttctgcaattttgtctaagttaattttttttttttaagaaatgccaattatgtcaaatcccttttgtctctatacaatagtccccaactgttttggcaacaggcacgggtgagggtgggggaatggttttcagatgaaattgttccatctcagatcatcaggcattagtcgattctcataaggagcggacaaccttgcatgccctcctatgagaatctaatgccgccgctaatctgacaggaggcagagctcaggcgataatgctcaatgggtgccactcacctcctgttgtgctgcccaattcctaacaggtcatggataagtactggtcagtggcccaggggttggggaccactgctctgtaactatttacagtattctttgtaactactttggtatctttaaaattttctttaacttttgtcaaccataaccctagtgagttttcagttgtgattattctattttgtaacttccaatgtacttttcaacttcataatggttaattttgttttccattgctttcttggtcactgtcatttcatttttcttctctttctctatttttaccattgctttattgaaatatcttctttgagcttctcatgtttctctattaatgagatcatgtctataatattttttgagactacagagacctatttatataaactcttcctctatttcttgaaaaagtttttatctggcgtgagcttcatctgctttttcattgaggttttatctcccttgcctatttttggggctggtttctttctattaatcactgagcagagccagctatttactgaactacagtgtgggaagtggtgggagggtgagtcagatcagcccacagaagctatttaaatttcaggtttcaagcccacctccccaaaaccgttttatgtgttttttcttctgcccaggcaccatatttttatatctatttttgacatttgggcggcctatgtagttcacagtgtaaaactctctgttttactttctttatgttattgctagtgattattgcttgtagtcccacccccttccccacattagccttagtattctatattattcagcaagcttgttcacaactctcaaatatagtctatcagaatttttatctttacctctacattccactattcggaagtatatagtaaaatcgtatgaagacagattttgtctttttcttgcctgtttacactctatcttacagaggtttcaaacaaaccatctttgtttgaaacatcgcaggataatgatacttattgaaatctacatcctgcccaagatatatgccagtcaatttcctttctcctattagtgcaaatggctacctacttaaaagctgctgactatagtttgtcatcaattacttgttaattacagatatggttttcatttttttttctcaatttttcattatgttatttttggagactgtcttaggtggggagtgaattataaatatttttatttcaccacctttaactgagtcaccatatgttatttgcacttccaatagaccagggattgaccagagtatcttttactgatatgaccaccagagctacatggcttttaccttctgtatatcagatgtcactggaatcaagcattaaacctagattaaatctggattaaaccagctgtatggcaccttagaaaattgagaaggactaggaagctgatagaaagaactcctgtataaaaaataaattctttttacattttccttggtagtatttctgcaagcttctttagtttctataggggaatcccagagttttcctctgagattgcttccctttcctttgtattttcatttttccctcttgggctttacttttcagtcgtgtatttctatcccaatgttaatttattacactgtttatattttcctgtccttcaattcatcagtagattagtgaagtacttattcctttaattataagtataaacgtttttaatttctttttggataacgatacatttaatggaaaatttttaaatgctatggtttcttaatagcttttctctaccactaattacttccgttaaaaaaaaaaagaaatacccatgcgtaatataaaagaaattttgaataaaatgttatcctttccttttactagagacaaacatctccacttcaaaatggaaaaatggaactatgcaaaggaaatttacgatattcaagagtatgatattatcactgaaccgattaatttaattgaaaatactaacctgcaaaaaagaattacacaaatgtatttgaaatgtcatcagatacctcaagctatgacagagttgattatgttacacaagtagtaaaggataaattaaatatattctatattaacactaagatttaaaactaattatagtcttctttaatttttctactgtatacatttcatctagttttcagtaaaacaaacttttcattacttttacttatcccatgcaaatctagttgctataagatataacctaatttggaaatacctccctgtaatacattggaattttggtgtgagtgtgtgtgatcagagaggataaacaaatggtgtcagcaaaatagaatgtaaaatatggagataatgtggatttacacaatttgataaaaattctcccttgaattttgcagatcatatatgaatatcatcatgtgaagtgcaattaggattttttcatatattaatacatatacatcatctctttaataaaatattttgctgaactcgtttaatatttctcatgtctcatatttcatattttctcatatgtctcatattttatattttctcatatgtgtctcatttttattattactatagtatccattaaaggagactggcaaatacctgaacaaagttatgttgttggcaatataagatattaccaattgcataatattatttccaaaggcaaattaatatgcaaactatagatttccatgggtatctatacaaattattacttgaagtccatagaaaacagcttccttagagggaagtaaaagaagctctgataacagacaatgtatagcatttcagttaaagtttgattgacatatttttttctcagtcttttatacttgtgaattatagtctacattttgtctttacagatgttgctaacacagtgcagcatgttggcttgtcattttactgattatgtatattgtctcctagttcaagtatacagtaaatcagagctttcatttttcaaggggcagaaaaataattgttggttgataaggtaaggttatatgattttgagggagcttcattgtaaattgaatgagaatccggttttcatgcaaaggtgtatctatgcgataatactttgaatgtctgtagtttgaaatagaaggttaattttttccactggcttatccttaatgaaggaaatcccctgataattactttgattctgaaaatgttgaaaactccagaagaaataaagcttttctttgatttctcagctgaagtgttgtacaaactgaggaatatgaagtccattcccttctttcttctcttgaataattttaaaattgtttgtttagttgtacaattgaaaatattccttattatagaagtaaaaaaacaataatgcatatttcctcatatcataaaaactaaatttgttatcatctgagcttcaatattcttgctcaattagaatagtaaatataaagtgtgatatttataacagttcaaggtttgataggagatagaggtgttttgattttatgggaaaattacttcctcaagaacacatttcttgaggttttagtaatcacatttgactccctgaaattggcaattttattcaatgtaggaatattatcatggtatattatagtgaggagcacatagtcattattattttgtttttgcaaatttattttgaaaaaaaggagcattatcaaatattggtttactattttaaagtaattcatcaggaaatgattttttaaacactgtccctttaagtaaatgtcccttgcttttcaaagctcaacttattacttatggtaatagagttactttgcttcttaaaacaaagtttatactagagcatagcattgtagaattattcaggtctcaatttctcactggaaaatgagtctttaaaatagtaaggatttaaatttctataaaatttaatcacagatacttatattttaagataaatgtgttggagctaaactctggaattattaaaatataaaacattatatccctctaatgtattttttctatttaaatttaaaacaataaacataaatatctttggaa

SEQ ID NO: 108 - DNA, 144491 bp, Homo sapiens
acactctgggcgcggagcacaatgattggtcactcctattttcgctgagcttttcctcttatttcagttttcttcgagatcaaatctggtttgtagatgtgcttggggagaatgggggcctcttctccaagaagcccggagcctgtcgggccgccggcgcccggtctccccttctgctgcggaggatccctgctggcggttgtggtgctgcttgcgctgccggtggcctggggtgagaggcgggcgggcgtggggaggcgcccgggcggacgaggaacccggggccccgcagagaactcgcgtgcagcgctgagctgcgctgctctgcgcgcccgggtccgaaggcagcgcgatgggtgggctgagcgcgcgacccggcagggcggcgggtgtaggatccttctgcgcactggagaccctcgctgcttctgggtaagcgtggagttcccaggtgcaggggcttaagtcgtgacgagcgcagtggaaggcgcagatgctgagcgggtgccgcacgaaattccttgcctttgtgtattcacagcctcggctggctatagccaagacgtggcgttgatcctagtgaaagggaacttggggatccgacaaacctgagttctggtcctagaaacttaactgtgaggcaacttagcacacctgagtctgtttgctcttctgtaaaatggggacactggtatctctgcatcgtggagttgctgcctcagtggcattaagcctgtcgagtatctaacacagggctatgtgtccccgagtccatttctatcccccaaccgttacctctgtactttgctcccaatggtgtttagacaagcagtcctagggatgcaggtgttacctgacaactgccccgcatggaactgtcctcgccccccacaccaagccaccacggccatcatcaccatgcacttaattgacagcatactttaagacagatgcatgccaggcacttgcggattagaagagcaagggaagccccagaacatgcaatgtaaccgttgcaggtagaagggacagtagatatgtttacagttcgcattttagtgatgtgtttagtacaaaataacgcctattataattattatggaaattttgaggccacatctcttcctttttcttaacttcaaataggtaaacatcttcagttagaacccttctattattatttttcggctccccagaagtcttcttggttgcctagactcactggcaacatctcatttgaagtgacagtcttggttgtttttgtccagcctattcctgacaactccgggttcgcccttctctgccactagacattttacattcattatttgagtgttccttcttctctaaaagagtaaataaaataaaataaagtagaaccaagtcccgcaagagttgttattaatatttgatctccttaggcaccagaaagtaacctgtcaggtgcagagatgtgataaaacgtacaatcttatttttaggagagaagcatgcccagtaagttaagcaatctgttgtcaacgcttaggaatttgtgtcatctttgggagtactggccctcttcttactagaatgttgttttacttagcctatgttgattaagttactgttataaacaatcccagacactattaattgcaaaaaaaaaatttactgaggttatcacaataacttccaaatgtgaaacagcctaaactaaactacctagaaattttgttgctgacataatttaaattttaaaatgctgatggatgcttccagtgtgcacggtcctttggaattttaaagaagtataagagctctgcacccaaagtgtatgcatatagaagtaggtggtggagttttatgaaatctacttattaggaagccagcgttctgctttttccagcctctgctacttaccagctggtgtcttggacccagtaagttaagtcacatcactgaccttcagtgtccacatgtataaaatgagcacaactgacatcctgatctctgagagagacgttttgaaaatcagatggtgtaatgcatgtgacagtgttttgtaatctgaaaacccccatgcatgtctgaaaaaccatgactaagaagtcgtgcaagactgcaggatcaccgaaaagcgagaaatctcaactcctatgatcaggaaaggatgagtgaaaggtatatggctttactagcacttaaagagtgaatctagaaacagattgcatacgacaaaaaatagcagaggagctaggattgttttgttattatgagttactcacagtacccgtaaagtggtatagtgctatttgaaagaggacttagattagctgcaaatagatattgcaaatgtaggacaacccctgaaaaatgtgaaaaaaagaactataatttatatgttaataagtaagagagaattgcatcatataaaatgctcagttaaaacaataaagatggctggggacagtggctcatgcccataatcccagcactttgggaggctgaggtgggtggatcacctcaagtcaggagttcaagaccagcctggccaacatagtgaaaccctgtctctacaaaaacacaaaaattaccagggcatgatggtgggtgcctgtagtcccagctactcgggaggctgaggcatgagaatcgcttgaacctgggaggcggaggttgcagtgagtcgagatcgtgccattgcactccagcctgggtgacagagcgcaactccaaatcaaaaaaaaaaaaaaaagaaacaaacaaacaaaacaaaaaacaataaagggcaggaaaagaatggaagacaaaaaatagaaacagagaacaagagaaaaaaagcaacaaataaaaaccagtaacaaaactaaagcaactatatcaacaatcattttgagtgtcaatgatcgaaatgcaccatttgaaacagatcatcagagtggatcaagaaacaagacccaactatatactgtgtacaacaagaccgttttaaatatagacaatatatatgaaaagtaaatggataaagatataccatgctaatgctagtcacagaaagcaggaatagctgtgttaatttcaaacacagcagacttcagaccaagaaaaattattagggataaagaggggcatcatataatgataaaggggccaattatccaagaagacgtaacaatatcccatatgtatgcacctgatggagagacaaaatacgtgaggcaaaacccatagaactgcaaggagaaatagatggatttactatcatagttggagacttctatgatatctttctgatatcagaaaaggtgctgaagtctccttatcagaaatgggcagattcagcaggcagaaaatccgtaaggacatacttgaattcaacagcaccatcaatccacttgggtataattgacatatatagatgacttcatccacaacagcagagcacatattctcccgcttacattcatggggatagaccacattctgagccataaaatagtacacgaattaagctttaccaggcagtgtttaatatagggtggactctggcgccctcacgtggtcctcatataggatctggtttggttatccctgctaggtaaaggtgcaagatagaagggaagttccaatttgctttctgtgctttgtggtgtattttggtttacatatgctcagatgagtggatgtgtgatttatattatctattttaatctaaaataagcttcacatttggacaggtaacatcaaaagtgtcctacacagaaatgctgggtgaagatcccagtaataaaaccaactccagaaaacaagaaaatggtagagttgacaatccctctcaccctctccgcaaagacacatgtatacacattttttgtcagaggcattaagtagaagaaatgctgtcagtctaatcacaactgatcacaactcgatgaaaccaaaaaacctagaaagtatcatgaagactgtcgaaataagctttacattcactattgtgaacagagagactcaatgtgactgttttttgtcccgttagatgttagctaatgattgtgctaagtcatgatgattaacaaagcatttaaaatatttattttatctgtgttacatttcaaaaatttatattgaggcatataatttatgttcgtgtacatatataatttataaatttatatatttgaaagggcatgctctttttttaaactgatagaggtgcctaagcaaagcaagtgcaaatctattccttaaagggtaagtatgcagaatggaaagcagagtgttctttgggttgacagctcatattgcaacagacatgaaagtgatgatgtgttaattgtgcatatagcacagaatacatcaacttgctttgaatggaatatctgaaccaggagaatgtgaaagtgggctgagtcatacaagacaaaacccgaaatgagataacaatacatacccactagaatgactaaaatgaaaaagattgaccgagccaagtgttggcgataaggtggagtaactggaattataatatactgctatttggcaggtaaaattataacattaactttagaaaatagttcaacagattcttaaaaccttagacacacactcaacattttactcttaggtttttacccaagagaaatgaaatcatatgtccacacaaagacttgtacatgaattttcatagcagttttgtttgtaatagccaacacgtggaaacaatccaaatgtccctcaacaagtaaatggataaactaaattaagatatatttatgcaattgaatattacccagcaactaaaggaaacaatttgtatacatgcagcaacctagatggatctctaattatgctgtgtgaaggctaaaccataaaaaaaaacctgagtgatttcctttatacaataggatataaatgaagtgatttaggttatatgaaattttagaaagtcaaatcaatctgtagtaagagaaaaccacctgagttatttcctttatatgataggatataaacgaagtgattcgggttatatgaaattttagaaagtcagatcaatctgtagtaagagaaaacacattgaaggttgcctagagaaggaagtggatgtttggatggattacagaagggcatgagggaactctgtgtgggtgggatgtatgatggaaacgtttattgtcttcattttggtgatggtttcacaacgcatacatatgttataagtaatcgaattgtacacttcaaatactcatcaatcattgtatgtaatatatcttgataaagctataaaaacttttaaaattatggtaggtcttcagtttgtggattttatattaatatatttgtcataggaactagtcacaattgagggattggtaataaaggagagaaaggaaactacatcaagctttctttgttgaaggctcatatattccttttttgagctattatacaactttgctttttataattacctatactattcatatactactatgcaggtaagaatattatgtaattaaggggaaggaacttctttccaagaatggttcattcaatttgctttgttactttaggtctcattccttcctctcgttgcaagctttgctgtgacatttaccctctctcaatacagcttttggcgctaggcacttcacatggaatctcttcctttgtccggcatcaatggataagacaaatatcaaaattgtatttcatcccacatatcaactagaggaaaggtgaatgcataacactgaaaataacagcaactgttttactcagtgttttttttttttacagtatcctcaaagtgctgttatctatcaaaatcagctgtgaaaatttttaaaaatagactcctgggccctaacctagacccactaaatcagagatttgggggacatagcttggattcttgatttttttgagttttataagtaattcttcattttttgttcattgcaacaaatatgcattgagttcttataattgagtgttaagcaccaggactaagtattaatttagaggtacaaaaaaacacatcatctcttgcctttaaattatgcatatctaatatctattgagagaaatagatacttctaaaagcacacaaagataaaaagcacaaattgtaataacaaacaattattgatatgaaaggaaaagcaaagtgtcggactagaaattattatagggtggggcagagggaagtagtttagattccaaatccctaagagggtcagggaaggcttcagatgagattgggtgtgttcagggtggtatggccataggcaggctggggaaggcttctataagaaagtgacattttagcagatgcctgaaggaagaattgaagtcagagtgaagataaaattgcgtcacatagaaggaatgtcatagacgggaaaaatgtgtgtctttgggaaactgaaaaaggggaaagggccacaccttggtgaggggaccaagtggcacaagatgaggcagggaacatagacaagggcttccttgcttaacaactgctggcttaataaagcaaatgtgtgatgatggatacaggctgtctgggaaaaataagtaagaaatatgagctttcttggagcatcatcctttgcttcagtagaaagcacagagttaggcttccaattctgactaaagccattgacaacagggaaaaggcaaccttaggaattctcctctctgtccggggtcccgtgggcactatgatggagctcatgagatgcagatgagaagtcccaggctgaatccggggcacattcactcaggagagctgaggtcaccagtcactgaggtcatccagtgcattcccgacagcataggctcattccaagctagttctgcaaaggagcagaaaatgaactcttggaagcaaagcaagcactcccactttagcggaataatcgaatttaactcttagaagtccccttacccttttctaagggtaataatcgtaagtataatttatgaagtgccttctgtgtatgtggcagcatatactacttttgattctccctgcaaacctggtaggaaaatattattccctttatgaagatgaaactgaggctcagcaagattaagcggtttgcctaagacctcatagccactaagtagaagacattgggttcaagattcaatctatgaacccaacatttttaatactatataccattctctttttgtattaatttcctattgctgctgtaacaaatttccacaaacttagtggcttaagacaacagaaatgtattctcttccagttctggaggctgacgtctaaaatagatccatagggctgtgttccttgtggaggctccaggggagcaggggttttcttgctctttccagcttccaggggctgcttccgtcctttggctcttggcctccttcctctaccttccaaaccagcaccatagtgtctctgaatatccttcttctgtctcctttcaccctcttgcctcccttttataaggacccttgtgatcacatttaaggtccacctagataacccaggataatctgcccatctcaagattcttaatcacatctgcaaagccctttaaccattacaggtaacaatcacaggcttcagggatcagaacatggatatctctgagaggtccttacttagcctaccacacctttccatatagattctcaaaattttagctgagcctaataagggagttcattaccattagggtccggtttagtagcaagtgcttcctttaagtgaaaaggtgaaagttgtccacttaataaggaaagaaaaacattgtatgttgaagttgctaagacctaaggtaagaaggaatcttctatcgatgaaattgtgaagaaggaaaaataaatttgtgctagttttgctgtcacacttcaaactgcaaaagttacaaccacagtgcatgctaagtgcttagctaagaggggaaaggcattaaatttgtgggcggaagaggtgaacagaaatgtgttctaattgacagctgtcaggtttggtactatctgaggttttgggtatcggctaatgtcttggaacatgtcccccaaagataagtgggtgactactgtatattcaaaataagcatttatatactggggagtaaatctcccatgttatttgtgttttatttgtcccacaaataaagtaaacaaagtagaattttaggcaagattcatttctagaggcagagatattttattataataaagaaggttgctctaccataaaatatagcaatttaaatttttataatcctaataacctcaaaatatataaaataaaagatggacaacattataaaaagaaatagacaaatgtacaataaataaaatattttaacacaactcattatctagtaagacaagtactccccccaaaatcagtaaagtatctagaagatttgaataaatattaacagattggattcactgaccttgttacaagaaagaattatacatgatgataggagagaggaagccacagcacaggcacttactgattaactaaattttgaagctgtgaaatgcaccttatcctttagtgaaagatgatataaatagcttagttgccttcaaactggcagagactttttgaatggatggatgctgattttttaaaaaggagcccatttctgaggcatcttttaaagcaggggtcctcaacccctgggccatagactgatactgtccagtggcctgttaggaaatgggcagaacagtaggaggtgagcagccaagcattactgcctgagctccacctcctgtcagattagtggcagcattagattctcataggagcagaaaccctattgtgaactgtgcatatgagggatctaggttgcatgctccctatgagaatctaatgactgatgatctgagtggaacagttccatctcaaaaccatttccctgcaccctccattcacggaaaaattgtcttccacaaaaccagtcccaggtgctaaaaagggactactgttgtaaaggaataagtccctttgctattattatttttattaagatggaatcttgctctgtcacccaggctggagtgcagtggcacagtcttggctcactgcaacatctgcctcctgggttcaagcaattctcctgcctcagcctcccaagtagctgtgcacaggcatgtgtacaggcaagtgcaatcatgctctgctaactttttgtattttgggagaggcagtgtttcaccatgttggccagcctggtctcaaactcctgacctcaagtgatccacccaccttggcctctgaaagtgctgaaattacaggcatgagccaccactcctgcaccccttggctattattgaagtgttctttttcttttttgatcacatctatgaagtatattggagagaaagagaaggtagaatgggaatttcaacagggtcacggtggctcactcctgtaatcccaacactttgggaggccaaagtgggtagatgacctgaggtcaggagtcgagaccagcctggccaacatggtaaaaccccatctctactaaaaatacgaaaattagccaggtgtggtggtgggcacctgtaatcccagctactcaggaagctgaggtaaggacaattgcttgaacccaagaggcggaggttgcagtgagccaagatagcgccactgcactccagcctgggtgatggagccagtctccgtctcaaaaaagaaaaaaaaaagtatggtaatttctccattaactttgatgcttctatggtcttgatctccaggtcaatgcaatgccccagaatggcttccatttgccaggcctaccaacctaactgatgaatttgagtttcccattgggacatatctgaactatgaatgccgccctggttattccggaagaccgttttctatcatctgcctaaaaaactcagtctggactggtgctaaggacaggtgcagacgtaagtaactctggagtgggaacccccctgttagtcaaacatctgtaagatctgattcaatttgttcaaattttgtaactgagttgcatatgacaattagtttgccaaggtgcaatacatatgagaattattcttgtagatcataccttgttactgctttgagttcctggcgccttcattaaaagtttatttcatgagaaacagtcattgcaggacatgattgagggaaaatccccattcactgggggtctcccattttcatgactaaaattaagtaatgaatgacttgggacaagaaagagaagtggattaaataactaaaagatgtgacaatcttgggctttgagatctttggattataccagttgaattgaattacagataataacaaagtttacatttttctgggaggcataatatggggatgaaacagatctgaaaggaaagttttttttgaaagggagctgatcctgaggcagtctggtgagtttcctcaaggtagcaaaatctgtggaaccatcagaactgcgtgtgttcctcagtaagctacaggcaggttgagaccttatgtactaaaaaaagtttttagtttactctacttggctccaaaattctgtttctttcctgtaggtaaatcatgtcgtaatcctccagatcctgtgaatggcatggtgcatgtgatcaaaggcatccagttcggatcccaaattaaatattcttgtactaaagggtgagttggcatctcttgaaccaacatctcttggttcaagagttctaacacagccttactaccttctagtcacatgtcagaaaggacaactaaactattaccatctgctctttaacggcttcaacacagatgtttagctcctgactgaaatgagcaaaggtatgacaagatcgggggaaaatcatctgtatccttgctggaaaccaaggcagagcatatatgaaaagtgtggcattcattgggtgggaaggaagaaaatgggggaagagtatagtcaaagcacacaaacagccttaacgcagaggggacattgctggaagaaagggaaggccattgagtaactgtgtgagagaaatcttaacggtcatagcacaagtagtttgctagggctgctgtaacagagtactccaaaacgggtggcttaacacaaatgaagtttttaaaattctgttccggaggctgaaagtgcaaaatcaaggtgttggcagagccatgctcccctctaaaacctgtaaggatggatccttctttgcttcttccagcttctggagccccaggccttccttggcgtgtggcagcagaactcccgtttctgtctctgtcctcacatggccgtcttccctctgggtctgtgtcctcacatgctgttttcctgtctgtgtatggctgtgtcgaaagtgctctcttttaataaggacaccaatcataatggattagcgcccacactaacgacctcatcttaactggattgcctctccaaagaccatatttccaaataagatcacattaataagcactggggattaagacatcaatatatttcggggtaagggggacacaattctcattcattgctggtaggaatgcaaaatggtaccatgacttggaaagataatttggcagttttttataaaactaaacatactcttaccatgttatccagcagttatccttcttggcatttatccaaaggaattgaaaactcatgttcacaccaaaaaaaaaagaaatctgcacacagatgtttataacagctttattcataattgccaaaacttggaagcaatcaagatgtcctttagcaagggaatggataaactgtggtacatccatacaatagaatattattcaataccaaaaagaaatgagctatcaagccatgaagagacatagaggaaccttaaatagtgaaccttttttcaccatcactaagtgaaagaagccaatctgaaaaggctacataacatatgattccaactatatgccattctggaaaaggcaaaactatggagacagtgaaaatatcagtggttgtcaggggttagggaagaaggggatgaatcggaagagcacagaggattttgagggtagtgaaactactctgtatgatgccataacagtaggtacatgtcataataaatttatccgaagtcatatagtgtacaataccaagagtggaccctaacataaactatggacttggggtggccatgatgtgtcagtgtaggttcctcaattgcgaaaaacgtaccaccctggtgaaagatgtttataataggggaggttatccatgtataggggcagggagtacataggaaatctctgtatcttctgttcattattgctgtgaaccaaaaactgtgctaaaacacaaagtctattttttaaaactgcatagacataaatacatgggcatatgtgcataaacagacacgcacacaaataagtgcaggtaaaacaggaaatttgaacaaaatctgtggattataactgtttcaatatcttaatgttgatgttgcactattgttttgcaaaatgttattattaggggaaaattgagtaaatagtacctgggatctctctgtactattccctgcatgtgaatctgattatctcaaagtaaaaagttttttttttttttaaagttcctactaaatttccaaggggatgggcttcccctcagatcactaccccttttcagggagcaataaagtaatcttccttggaatgtagcaatctgtaaccaatcaaaatgctgtaactatgcatggtcccatatggaaaatataatcctgctaaaatttctctgtctctgcctatgtaagtgataccttatgtcctccactttggagtgctgaccccattcatttggagttggtctcttccaggtggctacccttaacctttgtgctcaaataaactctatccttaaatatattttctgaatctcattatttaaggttgaaaatgtgctaacctaaataattcacaggatttgttttttattctcattttttcctaacctatccacctggttcaaggcacatagattaagaaggaaaatggaaatgggactaatatcccaggcttcactgtccctcttcggggccctggggaggagactcccaaaagtctagacatgttcacccacatcctgtatgtggtttctggaaacgaaatgatcatggcttttcctgaaccatggcttaactttgtgaatccacaactctctcttccccaggagatccaaaaaggtagggtaggatgtaaaggcttcaatctgttcaagtggatatgagactccctggctccccttacaataagtagcatggattttgtctctctgccttacttcctccaaacattctgaatgagaagtgttcaaaccactatttgttcaattgcttaatctactttgggacacaagtttaataaattaaaatattcttctatctgttccccttgatcagtgaacataaagttatcttttgactcatatttaaaatgttcagtattacaacactgaacaatagtatggaggaaaaaaaatgccaacttaagtttgaacttgcttcaccattcctatcccaacccccatgattagaaaatcaaaaagaacactttgagaaataacctcagtggggtcaaaagccagaggagcctccaggatcccttgttcctaagacaaacaggcaggaggaggtgcacatataggattgcagctgttcttcacttcatttgttcacatacttcatacttgtgtttatgtctgttggcagtgcaatagaaaatgatttcatttttggtggtatactagaaggcattaaaaaacaaaataaggccgggtgtgctggctgtaatcccagcactttgggaggctgaggtgggtggattacctgaagtcaggaattcaagaccagcctggtcaatgtggtgaagcctgtttctactaaaaatgcaaaaatcagccgagtgtggtggcaggcacctgtagtcccagcagctaaggaggctgaggcaggagaatctcttgaatccgggaggtggaggttgcagtgagccaagatcgcaccattgcactccagccttggcgacaagagtgaaaatctgtctcaaaaaaaaagaacaacaacaacagcaacaacaaaaatcccaaatgatattgaagtcattaataattacatcataatcactagtataatgtaatagtgcatcaagtatcttcaaaagcacccactgttctctcactatttatttgatcttcatttgtcactgttttgttgtttgaataaagctttatgttgccaggttttcttacatactcataaagcaaagttctcagctataccaataaccatgactgttatttgacattgcttcattccttcatgtatagtactatcaagtttgaccctaccctcactatgactagtttcacccaaccatctatcacaacagagagtctaacgtgaagtaaaataaatgtcataaattattccaaatttatggcacactgtgaacagtttgagacatactaattgagaattgctgactttagtattttaagtataaaatgagtgttcaattctttttgatcagcctggatttcctttggttctagttatgtatccccttccttccttccttccttctttccttccttccttccttcctccctcccttccttcctttccttctttccttctttgctttctttctttcctttttactttcttttttttttttgatacaatgtcttgctttgttgcccaggctggagtgcagtggcatgatcagcactcactgcagcctcaacctccctgactcaagcgatcttcatgcctcagcctcctgagtagctaggactacaggaatgtgccaccacgcctggcttttttataaattttttgtacagacagcttctcactatattgcccaggctggtctcgaactcctgagctcaagcaatcctcttgcctcagccccccaaagtgctggaattacaggggtgagccactgtgaagggcctaatttggccttctttaatgaatcttattgataaaagcccatccatgcatccatgcatccatacttttaaggcaaagaaatacatacaacaggactgtatacacacatatacatgtatatatatgacagcttccctgcactcaagaactttgtgctatcttttaaaaaatgaaatttataggaaaaactacaattcatcttagatttgcataaaaaagtgtcataaggtaataaagaagagaaagctcatccaattgagaatgtatgaaaaagaaagtcaaaaagtcccaagaagaatgtgaaacttgggaaagtgatagatagtcctttgatgagtgtaaaaagtccctctgaatcctataagagtgtaatctctggaagtagtaatttaattgggtagttgacctgtgtctttagaatgtaacattccttattttttgcctctagataccgactcattggttcctcgtctgccacatgcatcatctcaggtgatactgtcatttgggataatgaaacacctatttgtgacagtgagttgaaatatcccttcctatttcttttaccgacacattctaatttttctctggaataataaaaatcttaactgaattccttctgtgcaatctgtccttcacacggctgaagactgcggtaatgttctcgaatattcctatggggttcctggcaactctttctttaagttcttccttatcctgggatgtgtcttttctaattccagaagtttaaatacataaaagccttcaaacttgattttacttcaataaacgtgaaattatgttgtttctaccacctccagtataataatcatcttgcttggcaaatcagtaaagatttttaaaattgatactcttcaaggttagcgaagctgtggaagaacctggactctcatgtaccacgagatcaacacatcctcttgaaaggccccatgcactataaacctcagaagtgaacatatattttaacctacttcttaaaatttatacttaggaaataatcacacactttttaaagtagtttggtataaacttttcattgcagcattatttatattagttaaaatgttagagtaacctaaatattttaaactatggtttggaaataatctactagtaggaaaaagatgtgttcaaatgaccattataaagaattccctaagaaacataaaacagctatgcagaatgaaaataagtatatccatacactggcatggtattcagccataaaaaatgacagcataaagaagcacttaatgactagaaagagatgtattttatgtggaaaaagaatcagatgaatggcatatatggcaagatctcactttattaaaaaataatacacctatgtagtgagggccaggctgaggctgagagaaatacagtgtataacatctttgtcttactcttctctttggataactggactcctttacttttcttcttggtatttaaaaatgttacttttactagaaagtttaagagcttcagaatctaagtttacaaatgacattggtcacacatttattgctgtttatccactttaagaaacagttttgctattttgtaaaacaaattgggaaaccttccatcttatttgaaatctgtaataaacatggaattggaataggaattttcctggaaatatgaaaaagattagtaaaatagagaaaacaaaaaatataataatacacctatacctgtatttattttttatctctgtttctacttctgtaacctctctgtatccaaatcctggtaaatggcctcaagtcttcttggaaaaggctaggggaagatttacaatacatgcttttgattgtgtagcatggtgcttcctcaagagaatccagtctcccatccgttggtgctgctctgggtctataaactattcaagtctaggaattgttgatgaacaatgaacttcttttgcaataattcaagtcagacttctattcacttgacctaaaactcttacacttatacaaatcaagtaacactttagtcggctatccgtctactttggttttagagactccatgatcaattagcccaataacaatgtcctcttcaatcaaatcattctgattgctgtttcagctcaaatatgcattacaagaacccccattgtctctggcaattaagtgctgccactgggactctgccaccctgaggtcctttggtccccaagtgaattcagagaatccagttcaatggcaacagttcccattgtcattcctggcctacagagaatgaaccgttgcagaggatgctgaaactccccatgtgaatgtatttctcaagcctctggtaaaaggtctgtcttctgaaccctctactcctgcactgtgcctcaccagctctatccaaggatacaactttcagagtggaatggctgttgcttaacttctgcctctcaaatatcaggctaatttctcatgctataaccctagtccagaaccgtacagagaaagtaagtctggaaaacttaattccaaattggcctggttgacatggtgccaaaccaccaaataattataattttatttaactctttgtcttcttttctttctttccttccctccctccctcctttcctccctccctccctccctccctccctcccttccttccttccttccttctttccttccttccttccttccttccctctttccttattttctttcttctttaccacgctggctaggaccaccagtataacattgaacattggtagcaatagatgtcatccttgtcttgttccacatctcaaagttaaagtttaaaacatttcaccattaagctggtgtttactgtaggcttttggtagataaccatttttgaaataaggaaattatcttatatattcttcattgctaaaaaatttatgtctttgaatcatgttgaagtttatcaaacactttagttacatatattgatgtaatcatatctgtttctctttttctgttaatgcaacaaattgttttgagtacatttttgaaaggcaaatgattttaaatttcaattttacattcttaaaataaatcaactcagtcataatatttaatcatttttatatatggcaaatatgcttttatgatatattttagatgtttctattaaaatataattcatgtatcataaaagttacctttttaaattatacaatttagtggtgtttagtatattcacaaagttgtgtgttatggtctgaacgtttgagtccaccccaaatccatatgttgaaatccttacccctaaagtgatgacattaggaagtgaggcctttgaaagatgattagggcatgagagcagagccatcacgaatgggattagcgtcctaataaaagaggcccggaagagctcctttggccctcccaccatgggaggagatgctgaatctgccagtgttggtcttgaactccccagcctccaaaactacaagaaataaatttctgttgtgtacaagctaaccagtttatagtattttgttatagcagcccaaatagactaagacattgggcaaccagcaccgccaattaattctagaacactttcatcatcccattcctaacatattttagagataagactataattttctttcttgtaatgtccttaataagattttgatatcaaagctatgacagtcttataaagccagctggtagtgtttcatatatttgtttccttgtaagggtttatataagattggcattatttcttctttaaaaataattcaccagaaaaggtatgtggcctggagtttacgttcttgggaagtttttttttttccaaccattttcctgtaccatgtagacttttggctgaagtataacatatatatatatatacacacacacacacacacacacacacacacacatatatacatatatacttatatgtatatatgtatatatacgtatatacgtatgcatacgtgtatgtatatgtgtatatatgtacgtatatatacatacgtacgtatatatacgtgtatacgtatatatacatatacatatataggtatatacatatatacgtatatatacatatacatatataggtatatacatatatatacgtatatatacatatacatatataggtatatacgtatacgtatacatatataggtatatgtatacatatatacacactatatatatatacacatatatatagtgtgtatatatgcacacatcttaatcatgcagttcaatggagttttacaaagtaaatgtatccatgtaaacgtcactcagattaagatatagaacattatcagcaccccagaagccttcccgatgccctttcccagttatcttcccaaagaaaccactattctgatttataacactaatagttttgttgcttcctaaattttatattaaaggaatcaaaaaatagatactcttttgtgtccagcttcatctcaatgttatatttggaagagtcatttttgtttttgcaggaaggattgttgggtcttctttattattatgttgtatttcattgatgatcttgagtaccttttcacgtttgtgaagtgctattccaaacttttgcctattatttattagtttgtctattgttttgtagaagttctttaaatattctcatgttttctaataaatgtaacacaaatattgtctttcaggctgtggcttttcttttttccttcttaatgatgtcttttgtttatgaaagttctacattttaataatattcaatttaggagtcttcttttttccagttactgctttttctattctacttaagcaattgggccaagtgaggtggctcatgtctataatcccagcattttggaaggccaaggcaggaggattgcttgaagccaggagttcaagaccagcctgggcagcagagtgagaccctgtctctacaaaaaaaataaatatataaaattagctgggctcagtggcacatgcctgtagtcccagctacttgggaggctgaggtgggaggatcccttgagcacagaggttcaaggcttcagtgagttatgatggtgccactgcactccagcctaggtgacaaagccctgtttcttatggatgggcaatagatctaatatcatctattaaaaagactattccttgcatagtgcaatgcgacaccaccatgaccataagtcaggtgaccttatgagtggatctcattccagagaggttctgtttcactggtttatttgccatactataagcactacattaagattttaattactatagcattacattaagatttgatatctggtagcatatatctcctaactatgtgcatcttcaagatttacttggtgattcttggccctttgcattaccatataaaatttagaatcagcttgtcaatttccacataaagaatcctacttgaatttgtattaagtttctgttgactcagtagatcaatttgtggacaagtaacaaatttacagttttgaagtttaaatttatgaatatgatatatcctcccattttgaagtcttctttaatttcttttaataatatttgttaatgtacattatagaagtcatgtacctatttcattatctttattctgacatattatttttaaaatttcattctttaattatttacttcttagatatgcacctgtttcatctcagctccagcaaatttgttaaatttacttataaattgaatagtttatctgtagattcttttgaatttgctgtgtaattatgtcatctatgaatctgacaaagtttttacatcttttcctttcttatgtcttttgtttatttctcttgctttattgcattggctagaacctccagtacaatattgaatagaagacatgatacaaggcttttaatagtcctcataaatcatgatgtatgctgtagatttttgcatgatatcctttattagattaaggaaactcccctttctttctaattactaaaagatttatgaatgttctttctaattgatcactgcatgtattgagattatcatgtttctttttcactctgttaatgtaatatattacattgattgatgtttaaaagacaaacgctgaattcctagaataaacctatgttgcttgtgatgtgttatagatgattatcctatgtatgggggatatgcgtgtgtgtgtgtgcaggattgctcatatttttattgtaacattgtaacattgatttaatatttaaaatcagtcaaggtaaacctcactttgatcattgtatcatcctttggaaatattgctggattcagtttcataatattttgttcagaaaatttgcatttatattctcaagagatcttgggttataatttgcttttattttaatgtccttatcaggtttgggcatcaagattatgttggcctgataaaatgtgttaaaaattatttattttttctagtgtctggaacaatttgtgtaacattatttttccttatatgtttggaagaattcagcagtgaagcaatctggacctgagggtttgttgttgttgttgtcaggatttaatatctttaatagctgtaaaactattattttatatcttattgaattagtttgggtaagttatatttttcaaggaatttactcattttatttagatttcctaggttatcagcataatgctgtttattatagtctcatattagcctttggatgcctgtaagttctgtagtgatacccttacactcattaatttctgatattggtaatttcttttgcttctttttccttgattagttttaccggggctttatcaattttactaagcttttcagaaaaacaacttttaactttcttgttttttctttagtttatgactattttctcttttattgatttctgctttaagctttgtgtattcctccagtcctaaattcttgatactaattaatttgtttccaacctttatttttctaatatgtacatttaacctatcaatttttctctaaaactgttttatttatttccaacaatctttatatttttattatcattgtacataaaagctttctaatttcacttttaatatctcctctgacccataggctgtttagaagggcattgcttaatttctaaatatttagagatcttctagttatcattctttcattaatttaatcatttgagacatggtttattgcccagaatatggacgattttggtaaaatgttacatatgcacttgaatgtacagttattttgcttcattttctagaaatgtcatttaggaaaatgtggtttagaacagtctttttttccccctccacttgttctctcagttatggagaagcatgtgtaaaatatctgtattagtttcccagggctgctgtaacaaattaccacaaacttagtggcttcaaagaagagaaatttactctcttaacagtttggaggccagaaatccagttaagatgtcaataggattggttccatctgcaagctgttctgtgcctctctccaggcttccttccagtggctgctggcaatcgttgatgttccttggcttgtagatgcatcatttccttctctgtctccatcttctcatcgccttctcctctgtgtgtgtcctttgctcttctgtctcctataaagacactggacatggatttagaggccaccctggcaatccagaatggtcacagctcgagatcattaacgtgattgtatctacaaagactctccaaactgggtcatattcacaggtttcagagatcaggacacagatattttttaaggaggacagtggttattcaacccattacaatccccaactacaactatgaatttgtctgtctttcctctttgttctagcaatttttactttatgtattttaaacatgttattaaatgcatgaaatttttggtttattctttctgctgaattgactattttatcataatgaaatgtctctctttacctctcataatacttcttaccttaaaatctactttgcatattaatacagctatataagctttctttattgtttttatattatatgtgttttaaatcttttactttcagcccttctttgtcttatatttaaagcttgtctcttataaacatcatatagtaaggttttgttgttttattcagtcttagttgttcattggtgtgtttggaacattaaaatttaataataaaaattaaaaataaataaatttaatatagttactgatataaagtctaagtcttggtatttgtttcatgtgtttgttcctttattcctcatttctcacattttttaattcatcaagtatttttattattctatttccccagtagcttttaagttatattccattttttattcttaaatgactactctagagatagacatccttgatttactatagtctgctaaaattgtacttttaccactctccaaacaacgcaagtaccgaaactattaatagttaattccatttatgtcctccccctctttttgtattgttgccatacgttttgcaaaaagaaaagcttcagctgaattaaatttaaaagagtttaattgagcaatgaacgattcgcaaatcaggcagcctcccgagccaaagtaagcgcagagactccagcccagctgcaatgggggaagaggatttaccgacagaaaaaggaaactgacgtacagaaaacagaagtgaggtacagaaacagccgattggttatagctcagcgtttgccttatttgaaaacagttcaaacagttggccacatttgattggccaaaactcggtgattggcgtaagagtagtctgcggtctgtttacatcttcacttgttatagtttgcagtttacagagaaacctttaggctgagcttaaactacgtaaggctttaggctaaacttgatttaacgatttacatatattctatatttcaaagacactgttgtctttataaaaacagtatttatttatatttacaccttagtgaattcttagaatttttatgttgcctcagcatccatttagaatatgtttagctttctcatgccagaagcagggcttagtcacccttaatgccctttctagttctgtacctcctcccaattttgcaacgtggtcgagccagatatctgccttatacaactgcctcctggtgaccacctctctatgggacagctagataaaacctacttgactagcgtccctgacctctgtgccctgcatggacttcgcagatatgctgccgtgaccacctctcagtcgcagcacgactgcctggaacatgtgcctgctttctttaaactcaccaattagaactccccatgggagataccttggcttgtagatgcaagatgctgggtcatactctggtccccaataaaggcattggctgatgggtccccttctctctgtctgtctcctcgcgctgaccaacctctgtgtgatcttcaggcgtgccatacccccagcccgtaataaaatctttactgccatcttgtgtttcttgtaatgactgaagaggttttctctatcataaagatcctaaatgaaaacatacccgcatatgagctctttctggtgtgtttccttcttattgcaattctgtcaattctatatgaaactattttccttcagcctgaaaaagtctctttggcatttttgtattgtagagcttctgacaacaaattctttaaacatttttctaagtgtggttcctctgaaggttattgtccatgtttcctggctgcttttaaaatggattacactttaaaacagattttttacaatattattgtgttgtgtctaggtaagaatttctttgtattgcttgggtttgcacatttttttttttttggttgtttttttttttttttttttttttttgacagaatttcactcttatcacctgggctggagtgcagtggtgggatatctcggctcactgcaacctccgcctccggggttcaagttatcctcccacttcagccttccaagtagctgcaattacaggcctgtgcctccatgcctggctaatttttacccttttagtagagatgggttttcaccatgttgaccaggctggtctcaaactcctgacaagaggtgatctgcccacctcggcctcccaaactgctgggattacaggcatgagccaccgtgccaggcctgtatagccttttgaacctgtaatttaatgatgtcttgcatcagtcttggaaaattctcagttattaattcttcaaatgttgtttatgctcagttctctctctcttctcatcgagggacttcagttaaacatgctaggctttattcttctatgtatttagtctgtattttttaatctttttatatattggtgcttggttttgagtattttcttctgtcctagcttccggttcattgattttctttcagagtctaacctgctattaatctcacacaaattcttaatttcagcaatcatattttacttttacaattctagactttttattttccaaatctgccctcttccttttttttttttttttttttttttttgagacagggtctcactttgttgcccaggttggagcacagtagcataatcatagctcactgcagcctcaaccttcacaggctcaagcaattctcccacctcagccacctgagtagctgggaatgcaggtgtgcaccaccacacctacacatctggataatatatatatatatatatatgtatatatacttttttttttttgtcgagacagggtttcgccatgttgcccaggctggtctcaaactcctgagctcaaacgatccactctcctcagcctcccatagcgttagaattacaggcgtgagccaccacatcccaccctgttctttttaatagtttctagttcttacaagtttcaattatacccttgaacaggtctgtagttctaatgggtcagtttctgtcatcagtaattgtgtgtgttattttatctctccaaatatctggttatctttgattgtgtatcaggaattctatttgaaaactgtgtctgtagaaataatttcaaggccttagataacccatcttcttccagatggaatttttgtcattgtttctgcaggcatctggggacattagcaatctaggaccactctaattcagtctcaggaactgtgattttccagggccacccacagtaccagtacttgaagtactagttccagtctctgagacagcaaatttattttcagttaaccctgattaccagggcctagttcttgtggcctcagaacacatcagaaggtattaccaggccttccatttggggcaggccctggacttccattgttgtcccttaacttcatgagaaaatcaaaagtctgttcagcctctcagttgccccgtcctgattcagctgcccattcccaaacaataagcagcccagttgccaagcccaaatacccagctctcaactggattctcatcttctcctagatcatggcccaggaatgcttcactagtttgttagctttctgatgctttaacagataaatatttttaattctccagtatttctagcctttcttgagggtggatggttggagcaatattttatttgaactgttgagattactattagtagaagcagagcctgaaaaatttttatttttaattttaattcattcatttctaaatttatccaattaaattcactcagttttaatttcaagtgttttgggatttgggttgaagaaattttgttctagtttatagcaacacagtatactatgtactactgctatactttaaaatgtatttaggggtttttgtggactaatatatgatcacttttacacagatatcatcttatgatatcaaacttagatttgatgaaatgagttggtaagcttcatatcttttatatgttgtgaaaccttgaaattacatttggaagtatatttttgaatgaattttggtaatttgtatttccatttatatcatttagattttcaaaatatttaaccccctgtagtctacagttttataaatattctcatatacataaaaatatgtttaaattctttttcctactgtgtatatttgtgttttctctcatcccttatactttatcttttagcaaatgtttttgtattttatttttctaaaaaagctaaccttggttaataacaaaaatggaaattaagaaagcaaacggaaaagagtaggagaaaactgtataaatactataacactatgatcaaagagctatttaaaatgaaaagaatgtggattgagttaatacatgcatgcaaatactataggaaatcatatcagtaagaaaggcaggacacatcatattatgcccattgaagctacaactttataaaaatgtacctatgtgttagcaaagattaaaagcaaataatgaatgtaaaaatagctatagtttagtgactcatgagatttctgtcattcattatttaaactgactgttatttatcctgctcttcctttttccaggaattccttgtgggctaccccccaccatcaccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccaggggtgagtctgactgaggcctagaagggccctgccagtgacatgcgttgctgttggatcaggagattagtatttgttcagggggagggatgtgtgctgagcagggtcgaggagcaaattttctaggtagtgaacatgaaattcagaaggtgtgtgtacatgcacatgtgctgaaattgcgaagcaaagctcaacctgggcaagggatatgatgtttctttggggttcttataaacagatctatcaattacctttgagtataataatggttgatacaaaatgagtgattcctctggccgggcactataatacaggctacatgtgaattttaatccttaaaacaaagttattaggtagttaccagttgttctatgtttgtctgtattgttttgcttgagatactgtcttgatctgtcactcacgttgaactgctgtggtgccatcatgacttacttcaacctccgcctctctggctcaagcaagtctcctgcctgagcctcccaagtagctgggaatataggtgcatgccaccatgcctggataagttttttatatattttttgtagggatagagtctcaccatgttgcccaggctggtctcgaactcctcagctcaagcaattcacccaccttggcctcccaaagtgctgggattataggcatgagccaccgtgcccggcctctatgttttatagagaatatgtgccttagacacatcagataacattctgagacagtaacttgcagacaaaactggattgcaagtccacctcactccagagccttggctttgctcatcagcattcagtcatgaaatcaaaacttactctagatactttcaaggagggagggatttcatgcaggttgtattagtctgttctcacattcctataaaaaactacttgagcctgggtaatttataaagaaaagatgcttacttgactcagagttctgtaggctgtacaggaggcatggctagggacccctcaggaaagttacaatcatggtggaaggtaaagaggaagcacgcatatcttcatatgcttggcaggagagagagagagagcaaggcagaggtgctacacactttggaacaagcagatctcgagagaactctatcacaagacagcactagggtgatggtgctcaaccataagaaaccacctccatgatccagtcacttcccaccaggctccttctccaacactgggaattaccatttgacatgagatttgggaggggacatagagccaaatcatatcgcagctaataggtcacaaaaatgttagaagggcaggaaaagcaataggacaaaggcaaagttacgagagatcagggagctgctgtggctcccagtctacagcacaggagcctggagtgatggtgaaatggccagcccctcccactgagcaggcagctccctgtaagctgctagtgctgcaggagccaccactgctgccagaatgcagctgatattgctggagccaaagtcattggcatcgttacaattgaagctgtagctactcactgaagccatctatactgccactgcctgagccacttctagaagtagaacagattctgccatcatcctgctttttaatttggtatatatgcctccaattggcagaacctaaccagagcccagctatcaaggaagatgaacaattgtagttttaaggcttcctttgctagctgtcaaaagacagtgcagaagtgtgaggctgggggccaacagaaatttaaccagcacagcacctcaatattacatcaccaggcattgattagtccagggaaacactgggtgatgagccctgaaaatggacattacagcatcagagtatttacaaactccctaaagaagtcatttttctattccaatcccccatttgatgcttgagaaagctgaagtccagaaaagggaactgatctgctcaaagacaaaccgaaattattttttccattttataacagttttatgtaatttagttgagatccaaatgtgttctgatttcctgagttccaatcaactatattaagagagagccagcgctgcccttacaatatgttgcgtaaatatacactctcatcatggtgacagtaggtctttcagattttgttcgacagtttcccaccttctcactgaagtgaaatgaatgactaggcagcaccttgctacatagcatgaggagaggagacccatagttctttaccatcctatgtcaggtggccgctgagagaagacttgaaaggagatgagcatagatgtatggacgctctttgttgcaccagtgtgataggtgatggagggacctattagatgagacatgggcaggggcactcctttattgcttaaaatgcaagactaaattggtgatgcctttctagaaaggaagtatgaagatacgaaaatccatcattcctcccaattttgtactgggtgaacagtaattggaagcattctagaaggaactgtccattgtgaaatcttagttgcatactttagatgaaaaacaatgaattggagatacctctgttttagtcacagttgtgccacgtgtcagttctatgactgatggcaagacatcttccttgccctgtgtatttagtttatcaatgtaataaggctgttattctaactttattattatatatagatttgtaattattattcccttggccagtttaacagtgagaaaaaagttgttttcacacaattagctgtactttgtttctctctccccagtatgtcagccacctccagatgtcctgcatgctgagcgtacccaaagggacaaggacaacttttcacctgggcaggaagtgttctacagctgtgagcccggctacgacctcagaggggctgcgtctatgcgctgcacaccccagggagactggagccctgcagcccccacatgtgaaggtgactagactcttatctggcttgatatttttagcttgcgtctttattctccacatgccagtgatttctgttcgtttttctttatctccagtgaaatcctgtgatgacttcatgggccaacttcttaatggccgtgtgctatttccagtaaatctccagcttggagcaaaagtggattttgtttgtgatgaagggtgagtatgagcttgcctgacctgctggacattgaaattggggttgggaatcagtctaaaaaggggagatttggtgtggcacacacacacacaccttcagagagatgaactttcgaaagtatacctaggaagaaaggaaagaaacatatagaactaataacatgagatatgaagaggaaactggaacatatattaactggcaagttcaaaggcaagtataactactggttatgaatatataagtaacacattaagcaaaaaatatcagccagaaacggtggctcacccctgtaatcctagcacctttgggaggttgaggcgggcagatcacctgaggtcaggagttggagaccagcctggacaacatgatgaaaccctgtctctactaaaaatacaaaagttagctgggtgtggtggcatgtgcctgtaatcccagctattccggaggctgaggcaccagaatcacttgaacctgggaggtggagtttgcagtgagccgagatggcaccattgcactccagcgtggacaataagagtgaaactccatctcaggaaaaaaaatcatattttacaagcaaaaaggaatatgagtaatttagagagtcccaggaaaaaactggaagtaacaaaagcttattataaaaagctaggatcatttgtgaatcatttcagtaaattctttaaatcgtcaacagtgaaatttgtaataggactgaaaatgtaaaaatcagcattttttaaaaaaatccagccatatatcatctggttaatcatgggctctgggctctgagctggggtcctgatggctgctgttaatatttccagcaagctcattaccttgtttatgtccacctagtgctcttcgcagggtgcacatctctacacgggagctgaccggcatgggcaacaaagcacctgatcccaaaatgtaacacagaatcttggcagcctccaaatgccagcacccagtaagagttaggagggcatcggggtccagcagacattgagaattttcgacaattgcatgcaaaaaataagtcctctcttctttcctttttcccctagaatattcatgcttactcttcagcagcccaaattgcccttttgagccttcttcacgccatcacagatgtggagatgaaaggacagtctgttctctcgccagctatttcccacttttccactccaaactgggagctgttttacttgctgttccagggtcagagttaggaaggcattacattagaagactgggtttctaataacaacaatgagtgatttatcaggttatcatggagtaatcagtgaaactccaagcctgggtcctgggtcaaggggatggcgcctatgtcatgaccacctttttcagttcaagcaggactatcatgtgaccaagctactgcattttgccattctatattgttcccttctggaggctgtgatttttccagaataaggtagcctgtgcaactctgccacctgctggcctaaggtcctaataatcctgaaattggggctgggccttagattgtgaactaagggttctcttggctgaaacagctcacactattcactcctattttcttctttagatttcaattaaaaggcagctctgctagttactgtgtcttggctggaatggaaagcctttggaatagcagtgttccagtgtgtgaacgtgagtagcaggagtaacatttcaggccagtctctcccttcatctgttcagtatttgacccatgacctcccctaatgtggttcttcaattttctagtttgaattattgatttgaaaattgcttattttaataatgtttggttgtgaatcaaatgtatacatcacctgtctttggaaccatctgatctgtctctgtccttctgtattctgtgttctagtgcgataaatcctatggtagcatgattctaggtcaggagagattagataatgtgaagccttaacaatttgctttctttctctctttcttttgtttcttttttctcttccttcctttcttcagttctttcttcccttctctttctctcccctttcttccttccttcctccttctttcttttccattttgttcttccatcaggtgcagtctacaatttttgtatatatttgataatacacaaatattaaacatgcctttatttaatcaatatttattgatcacatactttgtgcctgatgttcatctagccacaggagttatatcagtgaacaagatgaatgaattccctgtccccatgttgtttccactcagttggggaaagggacaagaaaaaaaataaatacgatgctatgaagatagtagagcaaagcatttaggcatgagggaaaagtgaggagcaacattagacaaggcgagcagtttgagactccttaaattctcaaaacatgtacctaaataatttatgctgagagattcataaataatgtcatttttaaaaatttattatacttttaagttctagggtacatgtgcacaacgtgcaggtttgttacatatgtatacatgtgccatgttggtgtgctgcacccattaactcgtcatttacattaggtatatctcctaatgctatccctccccgcttcccccaccccacaacaggccccggtgtgtgatgttcccctttttgtgtccaagtgttctcactgttcaattcccacctatgagtgagaacatgtggtgtttggttttttgtccttgtgatagtttgctgagaatgatggtttccagcttcatccatgtccctaaaaaggacatgaactcatcaatttttatggctgcatagtattccatggtgtatatgtgccacattttcttaatccagtctatcattgatggacatttgggttggttccaagtctttgctattgtgaataatgcagcaataaacatatgtgtgcatgtgtctttatagcagcatgatttataatcctttgggtatatacccagtaatgggatcgctgggtcaaatggtatttctagttctagatctttgaggaatcaccacactgtcttccacaatggttgaactaggttacagtcccaccaacagtgtaaaaatgttcctatttctccacatcttctccagcacctgttgtttcctgactttttaatgatagccattctaactggtgtgagatggtatctcattgtggttttgatttgcatttctctgatggccagtgatgatgagcattttttcatgtgtctgttagctgcataaatgtcttcttttgagaagtgtctgttcatatccttcacccactttttgatggggttgtttttttcttttaaatttgtttgagttcattgtagattctggatattagccctttgtcagatgagtagattgcaaaaatgttctcccattctgtaggttgtctgttcactctgatggtagtttcttttgctgtgcagaagctctttagtttaattatatcccctttgtcaattttggcttttgttgccattgcttttggtgttttagacatgaagtccttgcccatgcctgtgtcctgaatggtattgcctatgttttcttctaggatttttatggttttaggtctaacatttatgtctttaatccatcttgaattaatttttgtatacagtgtaaggaagggatccagtttcagctttctacatatggctagccagttttcccagtaccatttattaaatagggaatcctttccccatttcttgtttttgtcaggtttgtcaaagatcagatggttgtagatgtgtagtattatttctgagggctctgttctgttgcattggtctatatctctgttttggtaccagtaccatgctgttttggttactgtagccttgtagtatagtttgaagtcaggtagtttgatgcctccagtttgttcttttggcttaggatagacttggcaatgcaggctttttaaataatgtcatttttaaaaaatgagccccatatgttcaataatgagtagactactgatttctcctagtctccccatttataatttccccaatagaagatagaactttgcttcatttcttgattctaatgattgggaaatgtgtttctttagaaaaccatgaaattttactaaaatgtttatgttgttagaaatggacatcttacagtgctttttagagtaaaattttggaagaacataacttatatagagattcttgctgtctaagaaattcagtgctccttgaagcagcatgacaaatttctgttctaccatcatgaatgaaagctcattgattggactactcaagctttctcttatttttcataactgttgctagttaaagtagcttcttccaaattccagttctaatgaaaaatgccaattagaaatgaggaagaaactgttctaaacaaatcagcagatgctagaaaggagaaacaacttgaaacctgacccagaaagttaaaagagaaaataaatcatcaacagacctagacattttcaaaagcaaagccatctgaatccatttggagttgttttttatcatggccttactatgttttaattcactgtgacagggctattgttatcactgagattgatgatcaatatcaagaagtaatcagcgaaaggtttcacctatttaagatgattagcacacatatgtacatttgagaaatatttcctaagaatgcaggctccttcctcagcactctgtccccaggatcctgatgagtggctgacacaggacaagtgcttaattaatatatattgactaaatgaatgagcaacccttcaaaatggctatttttctttttcaaatgttttgctacttcattaaagttgtaaagtttccattgtccaggaaccgttactatccggaagattcaggatagacaagtctcttttgtactttgcaatacactttcattgatatctcatttaatccaactcttcaaagtcctaatgtctactgtcatctccttagcatattttcagcaacaccaatcatagcaccctgtaattgcagaatacctctggtgaaactcctgaatgaaacttagagctttcatgttttttctagaaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctgggttagtgctcatttccccacatcccaaatgggttcagaatatctaacccaggccctccatatttccgtaattacaatgtggtatttatttgtgcatttgccacaatggaatgccaaaccaatgatagatggttctaaggtaggtcaacacataagatcctgatgacctttgcagatggagggactgatgaaaaaagagggaggcggtgagtggtgggaaagtccttcattagaatcatatgaattaaaaacagatgcctgtgaatctccttattgaaatgtttggtttagaaatctgacctagaaaatcggtggctccttctgccaggaaacgtcttgagttcccgcccatgcttgacagcctctcattggagttttgatgacttgaagtacaaggaaaccagacaggaaaggtggaacctgggcagaaaaactctttctggcttcctaaaaatgtgaaaaattaaatgggagctatctttacattaaattatatgagcattagctgagcgtggtggcaattgcctgtggtcccagctactcgagaggctgagatgggagtatcccttaagcctgggaggcagaggttgcagtgagccaagattgtgccactgcactccagcctgggtgacagagcgagaccctatctcaaaaacaataaaaataggcattaggaggccaaggctggtggatcactagaggtcaggagttccagaccagcccgcaaacacagtgaaactccaactctactaaaaatagaaaaaaaatttaaaaacaaaaataaattatatgagtagaaagaccagatagcaggctagtcttccaaataatatacttccttataagcctatgctaatggaactttcctttctattttacagggaagttttttttttttcataactaaaattttcttttcttctggcatcaaatctaccaaggaagagaaaagaggaaacacactgggtatctttttattaactcaaatattcttgatttcttggtctctaggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtgcgtaaacttgcgttggatctttcccatgtctgcaaaagcttcttatggaattatttcaaatgtgggatatgagaaaccttttctgaaaagtgttcggatagatggatgtaagagtttttcttgtaggcatccttgattgttgcttgaaatgttaacttcatgagaatgtttcaagaaatagttgtagagaaaatcttcattccctatgggaaagaaaataataaatgactagatcaggaaaaaaatggtgtaggaagacaaattctgtttgaataactaggtgggaagaaatcctttgcaaactttgaaatatattgatagtaaataatgccataaatgacctttacattttgataagggatgcaaggtctctacacagatctaaatctagatctagatagatctggagggaaggtctttttgaaagtggggcttagtaggtggctgatcctcagcgctctgatgagttttctcaaggtgccaaaatctgtggaaccatcagagccgcgtgttttcttcaggaagctacatgcaggttgagaccttacgtactgaagagagttcagattactctacctggctccaaaacattttctttcccacaggtaaatcatgtaaaactcctccagatccagtgaatggcatggtgcatgtgatcacagacatccaggttggatccagaatcaactattcttgtactacagggtgagttggcagcaacatctcttggtttaagagttccagcacagcgatagtactttctagccacatctcagcaaggaaactaggctattgccacctgctcttaagaggcttgaacacaggtgttaactcctgattgaaatgaacaaagataggagaagattagggggaaaatctgtatccttgctggaaaccagggcagtgcacatataaagagtatgctgttcactggatgggaaggaaaaaaacttagaagtgtagtagtcaaagcacacaaacaaccctaacccagagtagacattgctggaagaaagggaagaccatgtagcagctgtgtgagagaatgaatcttaatgataacagcatgatcccttgctagggctgccatcaaaaagtacaggccttcctcgttttattgtacttcgcagatgttatgctttttacaaattgaacgcttgtgggaacgctgtgtaagcatgttcgtcggcatcatttatccaacagcgtgtgttgacttcgtgtctctgtgtagcattttgattattctcacagtatcccagatgttttcattattatcatgtctgtgatagtgatctgtcatcagtgatctttgatgttactattgtcattgtttggggtccctacgaactgcacccatataagacagaaaacttaatcaataaatgtgcgtgctttgactgctccatggactagacattccccttctgtctccctctcttcaggactccctaatccctgagacacaataatactaaaatgactccaattaataaccctacaatagcctttaagtgttgacatgaagggaagagtcatgcatctcttactttaaatcaaaagctagagatgattaagcttactgaggaagatacgttgaaaaccaagataggccaaaagccattcctcatgtgccaaacagctagaaagttgtaaaggcaaagtaaaaatacttgaaggaaatttaaaatgctcttccagtgaacacatgtatgataagaaggtaaaacagccttattgctgatatggaagaagttttagtggtctagacataagatcaaactagaaacatttcctgaagccaaagcgtaatcctgagcaaggccgtaactctcttcaattctgtgaaggctgacagaagctggaagctagcagaatttggttcctgaggtttaaggaaagaagccctctccataacataaaggtccaaggtgaagcagccagtgctcatatagaagttgcagcaagttatctagaaaatctagctaagatcactgacgaaggtgttacactaaataacagattttccatgtagacaaaacagccatctattggactttcatagctagagaggagaagccaatacctgggttcaaagcttcaaagaacaggctgactttttaggagctaatgccgctggtgactttgagttgaagccaatgttcaccgaccattctaaaaatcctagggcccttaagcattaagttaaatataccttgcctgtgtctataaatggaagaacaaagcctgatgacagaggtatgtttgcggcatagtttactgaatattttaagcccactgttgagatctagtgctcagaaaaacagattcctttcaaaatattactgctcattgacattgcacctaagcagccaagagctctaatggagaaggacatggagatgaatggagttttcctgcctgctaacaacagcagccattctgcagcccatggctgaaggagtaattttgactttcaagtttcactatttaagaaatacattttgtaaggtgagtccccacagacagtaattcctctgatggatctgaacaaaataagttgaaaactgctggaaagaattcatcattctacataccattaagaacattcgtgattcatgggaagagcttaaaatatcaacattaataggagtttggtagaagttaattccaaccctcatggctgactttgagaggttcaagacttcagcggaggaaataactgaagatgtggtgaaaatcgcaagagaactacaattagaagtggagcctgaagacgtgactgaattgcgacaaattcatgatcaaacttgaacagatgaggagttgcttctcatgaatcagcagagaaagtggtttttttgaggtggagtgtcttcctggtgatgatgacatgagcattgtgaaaatgaccacaaaggatacagaatattacaaaaacttaggtgataaagcagcagcagtatcgggaggattaactccaattttgaaagcagttcagagggtaaaatgttatcaaacagcattgcatgctagaaaaatcttttgtgaaaggaagagtccatcaatacagcaattttattgctgtctcagcttaagaaattgccacagccaccccagccttcagcaaccaccaccctgatcagtcagcagccatcaaccttgaggcaagaccctccaccaacaaaaagattacaaattattgaaggtcagataatctttagtattttcttatcaataaacctttttttaaagtatgactttgtttagacataatgctatttcacacttaatagactaccgtatagtataaacacaacttttagactcactgagaaatcaaaaaattcatctgactcatttgttgtgatatgtgttttattgtggtggtctggaactgaacctgcaatatatttgaggaatgtctgtaacacgaagtgggcggcttaatacaacagaagtttttggagttccattctagagactggaaatccaaaatcaaggttttgggagggccacgctccctctgaatcctgtagggaaggatccttcattgcatcttccagcttctggagccacaggccttccttggcatgtggcagcagaactccaatttctgtctctgtcctcatatggccatcttccctctgggtctgtgtcctcatatgctgttctctctgtgcatgtctgtttccaaagttttcccttttaataaggacaccagtcacactggattagggcctaccttcatgacctcaccttaacttgattgcgtctgcaaagatcgtatttccaaataaggtcacatccacagggactggaggttaagacttcagcatactcaggggagacacaattcaacctataacagagcccctttgaaaatgtcaggcatcaggtgctcacagcacacggtccagctgttggtgctcacccttgctcagcacacggtggaggctctgcctcaatctcattcttcatgggaacagctaagccaggtagcgaatacgagttacgtttgtgtcaccacagcagacactgaaaggaagtttgtggtgtccagcacatttgccagcataggcctcacagaccacaacacctagaatctgacaaaaattagaataaatccgatgtctccttttctctctttttttaagcatttttaaatacaattggtaaatttcctgactgtaccctactcatcttgcattgctgaataagtgaggaacctctctatggcatgaagcagaaaaccattgagcttatgagaagaaacaggaaatacatgtaaaagagaccagtctgaaaaatcaggagaaattttacaaaagagatttactgccaagaaaccagggaaactttcagaacactctccttttcatatttgtaacaagattcaattgtacaaatacttctgtgaaactagccatgaagtgtgtacatgaatgaatatatgtattcagtgtgtttatatatttcatttcatacatgtgatctatatcatatatatatatatatatatatatatatatcacaatgaatattgcagaaaattaaagcaaagagtaagaagagttaaccaaatgttccctgaatgcagtgggaaaagatgaaaaggagaagacaggcaagcacagtggctcacacatgtaatcccaacatattgagaggccggggcaagaggatcacttgagcccaggagctcaagaccagcctggacaacatggcaaaaacccatctctacaaaaaagtataaaaattagctgggcatggcagcatgtgactgtagtcacagctaggcaggagaatgaagtgggaggatcacctgagcccaggaggctgaggcttcagtgagccttgatggcaaccctgcactccagcctggatgacagaatgagaccctgtctcaaaaaaggaaaaagagaagacatatgtaacacagtgtcaggattcaaaatacatgtagcaaaaattccagaagggtaagcaaataagcccatacctagccatcactagggaaacttctgtgtttcagggatagagaaaaaaactctgattccagaaataaaatgtgaaaatataatacccgcaaaagaaataaatttattgacaccacattgattctatattgtataagatatattgtataacactaaattgtagaagatagcacttctcttgagccaagctaatatgcacacctagaggctccaggtacacattaaaggataagcaaagacacaaaaattgtaccatttaagtatgtttcccaggcaattcataagcaaatttttaaaaaggagaatgatgaattccaaaggaaatctcaatgagataggatgtaggtaaaaagaaaaaacaacaataaaaaaaacatacacacaaaatcttggcaatgtaataataatttattaataatctctctaaactcatagaatatatcaataaaactagaaaatgtgagacagcaagaaaagataggctagacttacattacagaaaagatgagtagactgactatatagagtttgactctaaaattgagaaaagaggtttaaatatgtgtcacgtgtatatgtataatatacatgcacacatataaaatgaaattcctcactggaaaaaatattaagtttaatttccaaattattagaatgactaaaacagttgaatctatctgttccatatagtaattgagggggaaggaaaaggaatagcaaggaatccatttttctcttccaccagaaataagctccctcatgtttgggtcaggtcactttattcattgctttctccacatcctcatcattaggcatcatgaaatcaatgaaaaggcagtgaaagaatgatgatgaaagctaatcaaatgtatcatttacctcaatacgtttggtttaatcttcttgttgaaagacaaattctcctagacaggatcaaaagcaacatatcttgtatttataaaaaacatgtctcaagtaaaatgacatagtattatacacacacacacacatacacacacacacacacattaagggaaaatgcagacaaaaaatggcagaaataatatttagagaaagatagaatttaagaaaaaaaattgtcaaacaggtctgcaaaataattgttttattttggtgccagttacagtccgcaatgaagcgaagatattaagaagcaaagtgggccaggagaaattagagcagaaatatctctttcaatagtgagagaataggaaaaagaagtagaaaagctgggaacaataggtaaagtttaggctaggccttagacttctcctgcattgtaatccctctggtttgccacatatgcatgctgtcaggaagttgatgaggtatgtacagcacaatttattttccattttttgcctttaggcaccgactcattggtcactcatctgctgaatgtatcctctcgggcaatgctgcccattggagcacgaagccgccaatttgtcaacgtgagttgaaatctctttccccattcaccccaccgtttaatcctagagttgtcctcctagaattacaaagaatggatctcatccctcttggaaatggtatccttctcatatttgaagaatccagtcatatccttaaaatggctcacagcattccaaacttccaccttcagctagaaatgcttttttattttttcttatctcaaggtctaattttttttaaactagtctttagctcacttaaacagtcccccaatttcatcctctgttgggtgaacacctcccagtttaaagagcattttatttagtgaagtcaacaaatacaaagtcagtgaaagaaaccccatatcctctctgcaagctcttagtatcacatcagatattcaagccatgcagctctttcttccttcttattctttgtctaaacaggatcatgccatcttccctgtgagttgtttggaagatgagctttctacattttggggagcaaagacgaatgagcaattgcaagctaacaaggaatataaaatgtgtataatcctgggtttagtgatggtgtgaggaaatcagcaatttcaaacccagttggtgggaggataagtgggaacaaactttgtagaaggccaataaactggctgggcactgccctacggtagagtaggacacagtattcagttcttccaagatcagacgagattgggcgcatttagggtggtatggttgtagatcagtatccagttctttttattatttctgaatctgtaagtatcatgtttattatatgtaatattgtatatttgtactttgtctttgttagttcttccagagcttttgttcttattatttaataaagatgttatactgagccacatgtggtgactcaaacgtgtaatcccagcactttgggaggcctaggtgagcagatggcttgagtccaggagtttgagaccagcctgtacaacatactgaaacgctgtctctacaaaaatacaaaaactatacgggcatggtggcacatgcctgtagtcccaactactcaggagactgagaggtgggaggattgcttgagccagagaggtcgaggctgcaatgagccatgatcgtgccactgcactccagtctgggcagcagagcaagaccttgtctcaaaaaaaatgctatgctgtatgctttattatattaatatccaatagaataaagacacatgccttctatatagagagaactaaattaataatggtgagataacagttaaattctcatttagcaggagaaataaaaacatagactataggctaggcacagtggctcatacctgtaatcccagcacattaggaggctgaggtgggcagatcacttgaggtcagtagtttgagaccaccctggccaacataatgaaaccccgcctctactaaaaatacaaaagttagccgagtttggtggcgcatgcctgaaatcccagctactcaggaggctgaggcaggaaaatcgcttgaacctgggaggcaagggctgcagtgagccaagatcacgccactgcactccagcctggggaacagagtgaggatctgttaaaaaaaaaaaaaaaaagtggactctaataatacatggacacatttagtgaaataaacttaactgagtagagcagaacttataatattttaaaactgtaagaacatgtctgtacattagcaaatagtagatgagaatagtattttcaatatttacttctggtaatttggaattaaaaaaaaaacttttgggaaaatttacaataaagtatgattttaacaaaccaggctaggcgtggtggctcacgcttataatcccagcactttgaaaagcagaggcatgcagattgcttgaggccaggagttcaagactagcctgcccaacatggccaaaccccatctctactaaaaatacaaaaataaaccagacatggtagtgcatgcctgtgatcccagctactcgggaagttgaggtaggaggattgcttgacctgggaagtggaggttgcagtgagccatgatcgtgccactacactccagcctgggtgacagagcaagactctgtcccaaggttttgttttggttaacttgctgtccctttttccaggaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccaggggtgagtctgactgaggcctagtagggccctgcaagtgacatgcgttgctgttggatcaggagattagtatttgttcacggggagggatgtgtgctgagcagggtcgaggagcaaattttctaagtagtgaacatgaaattcaggtgtgtagacatgcacatgtgctgaaattgagaagcaaagctcaacctgggcaagggatatgatgtttctttggggttcttataaacagatctatcaattacctttgagtataataatgtttgatacaaaatgagtgattcctctgcccaggcactataatacaggctacatgtgaattttaatcctgaaaacaaagttattaggtagttcccagttgttctatgtttgtctgttttgttttgcttgagatactgtcttgatctgtcactcaggttggactgcagtggtgccatcatggcatacttcaccctccacctccctgactcaagcaagtctcctgcctgagcctcccaagtagctgggaatgtaggtgcatgccaccatgcctggctaagttttttatattttttttgtagggacagagtctcaccatgctgcccaggctggtctcaaactcctcagctcaagcacccacccaccttgggctcccaaagtgctgggattataggcatgagccactgtgcccggcctctatgttttacagagaatatgtgccttagacacatcagataacattctgagacagtaacttgcagacaaaactggattgcaagtccacctcactccagagccttggctttgctcatcagcattcagtcatgaaatcaaaacttactctagatactttcaaggagggagggatttcatgcaggttgtattagtctgttctcacattcctataaaaaactacttgagcctgggtaatttataaagaaaagatgtttaattgactcagagttctgtaggctgtacaggaggcatggctgggaaagttacaatcatggtggaaggcaaagaggaagcacgcatatcttcatatgcttggcaggagagagagagagagcaaggcagaggtgttacagactttgaaacaagcagatcttgacagaactctatcacaagacagcactagggtgatggtgctcaaccattagaaaccacctccatgatccagtcacctcccaccaggctccttctccaacactgggaattaccatttgacatgagatttgggaggggacatagagccaaaccatatcgcagctaataggtcacaaaaatgttagaagggcaggaaaagcaataggacaaaggcaaagttacgagagatcagggagctgctgtggctcccagtctacagcacaggagcctggagtgatggtgaaatggccagcccctcccactgagcaggcagctccctgtaagctgctaatactgcaggagccaccattgctgccagaatgcagctgatattgctggagccaaagtcattggcatcgttacaattgaagctgtagctactcactgaagccatctatactgccactgcctgagccacttctagaagtagaacagattctgccatcatcctgctttttaatttggtatatatgcctccaattggcagaacctaaccagagcctagctatcaaggaagatgaacgatttatttttaaggcctccattgttagctgtcaaaagacagtgcagaaatgtgaggctgggggccaacagaaatttaaccagcacagcacctcaatattacatcaccaggcattgattagtccagggaaacactgggtgatgagccctgaaaatggacattacagcatcagagtatttacaaactccttaaagaagtcatttttctattccaatcccccatttgatgcttgagaaagctgaagtccagaaaagggaactgatctgctcaaagacaaactgaaattactttttccattttataacagttttatgtaatttatttgagatccaaatgtgttttgatttcccaagatcagatcaactacattaagagagagcctgagatgccgttacaatatgttgtgtgaaattacactctcattatggtgacagtaggtctttcagattttgttcgacagtttcccaccttctcactgaagtgaaatgaatgactaggcagcaccttgctacatagcatgaagagaggagacccatagttctttaccaccctatgtcaggtggccgctgagagaagacttgaaaggagatgagcatagatgtatggacgctctttgttgcaccagtgtgataggtgatggagggacctattagatgggacatgggcaggggcactcctttattgcttaaaatgcaagactaaattggtgatgcctttctagaaaggaagtatgaagatacaaaaatccatcattcctcccaattttgtactgggtgaacagtaattggaagcattctagaaggaactgtccattgtgaaatcttagttgcatactttagatgaaaaacaatgaattggagatacctctgttttagtcacagttgtgccatgtgtcagttctatgactgatggcaagacatcttccttgccccgtgtatttagtttatcaatgtaataaggctgttattctaactttattattatatatagattcgtaattattattcccttggccagtttaacagtgagaaaaaagttgttttcacacaattagctgtactttgtttctctctccccagtatgtcagccacctccagatgtcctgcatgctgagcgtacccaaagggacaaggacaacttttcacccgggcaggaagtgttctacagctgtgagcccggctacgacctcagaggggctgcgtctatgcgctgcacaccccagggagactggagccctgcagcccccacatgtgaaggtgactagactcttatctggcttgatatttttagcttgcgtctttattctccacatgccagtgatttctgttcgtttttctttatctccagtgaaatcctgtgatgacttcatgggccaacttcttaatggccgtgtgctatttccagtaaatctccagcttggagcaaaagtggattttgtttgtgatgaagggtgagtatgagcttgcctgacctgctggacattgaaattggggttgggaatcagtctaaaaaggggagatttggtgtggcacacacacacacaccttcagagagatgaactttcgaaagtatacctaggaagaaaggaaagaaacatatagaactaataacatgagatatgaagaggaaactggaacatatattaactggcaagttcaaaggcaagtataactactggttatgaatatataagtaacacattaagcaaaaaatatcagccagaaacggtggctcacccctgtaatcctagcacctttgggaggttgaggcgggcagatcacctgaggtcaggagttggagaccagcctggacaacatgatgaaaccctgtctctactaaaaatacaaaagttagctgggtgtggtggcatgtgcctgtaatcccagctattccggaggctgaggcaccagaatcacttgaacctgggaggtggagtttgcagtgagccgagatggcaccattgcactccagcgtggacaataagagtgaaactccatctcaggaaaaaaaatcatattttacaagcaaaaaggaatatgagtaatttagagagtcccaggaaaaaactggaagtaacaaaagcttattataaaaagctaggatcatttgtgaatcatttcagtaaattctttaaatcgtcaacagtgaaatttgtaataggactgaaaatgtaaaaatcagcattttttaaaaaaatccagccatatatcatctggttaatcatgggctctgggctctgagctggggtcctgatggctgctgttaatatttccagcaagctcattaccttgtttatgtccacctagtgctcttcgcagggtgcacatctctacacgggagctgaccggcatgggcaacaaagcacctgatcccaaaatgtaacacagaatcttggcagcctccaaatgccagcacccagtaagagttaggagggcatcggggtccagcagacattgagaattttcgacaattgcatgcaaaaaataagtcctctcttctttcctttttcccctagaatattcatgcttactcttcagcagcccaaattgcccttttgagccttcttcacgccatcacagatgtggagatgaaaggacagtctgttctctcgccagctatttcccacttttccactccaaactgggagctgttttacttgctgttccagggtcagagttaggaaggcattacattagaagactgggtttctaataacaacaatgagtgatttatcaggttatcatggagtaatcagtgaaactccaagcctgggtcctgggtcaaggggatggcgcctatgtcatgaccacctttttcagttcaagcaggactatcatgtgaccaagctactgcattttgccattctatattgttcccttctggaggctgtgatttttccagaataaggtagcctgtgcaactctgccacctgctggcctaaggtcctaataatcctgaaattggggctgggccttagattgtgaactaagggttctcttggctgaaacagctcacactattcactcctattttcttctttagatttcaattaaaaggcagctctgctagttactgtgtcttggctggaatggaaagcctttggaatagcagtgttccagtgtgtgaacgtgagtagcaggagtaacatttcaggccagtctctcccttcatctgttcagtatttgacccatgacctcccctaatgtggttcttcaattttctagtttgaattattgatttgaaaattgcttattttaataatgtttggttgtgaatcaaatgtatacatcacctgtctttggaaccatctgatctgtctctgtccttctgtattctgtgttctagtgcgataaatcctatggtagcatgattctaggtcaggagagattagataatgtgaagccttaacaatttgctttctttctctctttcttttgtttcttttttctcttccttcctttcttcagttctttcttcccttctctttctctcccctttcttccttccttcctccttctttcttttccattttgttcttccatcaggtgcagtctacaatttttgtatatatttgataatacacaaatattaaacatgcctttatttaatcaatatttattgatcacatactttgtgcctgatgttcatctagccacaggagttatatcagtgaacaagatgaatgaattccctgtccccatgttgtttccactcagttggggaaagggacaagaaaaaaaataaatacgatgctatgaagatagtagagcaaagcatttaggcatgagggaaaagtgaggagcaacattagacaaggcgagcagtttgagactccttaaattctcaaaacatgtacctaaataatttatgctgagagattcataaataatgtcatttttaaaaatttattatacttttaagttctagggtacatgtgcacaacgtgcaggtttgttacatatgtatacatgtgccatgttggtgtgctgcacccattaactcgtcatttacattaggtatatctcctaatgctatccctccccgcttcccccaccccacaacaggccccggtgtgtgatgttcccctttttgtgtccaagtgttctcactgttcaattcccacctatgagtgagaacatgtggtgtttggttttttgtccttgtgatagtttgctgagaatgatggtttccagcttcatccatgtccctaaaaaggacatgaactcatcaatttttatggctgcatagtattccatggtgtatatgtgccacattttcttaatccagtctatcattgatggacatttgggttggttccaagtctttgctattgtgaataatgcagcaataaacatatgtgtgcatgtgtctttatagcagcatgatttataatcctttgggtatatacccagtaatgggatcgctgggtcaaatggtatttctagttctagatctttgaggaatcaccacactgtcttccacaatggttgaactaggttacagtcccaccaacagtgtaaaaatgttcctatttctccacatcttctccagcacctgttgtttcctgactttttaatgatagccattctaactggtgtgagatggtatctcattgtggttttgatttgcatttctctgatggccagtgatgatgagcattttttcatgtgtctgttagctgcataaatgtcttcttttgagaagtgtctgttcatatccttcacccactttttgatggggttgtttttttcttttaaatttgtttgagttcattgtagattctggatattagccctttgtcagatgagtagattgcaaaaatgttctcccattctgtaggttgtctgttcactctgatggtagtttcttttgctgtgcagaagctctttagtttaattatatcccctttgtcaattttggcttttgttgccattgcttttggtgttttagacatgaagtccttgcccatgcctgtgtcctgaatggtattgcctatgttttcttctaggatttttatggttttaggtctaacatttatgtctttaatccatcttgaattaatttttgtatacagtgtaaggaagggatccagtttcagctttctacatatggctagccagttttcccagtaccatttattaaatagggaatcctttccccatttcttgtttttgtcaggtttgtcaaagatcagatggttgtagatgtgtagtattatttctgagggctctgttctgttgcattggtctatatctctgttttggtaccagtaccatgctgttttggttactgtagccttgtagtatagtttgaagtcaggtagtttgatgcctccagtttgttcttttggcttaggatagacttggcaatgcaggctttttaaataatgtcatttttaaaaaatgagccccatatgttcaataatgagtagactactgatttctcctagtctccccatttataatttccccaatagaagatagaactttgcttcatttcttgattctaatgattgggaaatgtgtttctttagaaaaccatgaaattttactaaaatgtttatgttgttagaaatggacatcttacagtgctttttagagtaaaattttggaagaacataacttatatagagattcttgctgtctaagaaattcagtgctccttgaagcagcatgacaaatttctgttctaccatcatgaatgaaagctcattgattggactactcaagctttctcttatttttcataactgttgctagttaaagtagcttcttccaaattccagttctaatgaaaaatgccaattagaaatgaggaagaaactgttctaaacaaatcagcagatgctagaaaggagaaacaacttgaaacctgacccagaaagttaaaagagaaaataaatcatcaacagacctagacattttcaaaagcaaagccatctgaatccatttggagttgttttttatcatggccttactatgttttaattcactgtgacagggctattgttatcactgagattgatgatcaatatcaagaagtaatcagcgaaaggtttcacctatttaagatgattagcacacatatgtacatttgagaaatatttcctaagaatgcaggctccttcctcagcactctgtccccaggatcctgatgagtggctgacacaggacaagtgcttaattaatatatattgactaaatgaatgagcaacccttcaaaatggctatttttctttttcaaatgttttgctacttcattaaagttgtaaagtttccattgtccaggaaccgttactatccggaagattcaggatagacaagtctcttttgtactttgcaatacactttcattgatatctcatttaatccaactcttcaaagtcctaatgtctactgtcatctccttagcatattttcagcaacaccaatcatagcaccctgtaattgcagaatacctctggtgaaactcctgaatgaaacttagagctttcatgttttttctagaaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctgggttagtgctcatttccccacatcccaaatgggttcagaatatctaacccaggccctccatatttccgtaattacaatgtggtatttatttgtgcatttgccacaatggaatgccaaaccaatgatagatggttctaaggtaggtcaacacataagatcctgatgacctttgcagatggagggactgatgaaaaaagagggaggcggtgagtggtgggaaagtccttcattagaatcatatgaattaaaaacagatgcctgtgaatctccttattgaaatgtttggtttagaaatctgacctagaaaatcggtggctccttctgccaggaaacgtcttgagttcccgcccatgcttgacagcctctcattggagttttgatgacttgaagtacaaggaaaccagacaggaaaggtggaacctgggcagaaaaactctttctggcttcctaaaaatgtgaaaaattaaatgggagctatctttacattaaattatatgagcattagctgagcgtggtggcaattgcctgtggtcccagctactcgagaggctgagatgggagtatcccttaagcctgggaggcagaggttgcagtgagccaagattgtgccactgcactccagcctgggtgacagagcgagaccctatctcaaaaacaataaaaataggcattaggaggccaaggctggtggatcactagaggtcaggagttccagaccagcccgcaaacacagtgaaactccaactctactaaaaatagaaaaaaaatttaaaaacaaaaataaattatatgagtagaaagaccagatagcaggctagtcttccaaataatatacttccttataagcctatgctaatggaactttcctttctattttacagggaagttttttttttttcataactaaaattttcttttcttctggcatcaaatctaccaaggaagagaaaagaggaaacacactgggtatctttttattaactcaaatattcttgatttcttggtctctaggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtgcgtaaacttgcgttggatctttcccatgtctgcaaaagcttcttatggaattatttcaaatgtgggatatgagaaaccttttctgaaaagtgttcggatagatggatgtaagagtttttcttgtaggcatccttgattgttgcttgaaatgttaacttcatgagaatgtttcaagaaatagttgtagagaaaatcttcattccctatgggaaagaaaataataaatgactagatcaggaaaaaaatggtgtaggaagacaaattctgtttgaataactaggtgggaagaaatcctttgcaaactttgaaatatattgatagtaaataatgccataaatgacctttacattttgataagggatgcaaggtctctacacagatctaaatctagatctagatagatctggagggaaggtctttttgaaagtggggcttagtaggtggctgatcctcagcgctctgatgagttttctcaaggtgccaaaatctgtggaaccatcagaaccgcgtgttttcttcaggaagctacatgcaggttgagaccttacgtactgaagagagttcagattactctacctggctccaaaacattttctttcccacaggtaaatcatgtaaaactcctccagatccagtgaatggcatggtgcatgtgatcacagacatccaggttggatccagaatcaactattcttgtactacagggtgagttggcagcaacatctcttggtttaagagttccagcacagcgatagtactttctagccacatctcagcaaggaaactaggctattgccacctgctcttaagaggcttgaacacaggtgttaactcctgattgaaatgaacaaagataggagaagattagggggaaaatctgtatccttgctggaaaccagggcagtgcacatataaagagtatgctgttcactggatgggaaagaaaaaaaattagaagtgtagtagtcaaagcacacaaacaaccctaacccagagtagacattgctggaagaaagggaagaccatgtagcagctgtgtgagagaatgaatcttaatgataacagcatgatcccttgctagggctgccatcaaaaagtacaggccttcctcgttttattgtacttcgcagatgttatgctttttacaaattgaacgcttgtgggaacgctgtgtaagcatgttcgtcggcatcatttatccaacagcgtgtgttgacttcgtgtctctgtgtagcattttgattattctcacagtatcccagatgttttcattattatcatgtctgtgatagtgatctgtcatcagtgatctttgatgttactattgtcattgtttggggtccctacgaactgcacccatataagacagaaaacttaatcaataaatgtgcgtgctttgactgctccatggactagacattccccttctgtctccctctcttcaggactccctaatccctgagacacaataatactaaaatgactccaattaataaccctacaatagcctttaagtgttgacatgaagggaagagtcatgcatctcttactttaaatcaaaagctagagatgattaagcttactgaggaagatacgttgaaaaccaagataggccaaaagccattcctcatgtgccaaacagctagaaagttgtaaaggcaaagtaaaaatacttgaaggaaatttaaaatgctcttccagtgaacacatgtatgataagaaggtaaaacagccttattgctgatatggaagaagttttagtggtctagatataagatcaaactagaaacatttcctgaagccaaagcgtaatcctgagcaaggccgtaactctcttcaattctgtgaaggctgacagaagctggaagctagcagaatttggttcctgaggtttaaggaaagaagccctctccataacataaaggtccaaggtgaagcagccagtgctcatatagaagttgcagcaagttatctagaaaatctagctaagatcactgacgaaggtgttacactaaataacagattttccatgtagacaaaacagccatctattggactttcatagctagagaggagaagccaatacctgggttcaaagcttcaaagaacaggctgactttttaggagctaatgccgctggtgactttgagttgaagccaatgttcaccgaccattctaaaaatcctagggcccttaagcattaagttaaatataccttgcctgtgtctataaatggaagaacaaagcctgatgacagaggtatgtttgcggcatagtttactgaatattttaagcccactgttgagatctagtgctcagaaaaacagattcctttcaaaatattactgctcattgacattgcacctaagcagccaagagctctaatggagatggacatggagatgaatggagttttcctgcctgctaacaacggcagccattctgcagcccatggctgaaggagtaattttgactttcaagtttcactatttaagaaatacattttgtaaggtgagtccccacagacagtaattcctctgatggatctgaacaaaataagttgaaaactgctggaaagaattcatcattctacataccattaagaacattcgtgattcatgggaagagcttaaaatatcaacattaataggagtttggtagaagttaattccaaccctcatggctgactttgagaggttcaagacttcagcggaggaaataactgaagatgtggtgaaaatcgcaagagaactacaattagaagtggagcctgaagacgtgactgaattgcgacaaattcatgatcaaacttgaacagatgaggagttgcttctcatgaatcagcagagaaagtggtttttttgaggtggagtgtcttcctggtgatgatgacatgagcattgtgaaaatgaccacaaaggatacagaatattacaaaaacttaggtgataaagcagcagcagtatcgggaggattaactccaattttgaaagcagttcagagggtaaaatgttatcaaacagcattgcatgctagaaaaatcttttgtgaaaggaagagtccatcaatacagcaattttattgctgtctcagcttaagaaattgccacagccaccccagccttcagcaaccaccaccctgatcagtcagcagccatcaaccttgaggcaagaccctccaccaacaaaaagattacaaattattgaaggtcagataatctttagtattttcttatcaataaacctttttttaaagtatgactttgtttagacataatgctatttcacacttaatagactaccgtatagtataaacacaacttttagactcactgagaaatcaaaaaattcatctgactcatttgttgtgatatgtgttttattgtggtggtctggaactgaacctgcaatatatttgaggaatgtctgtaacacgaagtgggcggcttaatacaacagaagtttttggagttccattctagagactggaaatccaaaatcaaggttttgggagggccacgctccctctgaatcctgtagggaaggatccttcattgcatcttccagcttctggagccacaggccttccttggcatgtggcagcagaactccaatttctgtctctgtcctcatatggccatcttccctctgggtctgtgtcctcatatgctgttctctctgtgcatgtctgtttccaaagttttcccttttaataaggacaccagtcacactggattagggcctaccttcatgacctcaccttaacttgattgcgtctgcaaagatcgtatttccaaataaggtcacatccacagggactggaggttaagacttcagcatactcaggggagacacaattcaacctataacagagcccctttgaaaatgtcaggcatcaggtgctcacagcacacggtccagctgttggtgctcacccttgctcagcacacggtggaggctctgcctcaatctcattcttcatgggaacagctaagccaggtagcgaatacgagttacgtttgtgtcaccacagcagacactgaaaggaagtttgtggtgtccagcacatttgccagcataggcctcacagaccacaacacctagaatctgacaaaaattagaataaatccgatgtctccttttctctctttttttaagcatttttaaatacaattggtaaatttcctgactgtaccctactcatcttgcattgctgaataagtgaggaacctctctatggcatgaagcagaaaaccattgagcttatgagaagaaacaggaaatacatgtaaaagagaccagtctgaaaaatcaggagaaattttacaaaagagatttactgccaagaaaccagggaaactttcagaacactctccttttcatatttgtaacaagattcaattgtacaaatacttctgtgaaactagccatgaagtgtgtacatgaatgaatatatgtattcagtgtgtttatatatttcatttcatacatgtgatctatatcatatatatatatatatatatatatatatatatcacaatgaatattgcagaaaattaaagcaaagagtaagaagagttaaccaaatgttccctgaatgcagtgggaaaagatgaaaaggagaagacaggcaagcacagtggctcacacatgtaatcccaacatattgagaggccggggcaagaggatcacttgagcccaggagctcaagaccagcctggacaacatggcaaaaacccatctctacaaaaaagtataaaaattagctgggcatggcagcatgtgactgtagtcacagctaggcaggagaatgaagtgggaggatcacctgagcccaggaggctgaggcttcagtgagccttgatggcaaccctgcactccagcctggatgacagaatgagaccctgtctcaaaaaaggaaaaagagaagacatatgtaacacagtgtcaggattcaaaatacatgtagcaaaaattccagaagggtaagcaaataagcccatacctagccatcactagggaaacttctgtgtttcagggatagagaaaaaaactctgattccagaaataaaatgtgaaaatataatacccgcaaaagaaataaatttattgacaccacattgattctatattgtataagatatattgtataacactaaattgtagaagatagcacttctcttgagccaagctaatatgcacacctagaggctccaggtacacattaaaggataagcaaagacacaaaaattgtaccatttaagtatgtttcccaggcaattcataagcaaatttttaaaaaggagaatgatgaattccaaaggaaatctcaatgagataggatgtaggtaaaaagaaaaaacaacaataaaaaaaacatacacacaaaatcttggcaatgtaataataatttattaataatctctctaaactcatagaatatatcaataaaactagaaaatgtgagacagcaagaaaagataggctagacttacattacagaaaagatgagtagactgactatatagagtttgactctaaaattgagaaaagaggtttaaatatgtgtcacgtgtatatgtataatatacatgcacacatataaaatgaaattcctcactggaaaaaatattaagtttaatttccaaattattagaatgactaaaacagttgaatctatctgttccatatagtaattgagggggaaggaaaaggaatagcaaggaatccatttttctcttccaccagaaataagctccctcatgtttgggtcaggtcactttattcattgctttctccacatcctcatcattaggcatcatgaaatcaatgaaaaggcagtgaaagaatgatgatgaaagctaatcaaatgtatcatttacctcaatacgtttggtttaatcttcttgttgaaagacaaattctcctagacaggatcaaaagcaacatatcttgtatttataaaaaacatgtctcaagtaaaatgacatagtattatacacacacacacacatacacacacacacacacattaagggaaaatgcagacaaaaaatggcagaaataatatttagagaaagatagaatttaagaaaaaaaattgtcaaacaggtctgcaaaataattgttttattttggtgccagttacagtccgcaatgaagcgaagatattaagaagcaaagtgggccaggagaaattagagcagaaatatctctttcaatagtgagagaataggaaaaagaagtagaaaagctgggaacaataggtaaagtttaggctaggccttagacttctcctgcattgtaatccctctggtttgccacatatgcatgctgtcaggaagttgatgaggtatgtacagcacaatttattttccattttttgcctttaggcaccgactcattggtcactcatctgctgaatgtatcctctcgggcaatgctgcccattggagcacgaagccgccaatttgtcaacgtgagttgaaatctctttccccattcaccccaccgtttaatcctagagttgtcctcctagaattacaaagaatggatctcatccctcttggaaatggtatccttctcatatttgaagaatccagtcatatccttaaaatggctcacagcattccaaacttccaccttcagctagaaatgcttttttattttttcttatctcaaggtctaattttttttaaactagtctttagctcacttaaacagtcccccaatttcatcctctgttgggtgaacacctcccagtttaaagagcattttatttagtgaagtcaacaaatacaaagtcagtgaaagaaaccccatatcctctctgcaagctcttagtatcacatcagatattcaagccatgcagctctttcttccttcttattctttgtctaaacaggatcatgccatcttccctgtgagttgtttggaagatgagctttctacattttggggagcaaagacgaatgagcaattgcaagctaacaaggaatataaaatgtgtataatcctgggtttagtgatggtgtgaggaaatcagcaatttcaaacccagttggtgggaggataagtgggaacaaactttgtagaaggccaataaactggctgggcactgccctacggtagagtaggacacagtattcagttcttccaagatcagacgagattgggcgcatttagggtggtatggttgtagatcagtatccagttctttttattatttctgaatctgtaagtatcatgtttattatatgtaatattgtatatttgtactttgtctttgttagttcttccagagcttttgttcttattatttaataaagatgttatactgagccacatgtggtgactcaaacgtgtaatcccagcactttgggaggcctaggtgagcagatggcttgagtccaggagtttgagaccagcctgtacaacatactgaaacgctgtctctacaaaaatacaaaaactatacgggcatggtggcacatgcctgtagtcccaactactcaggagactgagaggtgggaggattgcttgagccagagaggtcgaggctgcaatgagccatgatcgtgccactgcactccagtctgggcagcagagcaagaccttgtctcaaaaaaaatgctatgctgtatgctttattatattaatatccaatagaataaagacacatgccttctatatagagagaactaaattaataatggtgagataacagttaaattctcatttagcaggagaaataaaaacatagactataggctaggcacagtggctcatacctgtaatcccagcacattaggaggctgaggtgggcagatcacttgaggtcagtagtttgagaccaccctggccaacataatgaaaccccgcctctactaaaaatacaaaagttagccgagtttggtggcgcatgcctgaaatcccagctactcaggaggctgaggcaggaaaatcgcttgaacctgggaggcaagggctgcagtgagccaagatcacgccactgcactccagcctggggaacagagtgaggatctgttaaaaaaaaaaaaaaaaagtggactctaataatacatggacacatttagtgaaataaacttaactgagtagagcagaacttataatattttaaaactgtaagaacatgtctgtacattagcaaatagtagatgagaatagtattttcaatatttacttctggtaatttggaattaaaaaaaaaacttttgggaaaatttacaataaagtatgattttaacaaaccaggctaggcgtggtggctcacgcttataatcccagcactttgaaaagcagaggcatgcagattgcttgaggccaggagttcaagactagcctgcccaacatggccaaaccccatctctactaaaaatacaaaaataaaccagacatggtagtgcatgcctgtgatcccagctactcgggaagttgaggtaggaggattgcttgacctgggaagtggaggttgcagtgagccatgatcgtgccactacactccagcctgggtgacagagcaagactctgtcccaaggttttgttttggttaacttgctgtccctttttccaggaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccaggggtgagtctgactgaggcctagtagggccctgcaagtgacatgcgttgctgttggatcaggagattagtatttgttcacggggagggatgtgtgctgagcagggtcgaggagcaaattttctaagtagtgaacatgaaattcaggtgtgtagacatgtacatgtgctgaaattgagaagcaaagctcaacctgggcaagggatatgatgtttctttggggttcttataaacagatctatcaattacctttgagtataataatgtttgatacaaaatgagtgattcctctgcccaggcactataatacaggctacatgtgaattttaatcctgaaaacaaagttattaggtagttcccagttgttctatgtttgtctgttttgttttgcttgagatactgtcttgatctgtcactcaggttggactgcagtggtgccatcatggcatacttcaccctccacctccctgactcaagcaagtctcctgcctgagcctcccaagtagctgggaatgtaggtgcatgccaccatgcctggctaagttttttatattttttttgtagggacagagtctcaccatgctgcccaggctggtctcaaactcctcagctcaagcacccacccaccttgggctcccaaagtgctgggattataggcatgagccactgtgcccggcctctatgttttacagagaatatgtgccttagacacatcagataacattctgagacagtaacttgcagacaaaactggattgcaagtccacctcactccagagccttggctttgctcatcagcattcagtcatgaaatcaaaacttactctagatactttcaaggagggagggatttcatgcaggttgtattagtctgttctcacattcctataaaaaactacttgagcctgggtaatttataaagaaaagatgtttaattgactcagagttctgtaggctgtacaggaggcatggctgggaaagttacaatcatggtggaaggcaaagaggaagcacgcatatcttcatatgcttggcaggagagagagagagagcaaggcagaggtgttacagactttgaaacaagcagatcttgacagaactctatcacaagacagcactagggtgatggtgctcaaccattagaaaccacctccatgatccagtcacctcccaccaggctccttctccaacactgggaattaccatttgacatgagatttgggaggggacatagagccaaaccatatcgcagctaataggtcacaaaaatgttagaagggcaggaaaagcaataggacaaaggcaaagttacgagagatcagggagctgctgtggctcccagtctacagcacaggagcctggagtgatggtgaaatggccagcccctcccactgagcaggcagctccctgtaagctgctaatactgcaggagccaccattgctgccagaatgcagctgatattgctggagccaaagtcattggcatcgttacaattgaagctgtagctactcactgaagccatctatactgccactgcctgagccacttctagaagtagaacagattctgccatcatcctgctttttaatttggtatatatgcctccaattggcagaacctaaccagagcctagctatcaaggaagatgaacgatttatttttaaggcctccattgttagctgtcaaaagacagtgcagaagtgtgaggctgggggccaacagaaatttaaccagcacagcacctcaatattacatcaccaggcattgattagtccagggaaacactgggtgatgagccctgaaaatggacattacagcatcagagtatttacaaactccttaaagaagtcatttttctattccaatcccccatttgatgcttgagaaagctgaagtccagaaaagggaactgatctgctcaaagacaaactgaaattactttttccattttataacagttttatgtaatttatttgagatccaaatgtgttttgatttcccaagatcagatcaactacattaagagagagcctgagatgccgttacaatatgttgtgtgaaattacactctcattatggtgacagtaggtctttcagattttgttcgacagtttcccaccttctcactgaagtgaaatgaatgactaggcagcacctgctacatagcatgaagagaggagacccatagttctttaccaccctatgtcaggtggccgctgagagaagacttgaaaggagatgagcatagatgtatggacgctctttgttgcaccagtgtgataggtgatggagggacctattagatgggacatgggcaggggcactcctttattgcttaaaatgcaagactaaattggtgatgcctttctagaaaggaagtatgaagatacaaaaatccatcattcctcccaattttgtactgggtgaacagtaattggaagcattctagaaggaactgtccattgtgaaatcttagttgcatactttagatgaaaaacaatgaattggagatacctctgttttagtcacagttgtgccatgtgtcagttctatgactgatggcaagacatcttccttgccccgtgtatttagtttatcaatgtaataaggctgttattctaactttattattatatatagattcgtaattattattcccttggccagtttaacagtgagaaaaaagttgttttcacacaattagctgtactttgtttctctctccccagtatgtcagccacctccagatgtcctgcatgctgagcgtacccaaagggacaaggacaacttttcacccgggcaggaagtgttctacagctgtgagcccggctatgacctcagaggggctgcgtctatgcgctgcacaccccagggagactggagccctgcagcccccacatgtgaaggtgactagactcttatctggcttgatatttttagcttgcgtctttattctccacatgccagtgatttctgttcgtttttctttatctccagtgaaatcctgtgatgacttcatgggccaacttcttaatggccgtgtgctatttccagtaaatctccagcttggagcaaaagtggattttgtttgtgatgaagggtgagtatgagcttgcctgacctgctggacattgaaattggggttgggaatcagtctaaaaaggggagatttggtgtggcttaaaagaaagacacacacacacacacacaccttcagagagatgaactttcgaaagtatacctaggaagaaaggaaagaaacatatagaactaataacatgagatatgaagaggaaactggaacatatattaactggcaagttcaaaggcaagtataactagtggttatgaatatataggtaacacattaagcaaaaaatatcagccaggcacggtggctcacgtgtgtaatcccagcacctttgggaggttgaggcaggcagatcacctgaggtcaggagttggagaccagcctggacaacatggtgaaaccctgtctctactaaaaatacaaaagttagctgggtttggtggcatgtgcctgtaatcccagctactccggaggctgaggcaccagaatcacttgaacctgggaggtggagtttgcagtgagccgagatggcaccattgcactccagcgtgaacaatgagtgaaactccatctcaggaaaaaaatcatattttacaagcaaaagggaatatgagtaatttagagagtcccaggaaaaattgcaagtaatgaaaagcttattattaaaagctaggatcctttaagaatcatttcagtaaattctttaaaccatcaacagtgaaatttgtaataggactgaaaatgtaaaaatcagcatttttttaaaaattcagtcatatatcttctggctagtcatgggctctgggctctgagctggggtcgtgatggctgctgttaatattcccagcaaggtcattaccttgtttatgtccatctagtgctcttcacagcgtgcacatctctacacaggagctgaccggcatgggcaacaaagcacctgatcccataatgtaacacagaatcttggcagcctccaaatgccagcacccagtaagagttaggagggcatcagggtccaaaagactgagaattttcgacaattgcatacaaaaatcatgtcctctcttctttcctttttcccctagaatattcatgcttactcttcagcagcccaaactgcccttttgagccttcttcacgccatcacagatgtggagatgaaaggacaatctctgttctctcgccagctatttcccacttttccactccaaactgggagctgttttacttgctgttccagggtcagagttaggaaggcattacattagaagactgggtttctaataacaacaatgagtgatttatcaggttatcatggagtaatcagtgaaactccaagcctgggtcctgggtcaaggggatggcgcctatgtcatgaccacctttttcaattcaagcaggactatcatgtgaccaagctactacattttgccattctatattgttcccttctggaggctgtgatttttccagaataaggtagcctgtgcaactctgccatctgctggcctcagatcctcaaaatcctgaaattggggctgggccttagattgtgaactaagtgtcctcttggctgaaacagctcactattcactcctattttcttctttagatttcaattaaaaggcagctctgctagttattgtgtcttggctggaatggaaagcctttggaatagcagtgttccagtgtgtgaacgtgagtaataggagcaacatttcaggccaatctctccccttcatctgttcactatttgtcctatggcctccctcaatgtgattcttcaatattctagtcttaattatcgatttaaaaatagtttattttaataatgtttggttgtgaatcaatatgtacatcacctgtctttgcaaccatctgatctgtctctgtccttctgcattctctgttctagtgcgataaatcctttggtcttgtgctcctaggtcaggagagattagataatgtgaagctttaacaattttctttctttctctagttttttctttcttttttctcttccttccatccttcagttctttcttcccttcttctctccttctcccctttcttctttccttcctcccttctttctttttcattttgttctcccatcaaagtgcagtcagtctacaatttatatatatatgataatacacaaatattgaacatggctttatttaatcaatatttattgatcacatactttgtgcctgatgttcatctagccactggagttatatcaatgaacaagatggatgaattccctgtccccatgttgtttctacttaggtggggagagggacaagaaaaaaaataaattcaatgctatgagacaatagagcaaagcactgaggaatgaggcaaaaatggggagcaacattagacagggtgagcagtttgagactccttaaattctcaaaacatgtacctaaataatttatgctgagagattcataaataataagtcatttttttaaaatgagcctcatatgttcaataatcagtagactactgatttctcctagtctacccatgtataatttccccaatggaagatagaactttgcttcaattcttgattctaatgattggaaaacgtgtttctttagaaaatcatgaaattttactaaaatgtttatgttgttagaaatatacttggacatcttacagtgatttttagagtaaaattttggaagaacataacttatatagagattcttgctgtctaagaaatccagtgctccttgaagcagtatgacaagtgtctgttctactatcatgaatgaaagctcattaactggactactcaagctttctcttatttttcataactcttgctagttaaaatagtttcttccaaatgccagttctaatgaaaaatgccaattagaaatgaggaagagactgttctaaacaaatcattagatgctagaaaggagtaacaacttgaaacctgacccagagagtaaaaagagaaaataaatcatcaacagacctagacattttcaaaagcaaagccatctgaatccatttggagttttttttttttttttatcatggcctgactatgtttcaattcactgtgacagggctattgttatcactgagattgatgatcaatatcaataagtaatcagtgaaaggtttcacctatttaagatgattagcacacatatatacatttgagaaatatttcctaagaatgtaggctccttcctcagcgctgtgtccccaggatcctgatgaagggctgacacaggataagtgctcaattaatatatattgactaaatgaataaataacccttcaaaatggttatttttcttcttcaaatgttttgctacttcattaaagttgtaaagtttctactgtccaggaactgttactatccggaagattcaggatagacaaatctcttttgtactttgcaatacattttcattgacatctcatttaatccaactcttcaaagtcctaatgtctactgtcatctccttagcatattttcagcaacaccaatcatagcaccctgtaattgcagaatacctctggtgaaactcctgaatgaaacttagagcttttgtatgttttctagaaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctgggttagtgctcatttccccacatccctaatgggttcagaatatctaacccagcccctccatatttccataattacagtgtagtatttatttgtatgtatgcatttgccacaatggaatgccaaaccaatgatagatggttctaaggtaggtcaacacataagatcctgatgacctttgcagatggagggactgatgaaaaaagagggaggcggtgagtggtgggaaagtccttcattagaatcatatgaattaaaaacagatgcctgtgaatctccttattgaaatgtttggtttagaaatctgacctagaaaatcggtggctccttctgccaggaaacgtcttgagttcccgcccatgcttgacagcctctcattggagttttgatgacttgaagtacaaggaaaccagacaggaaaggtggaacctgggcagaaaaactctttctggcttcctaaaaatgtgaaaaattaaatgggagctatctttacattaaattatatgagcattagctgagcgtggtggcaattgcctgtggtcccagctactcgagaggctgagatgggagtatcccttaagcctgggaggcagaggttgcagtgagccaagattgtgccactgcactccagcctgggtgacagagcgagaccctatctcaaaaacaataaaaataggcattaggaggccaaggctggtggatcactagaggtcaggagttccagaccagcccgcaaacacagtgaaactccaactctactaaaaatagaaaaaaaatttaaaaacaaaaataaattatatgagtagaaagaccagatagcaggctagtcttccaaataatatacttccttataagcctatgctaatggaactttcctttctattttacagggaagttttttttttttcataactaaaattttcttttcttctggcatcaaatctaccaaggaagagaaaagaggaaacacactgggtatctttttattaactcaaatattcttgatttcttggtctctaggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtgcgtaaacttgcgttggatctttcccatgtctgcaaaagcttcttatggaattatttcaaatgtgggatatgagaaaccttttctgaaaagtgttcggatagatggatgtaagagtttttcttgtaggcatccttgattgttgcttgaaatgttaacttcatgagaatgtttcaagaaatagttgtagagaaaatcttcattccctatgggaaagaaaataataaatgactagatcaggaaaaaaatggtgtaggaagacaaattctgtttgaataactaggtgggaagaaatcctttgcaaactttgaaatatattgatagtaaataatgccataaatgacctttacattttgataagggatgcaaggtctctacacagatctaaatctagatctagatagatctggagggaaggtctttttgaaagtggggcttagtaggtggctgatcctcagcgctctgatgagttttctcaaggtgccaaaatctgtggaaccatcagagccgcgtgttttcttcaggaagctacatgcaggttgagaccttacgtactgaagagagttcagattactctacctggctccaaaacattttctttcccacaggtaaatcatgtaaaactcctccagatccagtgaatggcatggtgcatgtgatcacagacatccaggttggatccagaatcaactattcttgtactacagggtgagttggcagcaacatctcttggtttaagagttccagcacagcgatagtactttctagccacatctcagcaaggaaactaggctattgccacctgctcttaagaggcttgaacacaggtgttaactcctgattgaaatgaacaaagataggagaagattagggggaaaatctgtatccttgctggaaaccagggcagtgcacatataaagagtatgctgttcactggatgggaaagaaaaaaacttagaagtgtagtagtcaaagcacacaaacaaccctaacccagagtagacattgctggaagaaagggaagaccatgtagcagctgtgtgagagaatgaatcttaatgataacagcatgatcccttgctagggctgccatcaaaaagtacaggccttcctcgttttattgtacttcgcagatgttatgctttttacaaattgaacgcttgtgggaacgctgtgtaagcatgttcgtcggcatcatttatccaacagcgtgtgttgacttcgtgtctctgtgtagcattttgattattctcacagtatcccagatgttttcattattatcatgtctgtgatagtgatctgtcatcagtgatctttgatgttactattgtcattgtttggggtccctacgaactgcacccatataagacagaaaacttaatcaataaatgtgcgtgctttgactgctccatggactagacattccccttctgtctccctctcttcaggactccctaatccctgagacacaataatactaaaatgactccaattaataaccctacaatagcctttaagtgttgacatgaagggaagagtcatgcatctcttactttaaatcaaaagctagagatgattaagcttactgaggaagatacgttgaaaaccaagataggccaaaagccattcctcatgtgccaaacagctagaaagttgtaaaggcaaagtaaaaatacttgaaggaaatttaaaatgctcttccagtgaacacatgtatgataagaaggtaaaacagccttattgctgatatggaagaagttttagtggtctagacataagatcaaactagaaacatttcctgaagccaaagcgtaatcctgagcaaggccgtaactctcttcaattctgtgaaggctgacagaagctggaagctagcagaatttggttcctgaggtttaaggaaagaagccctctccataacataaaggtccaaggtgaagcagccagtgctcatatagaagttgcagcaagttatctagaaaatctagctaagatcactgacgaaggtgttacactaaataacagattttccatgtagacaaaacagccatctattggactttcatagctagagaggagaagccaatacctgggttcaaagcttcaaagaacaggctgactttttaggagctaatgccgctggtgactttgagttgaagccaatgttcaccgaccattctaaaaatcctagggcccttaagcattaagttaaatataccttgcctgtgtctataaatggaagaacaaagcctgatgacagaggtatgtttgcggcatagtttactgaatattttaagcccactgttgagatctagtgctcagaaaaacagattcctttcaaaatattactgctcattgacattgcacctaagcagccaagagctctaatggagaaggacatggagatgaatggagttttcctgcctgctaacaacagcagccattctgcagcccatggctgaaggagtaattttgactttcaagtttcactatttaagaaatacattttgtaaggtgagtccccacagacagtaattcctctgatggatctgaacaaaataagttgaaaactgctggaaagaattcatcattctacataccattaagaacattcgtgattcatgggaagagcttaaaatatcaacattaataggagtttggtagaagttaattccaaccctcatggctgactttgagaggttcaagacttcagcggaggaaataactgaagatgtggtgaaaatcgcaagagaactacaattagaagtggagcctgaagacgtgactgaattgcgacaaattcatgatcaaacttgaacagatgaggagttgcttctcatgaatcagcagagaaagtggtttttttgaggtggagtgtcttcctggtgatgatgacatgagcattgtgaaaatgaccacaaaggatacagaatattacaaaaacttaggtgataaagcagcagcagtatcgggaggattaactccaattttgaaagcagttcagagggtaaaatgttatcaaacagcattgcatgctagaaaaatcttttgtgaaaggaagagtccatcaatacagcaattttattgctgtctcagcttaagaaattgccacagccaccccggccttcagcaaccaccaccctgatcagtcagcagccatcaaccttgaggcaagaccctccaccaacaaaaagattacaaattattgaaggtcagataatctttagtattttttatcaataaacctttttttaaagtatgactttgtttagacataatgctatttcacacttaatagactaccatatagtataaacacaacttttagactcactgagaaatcaaaaaattcatctgactcatttgttgtgatatgtgttttattgtggtggtctggaactgaacctgcaatatatttgaggaatgtctgtaacacgaagtgggcggcttaatacaacagaagtttttggagttccattctagagactggaaatccaaaatcaaggttttgggagggccacgctccctctgaatcctgtagggaaggatccttcattgcatcttccagcttctggagccacaggccttccttggcatgtggcagcagaactccaatttctgtctctgtcctcatatggccatcttccctctgggtctgtgtcctcatatgctgttctctctgtgcatgtctgtttccaaagttttcccttttaataaggacaccagtcacactggattagggcctactttcatgacctcaccttaacttgattgcgtctgcaaagattgtatttccaaataagatcacatccacagggactggaggttaagacttcagcatacttggggggagacacaattcaacctataacagagcccctttgaaaatgtcaggcatcaggtgctcacagcacacggtccagctgttggtgctcacccttgctcagcacacggtggaggctctgcctcaatctcattcttcatgggaacagctaagccaggtagcgaatacgggttatgtttgtgtcaccacaacagacactgaaaggaagtttgtggtgtccagcacacttgccagcataggcctcacagaccacagcacctagaatctgacaaaaattagaataaatccgatgtctccttttctctcttttttttaagcatttttaaatgcaattggtaaatttcctgactgtaccctactcatcttgcattgctgaataagtgaggaacctctctatggcatgaagcagaaaaccattgagcttatgagaagaaacaggaaatacatgtaaaagagaccagtctgaaaaatcaggagaaattttacaaaagagatttactgccaagaaaccagggaaactttcagaacactctccttttcatatttgtaacaagattcaattgtacaaatacttctgtgaaactagccatgaagtgtgtacatgaatgaatatatgtattcagtgtgtttatatatttcatttcatacatgtgatctatatcatatatatatatcacaatgaatattgcagaaaattaaagcaaagagtaagaagagttaaccaaatgttccctgaatgcagtgagaaaagatgaaaaggagaagacaggcaagcacagtggctcacatatgtaatcccaacacactgagaggctgaggcaagagtatcacttgagcccaggagctcaagaccagcctagacaacatgacaaaaacccatctctacaaaaaagtataaaaattagctgggcatggcagcatatgcctgtagtcacagctaggcaggagactaaagtgggaggatcacctgagcccaggaggctgaggcttcagtgagccttgatggcaacctgcactccagcctggatgacagaatgagaccctgtctcaaaaaaggaaaaagagaagacatatgtaacacagtgtcaggattcaaaatacatgtagcaaaaattccagaagggtaagcaaataagcccatacctagccatcactagggaaacttctgtgtttcagggatagagaaaaaaactctgattccagaaataaaatgtgaaaatataatacccgcaaaagaaataagtttattgacaccacattgattctatacaacactaaattgtagaagatagcatttctcttgagccaagctaatattcacacctagaggctccagatacacattaaaggataagaaagacacaaaaattgtaccatttaagtatgtttcccaggtaattcataagcaaatttttaaaaaggagaatgatgaattccaaaggaaatctcaatgagataggatattggtaaaaagaaaaaacaacaataaaaaaatacacacaaaaactcggcaatgtaatcataatttactaataatctctctaaactcatagaacatatcaataaaactagaaaatgtgagacagcaagaaaaggtaggctaaacttacattacagaaaagatgagtagactgactatatagagtttgactctaaaattgagaaaataggtttaaatatctgttgtgtgcatatccatgtgtgtaatatacatgcacatatataaaatgaaattcctcattagaaaaaataataagtttaatttccaaattattagaataactaaaacagctgaatctatctcttccatatagcaagtgagagggaaagaaaaggaaagacaaggaatgcatttgtctcttccaccagaaataagccccctcatttttgggtcaggtcattttattcattgctttctccacatcctcatcattgggcatcatgaaatcaatgaaaaaggcagtgaaagaatgatgatgaaagcaaatcaaatgtatcatttatctcaatacatttggtttaatcctcttgttgaaaaacaaagtctcttagacaagatcaaaagcaacaaatcttgtatttataaaaaacatgtctcaagtaaaatgacatagtattatacacacacacacacacacacacacacacacaaattaagtgaaaatgcaaacaaaaaaaggcaaaaataatatttagagaaagatagaatttaagaaaaaaattgtcaaactggtctacaaaataattgttttattttcgtgccagttgcagtccacagtgaagccaagatattaagaagcaatgtgggccaggagaagttagagcagaaatatctctttcaataatgaaagaataagaaaaagaaatagaagagctggaaacaataggtaaagtttaggctaggccttagacttctcctgcattgtaatccttctggtttgccacatatgcatgctgtcaggaagttgatgaggtatgtacaggacaatgattttccattttttgcctttaggcaccgactcattggtcactcatctgctgaatgtatcctctcaggcaatactgcccattggagcacgaagccgccaatttgtcaacgtgagttgaaatctctttccccattcaccccaccattgaatcctagagttgtcctcctagaattacaaagaatggatctcatccctcttggaaatggtatccttctgatatttgaagaatctagtcatatccttaaaatggctcacagcattccaaacttccgccttcacctagaaatgcttttttttttcttatctcagtctaatgtattttaaactagtctttagctcatttaaccagcccccaatgtcctcttctgttggttgagcacctcgcagtttgaagagcattttgtttagtgaagtcaacaaatacaaagtcagtgaaagaaaccccatatcctctctgcaagctcttagtatcacatcagatattcaagccatgcagctctttcttccttcttattctttgtctaaacaggatcatgccatcttccctgtgagttgtttggaagatgagctttctacattttggggagcaaagacgaatgagcaattgcaagctaacagggaatataaaatgtgtataatcctgggtttagtgatggtgtgaggaaatcagcaatttcaaacccagttggtggcaggataagtgggaacaaactttgtagaaggccaataaactggctgggcactgccctacagtagagtaggacacagtattcagttcttccaagatcagacgagattgggcgcattcagggtggtatggctgtaaatcagtatccagttctttttattacttctgaatctgtaagtatcatgtttattatatgtaatattgtatatttgtgctttgtctttattagttcttccagagcttttgttcttattatttaataaagatgttatactgagccacgtgtggtgactcaaacttgtaatcccagcactttgggaggcctaggtgagcagatggctttagcccaggagtttgagaccagcctgtacaacatggtgaaatcatgtctctacaaaaaatacaaaaactaaacaggcacggtggcacatgcctgtagtcccaactactcgggagactgagaggtgggaggattgcttgagccagagaggtcgaggctgcaatgagccatgatcgtgccactgcactccagcccgggcagcagagccagaccttgtctcaaaaaaaaatgctatgctgtatgctttattatattaatatccaataccataaaggcaaatgccttctatatagagagaactagattaataatggtgagataacatagttaaattctcgtttagcaggagaaataaaaacatagactataggctaggcacagtggctcatgcctgtactcccagcacattaggaggctgaggtgggcagatcacttgaggtcaggagttcgagaccagcctggccaacatggtgaaaccccatctctactaaaaatacaaaagttagccgagtttggtggcgcatgcctgtaatcccagctactcaggaggctgaggcaggaaaatcgcttgaacctgggaggcgggggttgcagtgagctgagatcacgccactgcactccagtgtggggaacagagtgaggatctgttaaaacaaacaaacaaacaaaaaaaaaacacatggactctaataatacatggatacatttagtgaaataaggttaactgagtagagcagcactcataacattttaaaactataagaacatgtctgtacattagcaaatattagatgagaataatattgtcaatatttacttctggtaatttgaaattaaaaaacaaaactgttagcaaaatttacaataaagtataattattagaaaccaggctgggcacggtggctcacgcttataatcccagcactttgaaaggccgaggcaggcggattgtttgaggccaggagttcaagactagcctgcccaacatggccaaaccccatctctactaaaaatacaaaaataaaccagacatggtggtgcatgcctgtgatcccagctactcgggaggttgaggtgggaggattgcttgacctgggaagtagaggttgcagttagccatgattgtgccactgcactccagcctgggtgacagcaagactctgtcccaaggttttgttttggttaacttgctgtctcttttccaggaattccttgtgggctacccccaaccatcgccaatggagatttcattagcaccaacagagagaattttcactatggatcagtggtgacctaccgctgcaatcttggaagcagagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccagagttaccaagctgctccaggggtgagtctgactgatgcctagaagggccctgccagtgacatgtgttgctgttggatcaggagatgagtatttgttaagggggaggtatgtatggtgaggagggtgggaaagtaagttttgggggaagaagcatgaaattaagaattgggggtgtgcatgcacccatgcatatgtgtcttcatttggaaagcaagaccttaattagccaagaaaaaagctattttggactcacctattatttgattctcagggcaaagtaccagctgcaatctctctcaagtatattgaaaaattatatggactttctctatgatcagctatgtgctaagcactttatatgcattttctcattcattatttacaacaacactttgaaattgtgctattgtattatccatttaatagtgacatcagcttgatctttcagaggttaaataaattagctaagtcacatgttctaagcgagacacccaggattttaaaatgcaagtgtatcagaccccagagtctgaatgttttggctcttgccatactttcatcagtatccattgctgaaagaaagagactggcttacaaagacagaaatcatagcctcagaatagacaaagaccttagagtttgtctataatggtctgcctcctacattttattttgattttattttatttaaaaactatttattagagttgatgtcccactctgttgcccaggctgaagtacagtgatacaatcatggctcactgcagcctcagattcctaggctcaagccatccacgtcctacattttatccctaggagtctaagtcaagagtgaaagtaacttgttcaaagtcagttaaatatttctaaattcatgtttaatgaggtatagattaggttgatgttaaaatgggttctgatgccctaagcatgaacgaacaggactataaataaaggcagatgttgagtcaaatactctccaaataatatgccctctcgtgacaaaggactgtcttatttaatggcttgtgtttttgatggctcatcttgtctactgatgccacaatagctggcttagcagctgtgtaggaggtgttatggttgatacatagggacagagaaggagcttacgattcttctaccaacccatgttagccttgtgcaaccactgagctgggaagatgaacagataaagggatataaagacggatgtactgaggcaggagatgggcagggcttgtgttctggtcacaatcctgctgaccaaaacaggctctggcccagacaggatgaagtgaaaaaacagcaggaaccagcagatggcgatgaaagcaattgctagctgccctcatagtcccatcagcaccatgacagtttacaaatgccatggcaacgacctagaagttaccgcccctttcctggaaagttctaaataactcgcccctcaatctgcattgatccactccttaatttacatgtaactgaaatgggtttacagcagtataaacacagttgcctgccaggaacccttatgttgctgactctgggtgtgctgcctgtgagttagccctgctctgcaagaagcagtgcctttcactaacagattgctgtctagcaccactggctcatccttgaattctgtcctggatgaggcaagaacccttccagagtaagccccaatttaggggcatgcctgtcccgaaacagtatgactgtactttagtcattggtgtgcaatcagagaaattgggggaaatctgtaaaacagatttggtctcaggtgacagtctcattacctgaataacaatggtacaaatcgggattaccttcctaggaaatatgtagatggagaatccaccaatactgataacttcacattggatagccagagctaggagaaaatacctcatgccctgtagatttacaagtgaatttggggccttgtgctagggagaattgggttctatttctctacctctgactagctatgaggtcttcaggaagcataggaaattcccccataactaacaagtactctggaactgtcctttccacagtgtgtcagccgcctccagaaatcctgcatggtgagcataccccaagccatcaggacaacttttcacctgggcaggaagtgttctacagctgtgagcctggctatgacctcagaggggctgcgtctctgcactgcacaccccagggagactggagccctgaagccccgagatgtgcaggtgcctcaactctctggcttccagatttctctctttaccccacacatggaggtcttactcctattttttcttttttttttttttcttcttctagtgaaatcctgtgatgacttcttgggtcaactccctcatggccgtgtgctatttccacttaatctccagcttggggcaaaggtgtcctttgtctgtgatgaagggtaagtgtgacccagaattcagatcagggactcagcactgcagagtgactcttgagcttaaggatcaatccaaaaagagggctgacctaggagaagaagaatccagggagattaacctctggaagtgtagctttaaaataaaggtagggactaagtggcactactatcaggagataaagagataaagaaaaaatggcgcatataactgagtgtcaagtacaaacagaaatacagtcaccagtccagaaaaggggaccaacctggtggaaaagaagtactagaggagactaatatctgaaacaatgattggaaagtgtggtatgaaccagctggatccatgaacagaagtttaaaaagcaaaaagctcaactcatttgatttctcacttatagaggctcagaagtaaaatcattttggaaaacgtgcagcttccagtaaggcacaaaggaaaaacaatggccgaaatacaaaagatcttgaaaaaaaaagtgtgtatatatatgtatacatacgtatacatatggacacgtatatgtatacgtatacatgtacatgtgtatacatatgtgtatacatggacacgtatatgtagacgtatacatatggacacgtatatgtagacgtatacatatggacacgtatatgtagacgtatacatatggacacgtatatgtatacgtatacatatggacacgtatatgtatacgtatacatgtacatgtgtatatgtatacgtatacatgtccatatgtatacgtatatgtatacatatgtatatatacatatgtatatacatatatatggaacatatgtatatatacatatgtatatacatatatacatggaacattagatgtatgaataaataataatttgcagacatgaagagataaataaatattctaggggttgttaagaaaagtttgatatataagagaaagttgtatataagataaaataacatgcaaagattatttcacaaaacttttaatcaaataaatagtggaatttggaataggaacgaaagagtaagtagaaatattctaaattccaattacatgtgattgacagctctgccagctattattgctttgtcctcactgaaagctacactttttccaaaatgatttggcttctgagcccgtcaatgagaaactaagtgagttgagtgttttcacctgtgctttagcttgagcagtaaaatgttaattaacttaggaattctcagggaggaggttgagatctgtcacgaagggaagagagaaatggtgcattcatccagccactactgctttgttctttaggtttcgcttaaagggcagttccgttagtcattgtgtcttggttggaatgagaagcctttggaataacagtgttcctgtgtgtgaacgtgagtagatggaatacttgttcagtctggatctttctgtttttttcttaatatagtttgccccatgggattatctattgtttgtcccgctgtttgtgcccgcttttgatagaaattgttctttgttggaatagatacaagcaatgttttggggaaaaataaacatgagaatcatgtgttttgggtaccatcctataaatatttatgaggagagtctgtgctataaatagagagaaatgcttcatagaaataaatgtatggcaagatgctaggctaaatttttctcttctttcctgtcaaaagtaatagtcatacttcaacttttcagttcttccctcaatcatccatttagtcatatactcattctttcaacagaaaattatttgagcacctactatgtgccaagcaatcttctgggaactggggatatacctataaacaagacagataagtccatgtttaagtttttgtgcaaggataaagacaaaaatcaaagacatgaatagaaatgttcaaatgatactaagtgttattaagaaaatgctcttaattgagtcagtgctgtcaattgagaatgtagctgaggacccaaaaggcaagtgtagcccagcaaacctctgggtgtagctgagggttcaaaatgggaggctgttgcagcaatctaatcagagatgttggcccaggatagcaattgggaaaggtgatgatgagaagtgatcaaattctggatatattttgaaggtgcagatgacaggatttggtgatggttagcttagatagagggtgtgaaagaaagagaagaaacatagccagtttccaggtttttggccagagcaaccgccagggtagaatttcccttagctgaaatgcaggggactgcatgaagtttgggaatgggggaaatcaaaagttaagcttgggacataactttagtgttcctcttagatatccagatggatatgttggagagtcccaggctgcccatagatatgtagaagccatcattgtatctgctatgcttgaaatcaggactgaaagagatcttcacctagggagtgagtgctgctagagaacagatgcatggactgagcctggatgtccaggattaagagttgcaaaggtgagaaggaatcagcaaaggggattatgatgaagcagccactgcagtaagagaaaacacaggagggtgaggtgccctggaagccaagtatggaaattattttaagggattagactaatcaactgtgtcaaattctatagagaggtcaaattaggtgagaacagaaaattgatctttgggtttagcaacttggaggtaacaagtggaagtttcagtggagtgctggcaaacactgattggaatgaattctagggagaatgaatgggaggaactgtaacagatcatagacaatattttagaggagttttcatgtaaagagagtagaaataggactatagctgaagagggaaatgacagcaagaggtttgcttttgatttttaagagggcagaaaatagtgtgttaaaaacagaaacactactatgtcccatctatccatttacttcttcactaaatcaatcagggtattgcttccccttctgatcatagctattaaaaatacatgtttacaatagaattttgctcatatgaatactttgccttaaatcatttcaatgtcttgtattgatttatatgatgaaaatgataatttcatcttacattgttggaagtcagctatttgacaatcttaacttccctggaatagttaagaagtatgaaagaaaagaaaaagaaaataccctcatgaacccaacatatacctgaaatcgcttactagagtgtaaacattggttaagctattttaacctttgattagtttatctataattcttttaagctgtaatatcctcttcccaaattcaaagcaaattagaaaagggaaggagtgtccccaaatagaggcattccaaggaataaatgtgtttctttaatgaaaaaaataaataaataaacccttaaaaaccaatgagtatctcaaaaaaccgtaacattcttgagccttttgaaacacatacaggagtacatagcatttttttttcattgtgacagcattactgcaatctttcatctgtattttgaaaatcatagcctggcatcatcaagaaaaattaaatcactgatatacaaataataaatgtataatatattttagaaagatgtctctaggatgaagactcttgatgtcaaagatcatatttatcctgtgctttaaacagtacttgacatacagcagatattcaaaaacatgcttgttgaattaatggatgattcccctttaatgtgactgtgaagatttttatttactttaaaggaatatactctttattattcagaaatattaactatctgaaaaatttaggatgcttaatttgggaaaggcttttgtaataaacattgatttagttgtcatttcatttagctccatcttagcagaggcctaatacatttattttgcagtttctactttccttaagaagaaaagtacgcttaattggcaacacagtcacagtatgacaactgtagaatcaccttggattatactttaaaattttttatggaattgagagctcttgttttctttctagatatcttttgtccaaatcctccagctatccttaatgggagacacacaggaactccctctggagatattccctatggaaaagaaatatcttacacatgtgacccccacccagacagagggatgaccttcaacctcattggggagagcaccatccgctgcacaagtgaccctcatgggaatggggtttggagcagccctgcccctcgctgtgaactttctgttcgtgctggtcagtatccacttccacatatcctaaatgggttcagaatatgtggacccaatccctcatgtttctgtaataagactatggtatttgtttgtgagcttaactttgtcataagtgtaaatgtcaaaattacataccatagctaaaacagatgggtttcagcagcgccaaggtatgtttgaatctataagatgaaaactcttcttgctggtggagtggaagagggtgggaaaaagggactgagggaggggtggagggaaggcagtaaggcacagttatgtaaatcaggaagaaaaatgtattcactggagacgacatgaaaacatctgcctctgaacactaaccagtatctgtataattgacagtctccataagttcatgaggggtacatgggcatgcaaagttcaaaattggaaatgtggatattatttagctaaggttttaaactagtgttctgctgcatgggctaagtaaccaaaaagactctctttgtcttgacttaaagtttgtccacttgtcatcttgcctccaggctgtcttaatctttgtacttgaactgttccactcagggggtaagaagcaaggaaagagtagcccaaagaaaagagtaggaaaaggaagaggctatttcttcctaaggaggggaagaagttgcctggtccttcagggcaaacattaggccttttccagagcagaaactggagtagattagggatgtggcaccagccttggaatattccattatccacagggaagccctgagagacaagagccagccaaggtgaaaagactaaacctgatgaaaggcatttaacctttctttgacctttactctccaactgagtggtacccatcagaatgcagtaaatttttttaatgtaaatgcctagaccccagtgcaggcttaatgaacagatggaggaagccttctccaaaaaggaggtaatggagttcagactctatttgaaaatatgcagcacatggctgggcacagtagctcacacctataatcccagcactttggaggccgaggtgagaggattgtttgaggccaggagttcaagaccaacctggccaacacagcaagctcctaactctacaaaaaataagactgaaaaattgtaaaaactgtaaaacaaaaaaagtaaaaatatgcagcacacaatatactctctcagaaagaagacatagcttcttacagaaggctgatggcttagtctgttttgttctggttctttttttgttttgttttgtgtgtgtgtgtgtgtgtgtgctttttttgagagagagggtcttactcttttgcccaggtggagtagagtggtgcaatcatagtttactgcagccttgacctccctggctcaagcaagcctcccatctcagcctgccaagtaggtgggaccacaggtgcatgccaccacacccagctaattcttgtattttatgtagaccggttttcatcatgttgcccaggctggtcttgaactcctgggctaaagcaatccacctgccttggcctcccaaagtgctgggactacaaggcgtgagccaccatgcccagcctattttgttctatctttaaatgcctggtttagcatcagaagaaaaacactgtattagtttcctagggctgctgtaacaaattaccacaaactaggtggcttaaaacaaaagaaacttattatttcacagttttgtaggctgaaattgagatgttggcagaggtattttcccatcttctaaggctctggaaaataaccaattctttacttcttccatctgctgctggttcctgggattccttggcattccttggtttgtggatgcatcattcaaatccctgcctccatcatagccttttcccctgtgtctctatatgtcaaatccctccactttttccctgatagggacaccagtcattggatttagggcccactctaaataaaagatgatctaatctcaagaacctaatcttaattctatctgaaaaaccattattccaaataagtttctattctgaggttttaggtagagatatcttttgggagaacatcattcaactcactacaaggggtacctgctatgaaaggccagagaggcagcttatgatgggcaccctgagaatggagtatggagagagatgataaaatatgtcttgctactcatgagtgaattagcacaaacacatgaagatttgagtggttaactgaggatataggcactccgataggaggtcagaatgtgaaactacaagctgaagttcttgctttggtgaaataagggaagaaagatcagaaagctgagtggtcttccaaatagtaaaaaaaatcctgctgagtagatgcattgaagagcttcatcccaaggtaacatcaaggagaagaaaatcttttgctattcttgtaagtctctttgtttctgtgatccacctatcagcttaattgaagagaaagaggaggtagggtggaagtctctctgctaactttgatattcctgtggtttttctctccaggtcactgtaaaaccccagagcagtttccatttgccagtcctacgatcccaattaatgactttgagtttccagtcgggacatctttgaattatgaatgccgtcctgggtattttgggaaaatgttctctatctcctgcctagaaaacttggtctggtcaagtgttgaagacaactgtagacgtgagtaacccctccctgggaactacttcatgtctgttaaagcataggtgggaccgggcttggtggctcacgcctgtaatcccatcactttgggaggccaaggctggcagatagcttgaactcaggagttcgcaaccagcctgggcaacatggccaaaccccacgtctacaaacaacaacaacaaaaacaacgtaggtgggatttgattcaatttgctcaaattttggaagcaagatgtctatatttgcccaagatattttgataaaggaaaggatggtcttgtacatcaccccttcttcttgcttgtagttcctgaaccttgactagatgctcatttcatgagaatggctctcacaaaagaattagagagaaaatttacattcactgtagatcatccttgatggctgacaccattaaatgaatgaaacaggggtacaaaagaaatttatgtgagttgcagtgaactgtgcttggctaactaaaaataggggagacatcccaaattttgaggcctttgattttggctggcggaatgagagtacaacactttagccataaatgacttgttttgtttttgttttgtttctgctgttgctgttgtgttttttgtttgtttgtttgtttgtttctgagatggagccttactctgtcacccaggccggagtgtagtggcgcgatcttggctgcaacctcctgggttcgagcaagtctccctgcctcagcctctcgagtaactgggattacaggcacccactcccatgcccagctaatttttgtattttttagtagagatggggttttgccacgttggccaggctggtcttgaactcctgacctcaggtgatctgccggcctcggcctcccaaagtgctaggattacaggcgagagcccatacataacctttattaggaggtgcaagatagtctttttcaaagttgtgttcgtagctacatgattctgaagttgtctgccaagtttcctcaaagcagtcaattccatgaaacaattggaactgtatatgctgtttagtatgccacactccagtctgaaccttacaaaggtaagttgaactctatatttaatcccaaattctgcttcttcccctaggaaaatcatgtggacctccaccagaacccttcaatggaatggtgcatataaacacagatacacagtttggatcaacagttaattattcttgtaatgaagggtgagttgagaataccatctcttgaatatgagttccagaacagcagagccaacttctgacccagtctcagatagacaaactaaactattgctccctttactttaaaagcaagcaataggacttatagatggagatgatacgttggacatagccatatgatcaaaggaatacaaaaaagaaggtacaatatgtattgtattgtaaaccagaggagggcaacatgttcctgtcaaaggtggtacatgtgaaacctggtcaggcattcattggatgaaaaggagcagcttacaaataaggaaaaggaaaaaaggtagttgaaccatgtaaacctccttaactgagatcagtaggtaatacagttgagttggaggaccctgaagcagagtttgggagggtaaacattaattgtaacagcagctctggaagagtatgcatcaaagtgcacacagagaggagacattatggggttcttgctcttgacttctccttgggacaagtagccacaccaaaagccattgcctcaactgagaaggggcttttaaaaactctggagtggacctccatcaaactccagcagacctgcagcagaggggcctgactgttagaagataaactaacaaacataaaggaatagcatcaacattaacaaaaaggacgtccacatgaaaaccccatccaaaggtcaccaacatcaaagaccaatgatagataaatccacgaagatgaggaaaaaccagcacaaaaaggctgaaaattcccgaaaccagaatgcctcttctcctccaaaggatcacaactccttgccagcaagagaacaaaactgggtggagaatgagtgagttggacagattgacagaagtaggcttcagaaggtgggtaataacaaactcctctgagctaaaggagcatgttctaacccaatgcaaggaagcgaagaaccttgaaaaacaggttagaggaattactaactagaataaccagtttagaaaagaacataaatgacctgatggagctgaaaaacacagcacaagaacttcatgaagcatacacaagtatcaatagccgaatcgatcaagtgaaacaaaggatatcagagattgaagatcaacttaatgaaataaagcatgaagacaaaaaaagaatgaaaaggaatgaacaaagcctccaagaaatatgggactatgtgaaaagaccaaacctacgtttgattggtgtacctgaaagtgacggggagaatggaaccaagttggaaaacactcttcaagatattatccaggagaactgccccaacctagcaagacagtccagcattcaaattcaggaaatacagagaacaccacaaagatactccttgagaagagcaaccccaagacacgtaattgtcagattcaccaaggttgaaatgaaggaaaaaaatgttaagggcagccagagagaaaggtcgggttacctacaaagggaagcccatcagactaacagtgaatctctctgcagaaaccctacaagccagaagagagtgggggccaatattcaacattcttaaagaaaagaattttcaacccagaatttcatatctagccaaactaagcttcataagtgaaggagaaataaaatcctttacagacaagcaaatgctgagggattttgtcaccaccagacttgccttacaagggctcctgaaggaagcactaaacatggaaaggaataactggtaccagccactgcaaaaacataccaaattgtaaagaccatcaacaatatgaagaaaccacatcaactaatgggcaaaataacaaatcagcatcataatgacaggatcaaatttacacataacaattctaacattaaatgtaaattggctaaatgcccccagttaaaagacactgactggcaaattggataaagagtcaagacccattggtgtgctgtattcaggagacccatctcatgtgcaaagacacacataggcgcaaaataaagggatggaggaatatttaccaagcaaatggaaagcaaataaaagcaggggttacagtcctagtctctgataaaacatactttaaaccaacgaagatcaaaagagacaagagcattacataatggcaaaggatgcaacaagaagagctaactatcctaaatatatatgcacccaatacaggagcacccagattcataaagcaagttctgaaagatctataaagagacttagattcccacacaataatagtgggagactttaacaccccactgtcagtattagacaggtcaacgagacagaaaattaacaaggatattcaggacctgaactcagctctggaccaagcagacctaatagacatctatagaactctccaccccaaatcagcagaatatacattcttctcagcaccacatagcaattattctaaaattgaccacataattggaagtaaagcactcctcaaaatgcaaaagaatggaaatcataacaaacagtctctcagaccacagtacaatcaaattagaactcaggattaagaaactctctcaaaactgcacaactacatggaaactgaacagcctgctctgaatgactactgggtaaataacgaaatgaaagcagaaataagtaagttctttgaaaccgatgaaaacaaagacacaatgtaccagaatctctgggacacagccaaagagtgtttagagcactaaatttatagcactaaatgcccacaggagaaagcagaaaagatctaaaatcgacgccctgacatcgcaattaaagaactagagaagcaagagcaaacaaattcaaaagctagcagaagagaagaaataactaagatcagagcagaactgaaggagatagagaaacaaaaaacccttcaaaaaatcaatgaatccaggagctggttttttgaaaagattaacaaaatagaccactagccagactaataaagaaaaagagagaagaatcaaatagacacaataaaaaatgataaaggggatatcaccactgatcccacagaaatacaaactaccatcagagaatactataaacacctctacgcaaataaactagaaaatctagaagaaatggataaattcctggatacatacaacctcccaagactaaaacaggaagaagtcgaatccctgaataggccaaaaacaagttctgaaattgaggaagtaattaatagcctaccaaccaaaaaaagcccaggaacagatggattcatagctgaatcctaccagaggtacaaagaggagctggtaccattccttctaaactattccaaacaatagaaaaagagggactcctccctaactcattttatgaggccagcatcatcctgataccaaaacctggcagagacacaataaaaaaggaaaatttcaggccaatatccctgatgaacattgatgcaaaaatcctcaataaaatactggcaaacaaaattcagcagcacatcaaaaagcttatccacaacgatcaagctggcttcatccctgagatacaaggctggttcaacatacgcaaatcaataaacgtaatccatcacattaacagaaccaatgataaaaaccacatgattatctcaatagatgcagacaagggcttcgataaaattcaacagcccttcatgctaaaaactctcaataaactaggtattgatggaatatgtcccaaaataataggagctatttataacaaacccaccactaatatcatactgaatgggcaaatgctggaagcatgcgctttgaaaaccagcacaagacaaggatgccctctctcaccactcctattcaacatagtattggaagctctggccagggcaatcaggcaagagaaaggaataaagggtattcaaataggaagagaggaagtcaaattgtctctgtttgcatatgacatgactgtatatttagaaaaccccattatctcagcttaaaatatccgtaatctgataagcaacttcagcaaagtctcaggatacaaaatcaatgcaaaaatcacaagcattcctatacaccaataatagacaaacagcgagccaaatcatgagtgaactcccattctaaattcctgcaaagtgaataaactaccttggaatacaacttacaagggaagtgaaggacatcttcaaggagaactacaaaccactgctcaaggaagtaagcgaggacacaaacaaatgaaaaaaacatttcacgattgtggataggaagaatcaatatcatgaaaatggccatactgcccaaggtaatttatacagtcaatgctatccccatcaaattaccaatggctttcttcacagaattacaaaaaaaaaaaaaaaaaaactactttaaacttcatatggaaccaaaaaatagcccatatagccaagacaatcctaagcaaaaagaacaaagctggaggcaccacgctacatgacttcaaactatactataaggctacagtaagcaaaacagcatcgtactggtaccaaaacagatatatagaccaatggaacagaacagaggcctcagaaataatgccacacatctacaaccatctgatctttgatgaacctgacaaaaacaagcaatggggaaaggattccctatttaataaatggtgttgggaaaactggctagccagatgcagaaaactgaagctggaccccttcctttacatcttatacaaaaactaactcaagatgtattaaagacttaaatgtaagacctaaaactataaaaaccctagaagaaaacctaggcaataccattcaggacataggcatgggcaaagacttcattactaaaacaccaaaagcaatggtaacaaaaaccaaaattgacaaatgggatctaatgaaactaaagagcttctgcacagcaagagaaactatcatcagagtgaacagacaacctacagaatgggagaaaatttttgcaatccatccatatgacaaaggactaatatccagaatctacaaggaacttaaacaaatttacaagaaaaaacaaccctatcgaaaagagggcaaaggatatgaacagacatttctcaaaagaagacatttatgcagccaacaaacatgaaaaaaagctcatcatcactggtcattagagaaatgcaaatcaaaaccacattgagataccatcttgggccagttagaatggcaatcactaaaaagtcaggaaacaacagatgctggagaggatgtggagaaatagaaatgcttttacactgttggtgggagtgtaaattcgttcaaccattgtggatgacagtgtggtgattcctcaaggatctagaaccagaaataccatttgacccagcaatcccattactgagtatatacccaaaggattataaatcatccttctataaagacacatgcacacgtatgtttattgcagcactgttcacaatagcaaagacttggaaccaacccaaatgcccatcaatgatagactggataaagaaaatgtggcacatatacaccatggaatactatgcagccataaaaaaggatgagttcatgtcctttgcagggacatttatgaagctagaaaccatcattctcagcaaactaacacaagaacagaaaaccaaccaccgcatgttctcattcctaagtgggagttgaacaatgagaacacatggacacaccgaggggaacatcacacagtggggcccgtcagagggtaggagtccaggggagggatagcattaggagaaatagccaatgtagatgatgggttgatggtgcagcaaaccaccatgacatgtgtatacctatgtaacaaacctgcacgtcctgcacatgtatcccagaatttaaagtatgataataaaaaaaagactgtgtactcatttttggttgccatgataaattcagagaggaaaaacatgatatatattaaattttactgcaacaactaactgccccttgtcatcagcctattctgtcactagagtgagtcagtattcctcttttctgactgtctgagcctggacgatttaaactgcttttcacacaacctcttgcccaaccttttctcacctcccattgtgaatgaacatagatttccctatggtaaacaaaacaaaatatcaccaaatctaaggcaagataaagaaattgaagataaaagaaaccaacccaagagatcagagaaatattcatctgcacaacagcttcctccaataaacaggggacaatctttaaaaatctctcatatgtgtttgtaacatagaatcgatggaactatatgaggcatttataagatttaatgatctgatatcagaaaagttgagatttgaatgaaacacatgggagtcggaaaaggagtgatgactggtagattggagcctgcccccaacccccggaaaaaaaaaaaaaaaacaccaaagggataatgaagacaagattgaattctccagaattcatcaaggaccagacttgaaatgacacatatatacacacaaacacactacacacaaacacacagggatataatatagaaattccagaaaaaataaaagaaagcagaatgaatagaagcattaattagcacataatggaagacaatttctcaggctataaagaaaaatactaagttgatccttgaaggcttactagacaaatcaagattaacaacaatgggccccggccctacatggaagaaaattatgccatccaaatataaaaaaatactgccactctccagaaataacaaaaaagaagaaattcatcttagcaccaagcttccgttctgtaacactaagtagtagaagttagtgtttgagaggaaatattgtacaataaaatttctgtactcggccaagctgccattcatctgcaaggcacagatgcatcgtcttaaataagaaggaaccccaaacatacaccagttagatatactgcctacaaaaagaaaaactcccacaaagctgtgggagtttttctttttgaagaagaaatcaaaattccaaatggtgttgtatcaaagaaatattaatgaggcacaaaactagttaaatggggtcactaaaactgttttatttaatatggaaataaaatatcaaagcaggactaattcttgaaagataattcatgtaatatgaaaagaagaagaaacttgatataaaaaatagattttatcacttcagctaggaagttagagatgaagtaagaaaaaccatcataaacttatcatatgtaggggacacatattcttgacataaaaaataaggagaaaatggtacttcacaccagtataaaatctatatatctatatctatatatatctatatctatatctatatatatatatataatcaaattttaaaagataatcagaagggcgaaaccacttggtccataaaacaaaagaggggtgagagaaacaagagctagcaagctttctgtctctcttttgggaaactagcattattacgttaaagtgaattaatacatgtattttaatgcctcagtttttctttctaatataataaatattaacagatataaactccattggtaaaatcactttgaggtccttaatacttcttaaagtggccgggcgctgtggctcatgcctgtaatcccagcactttgggaggctgaggcgggcagaacacctgaggtcgggagttcaagaccagcctggccaacatggagaaaccctgtctctactaaaaaatacaaaattagccaggtgtggtggcgcatgcctgtaatcccagctactcgggaggctgaggcaggagaatcacttgaacccgggaggcggaggttgcagtgagccgagatggtgccactgcaccccagcctgggcaacaagagcgaaactctgtctcaaaaaataataataataataataacaataacaataacaaaaatgtttaagagtgaaaagaattcttgagaccaaaaaagtttaagaactagggcttgatgatgttcaagcaaagataggaaaaggctattgcaagtacggtacaaagcacagggggaaggtttcataagtatatatataatatatatataatataacataaaattcatatatattataaaaataataaatatgatataaatttgatataaaatattatataaatctgatttttaacatattttgattttatactggtgtaaagtactattttctctttattttttacatcaagaatatgtatcccctacatagtataagtttatcatagtttttcttacttcattcctaacttcctagttgtagtgataaaatctattattttatatcaataaaaatattgatataaattttatttacatgatatacaatatttaaatataacatattttatattacaaaatatactactatgtattacaaaaaaaaaaacaaactccatttagcagagcaagaatggagtttgttttgtacagtgctgagttccaacccatagaattgttaaataaataaaaaggaaagaacactataagatcaaactcatcagttataatagtaaatgtgaatgattccaatccccccttttgaaagacaaaggcttctaaatatggtcagaatcctatttacagtagcaccaaaaagaataaaatacttaggaatcaatttaatcaaggaggcacaagacctgtgcactgaaaactcagtaactgaaaatgagcaaatgatgtgatagacatgtctccaagggaaatatacaaatgcccaataaacacatcaaaagatgttcaacatcattagtcattagggaagtgcaagtcaacctgactttgtactaggatgttttgtattaggatggttataatatttttaaaaaataggaaataaaaggtgttggcgaggatgtggagaaattagaacgcttatacattgctggtggaaatgtaaaatggtgtagcactgtggaaaacagtttgatgattcctgaaaaagttaaacatagaattaccatataaccagcaattctgctcctaggcatatacctaaagaaattgaaaacaaggactgaagcagatgctcaaataccaatgtccgtagcagctttgttcaaaatagccaaaaggtagaaacaacccaagtatctacgagcagatgaatggataaatgaaatggagcttatccattccatggaatattcttcagctatacaaaggaatagagttctgatacatgctacaagatgcataaactttaaaaacattatgctaagtgaaatgagccagacacaaaaggataaatactgtattccacttttatgaggtgccaaaaataagaaaatttattggactaaaaatagattagagataaccagtggaaggagagaatagggagttacaactcaatacatccagtttctcattgggatggtgaaaatttttggaactaagcagtgataatggttgtataatgttgtgaatgtcattgatgccactgaattatacccttaaaatggttttaatggcaaattttatgttgtatctcttttaaaacaataagaaagaaaaaaatttttaaatatatcatgtgatattaggaaagaaaaaaacagataacagtataagaaaaataagaatttaaaacatatcaaataagatttaaaaattttgtttaagatattgatacttggtccagtgcacaataaagacaagaacttttttttttttcttttgagatggagtctcgctctgtcaccaggctggagtgcagtggcactatctcggttcactgcaacctccgcctccagggttcaagccattatcctgcctcagcctgccgagtagctgggactacaggcatgcgccaccacgctgagctcatttctgtatttatagtagagacagggtttcaccatgttggccaggatggtcttgatctcttgacctcgtgatctgcctgcctcggcctcccaaagtgctgggattacaggtgggagccaccgcgcctggcctgaagacaagaacttttgaacaagagagcgctaactaacgtattgaaatacataaaacaaatactgatatatagaagagctcattcagctgtttcaaagacagagctctgtaacacatgtactcttacctaaagaactgtctcccaccactggaaaggaggtcttctctgaccaaatacacagcatcttggagttggccagcattaacttggatcatctggctggccaggaaaggagtgctcagggagaaagaggatggtcaccatcccaaccagattggccattagatctatgtatcaacagagtgacatacgggagaattaaaattctagtatgcaaaaatacaccgtatgttaacagaaaatagactgcagggaaatttgtattaggtaaaaccgagagaaagttaagagcatacaacagtagataagcaatagacaacccgatataaaaatgaggaaagaatatgcacaggcaattcacaaaaggaaacataaaaatggccttaaaaattgctaaaataaatatttaagcaaaaaagctcaacttcactatggtttggggaaatgcaaattaaagcaacaatatgtcatgttttcacagtcacattaataaaagtttaaaagacggaagtagaggtaaataggaatttgaggaaaaggagccctctcatagtggttcattggaatgtgaattgctgcagctttcaaaaaaaaatcttacactatccacaaacaatgaaagcatagatatcttcttagctactaatcccactcctaggaaaaggagtattaattacaataggttctttattgcagtattgtttatataagcaaaaagagcaaacaaccttgacatccttctattagcagtaggttgaataaatcataagacgtctactatgaactattttgcagcaatcaagaagacttaattagatctctgtttagtgatttgaatgggtgaccatgttgtgatgtcaacagaaaaaaataatttgcagaaaagcatatagagtttgttctcaatttggaaaaataatgacaaatttggaggagatatcctatacacatatgtgtgtttgattgggtttggaaaaatcaggaccacctgagatggaggtgggagtgacaaaatatacatggtatactaagtgaatatataggttatacaattacgttgttaaatttctgaaaacaagtgcaacttaagcatataactaaggagtagatgttaacctggacaaatgaaacatagattgttttgagcaagagacggcaaaattttttgtcaagagccagatagcaaaattttcaattttgcagaccatgcaatctctattgcaattactcagttctgccattgcagtggaaaaatagccctagacaaatgaatgtgtgattgtattttgataaaacttcatttacaaatacgtgctatagaacaaatttggcctgtgagccatagggtgacaatctccggttagatgaagggattgagagcattatttttcttcaattcttgtcattatgcaaagtcagagaattttctaaaataaataaaaatacaaattggcaaaataataatagttgaaaacttcagattgggcaaataagtgaacaaataatcacatgttgaggaataaggctgctttgattcttgtgtgttcaactttgaaacctttatcacagttataaaaaccatttataaaagtgatataactccacagagtatacctcaataaatttgcacatagaagaaatcaaaatgggtatattttctcatcgcaatacaccaaaaactaggaattaataagcaaatgatacattaaaaattcaaagttttagaaaacggagtaccttagatcttgatcaaagagaaatttaaaaacagccattgcagattacctggagaataacaatcgctaatgatcctcaagtgcatgtgcctcaagcattcttctaagtcctttacttgaattgatttacttagtctttaaaagaccctttgaaatggatatcatgcatatccctcattgtatagaagagaaaactgagacagacaggttaactaatttgtccaaattcatgtgacaggttgaggttagaattagaatatcgccagtcagcttcaacaacctgtaatggtaagccttacattatttatcttcttaattaggaatgctgaaacatatattactcataaaaatttctggggtgctgatgccaaaactgtcctcagagaaatttttcaatcctttttgttacttgacaggaaaaaattcaaataaatgaacaaaacatttcttaacaatttttaaattattaaaaacatatataaaaggctgctggagtaaggaattaataaagtaatgaacaaagaaaaaatcatagaaattataaagaaatctaaaagcagattctttaaagtgaccaattataaaacaaacagactgggtcaattgtcatttcacaaaataacaattctataaatatacaagaatgagaaagaagacataagcctgttgatattgaagagatttaatacttgataaaaatattatatcttctctattctaataaaattaaaactatccatgaaatgtaccatgtcagaagaaaaatacaatttaccaggtgtagtttaaaataggcagaattgctgataaacccatatctgtttgagtccatattttcaattcttttaggtatatacccagaagtggaattcctgggggatatggtaattctgtttaacttttcaaagaattgccagactattttccacagctgctgtaccattttacatccccatcagcaatgcacaaatgttccaatttctctacatcctcaccaacacttgtcatttttctggtttaaaaaaaattattattataccaccctaaaaggggctgaagtcagtttgatttacattttcctaatgactaatgatgtggagcatcttttcttgtgtttattggccatttgtatgtcttttttggaaaaatgtctattctcatcctttgtccatttcgtaattgggttgtttgtttcattgttattgagttacaggagtcctttatatgttctaagtattaaatccttatcagatagggttttcacatattttctatcattctgtgggttgtctttttaatctcttggtggtatcttttgttcttgacttggactgcaggacacttcagttcctcactacatgggcttctccaaaggacagctggcctctcccagaatgagcatctcaaaaagagaagaaaacattgcagtgctttttgtggttagcctctgaagttgcacactatatcatttccactttattctaatcattagaatcaagtcacaaagcacagcccacattcaaaaagagaggaattgggctccatcacttgaagggacatgtataaaataatttgtggacatatttaaaaccaccacaaagaagcacctttaaaaaaagacaatggcccagttttgtaactcttttttaacttcaagaaatagataatccaagtattaatattatttaaactgttatggaacatagaaataaaattatagccataattaaagtttgccaaagattacaaatgaaaataaaataaaatatatctctggctcatttgctaatataaatactaaaaatcttaaattgactattaaataaaaccaatattaaaagaattatgcaaggggaacaagtaaggttattccagaaatggttccaaattaggaaacccacaaacttacaatattaaagagtacaacttttcttaaatgtcatataaatatactctctaatgccaaaaaacacaatgaatggttaaaatctaaaagcatgcttgaatataattaaagttcaaaggaaaagaacactcggcatccttcctattattcaaagtagttgtggaaattcaaaccagtaaaatgacagccccctgtatttagagagatatacatatagatatagatagagagagagagaaggcaaatttattattaactgatggttgtttacctgaaaacccgaaggaattatttgaaaggttattagaataggaaatggtagtgagatatcgagtaaaaaataaatacttataaattaattactttctttatgtaggtaacaaccaaatagaatataaggaggaaaaataccattcacaacagaaacaaaatcatctagaaagaaatttaacaggaaatatataggacttataagcagaagatttaaaagagggggacatagaaaaatacttcaagaaatggaagatataatattttatttaaaagatttaatgttgtggtgatgttaattatccctgaattagtatgcaaatttaatgtaatcagtttcaatgacattcttttttttaatttgacaagatgtctgtaaatgtcatgagacccaccaacagaatattctgagataataacaagaagggtgtttgataccagatcagaggtgggtttgatacccacctctcagtgtctggtaaccacctttctactctctacttctacgagttcaactattttagatttcacatgtaagaaagatcatgcggtattagttcttctgtccctagcttattttggaaggtattttaaggcacaaatatgttgtagtgtaattatgttgtaatttttcctgacctgatgtcccacgtctgtaaaattcttttattgaagcctaggctctttccctaggactccctgtctggaatcataaatatcttacttctgtacttaacagaattgttctgtctgcatatagtccccactttttctccaagtagtttctcaaacaaatgcacttcctttcctgaaaagatgagtaagattttaacagctttaaatctttatatatagatatattttaagccaaacgactacactgtacatggttttatagccctctttaatacttacgaactatattgtataattattctaattattatatattactctacaacaccatttttagtggttgcattttggttattacttggatagtccataacctacctaacaaagtccttaatgtctggaattaaagtggtttcgcatttcaactgttagcaaaaacactacaatgcacgatcctgcacacgtgaaaagaaatgagatgaggacttcactaacttcaaagacagcttaaggattcagatcttcacatgtacacaagagacaagatttgcagatttgagtgaaaggctatgcacgattttaagcctttcagtacatattgccaaagtgccctccactaaactttgaccatgacctacggagtgagtcacaacagtgactctttctttgagtttatattactgctaggttttgtcaatttgccaatctaatgggcaaaaacggcattttatttgcattttaaagtgtatttatcatgtttataaggaagctaaacttttcatatgttcatttgactatttccatttttcgtttgtaaattatttgttcataattctttaccatttttctacttgggtgtttgcctttttataattgatgtataagagttgtttttattatttttcctctgtggtttgtcttcaaatttgtatgtagaaaggtttatttgtaattattcagttttatcagttttgttcatagtagaatttttcctcaatgtatgtctatagaagcctcaaatcagaaacacgtttgcctaaatcacctagttcttttatggttttatttttgacatttaatctttgatacacacggattttgctttgatgaatgtcatgaggcagagatctagcttagcttttcagatatttgccctatcaatgaataattcagttttccgtgtcttgaaatgccatctttatcactgccaatttcttacaaaaacttgtatctatttcttgggctttcccccattttgctctagggatctgtgtctctattcctgcatcatttcaattattttacattttaaatgcattttaacatcccttctgtttttgtgccttaaaataccttccaaaataagctaggcacagaaaaactaatgccacatgatcttacttccatgtgaaatctaaaacagttgaactcatagaagtagagagtagaaaggtggttaccaggcactgagaggtggggagctgagatttggtcaaagggcgcagggtttcagttagacaggaggagtaagtttcagagatctattccacagcatggtgactatagttaataataatgtgtatttccaaattgctggccgggcacagtgtctcatgcctatagctctttgggaggctgaggcatacgaattgcttaagcctagaagttagaaactaggctgggcaaaatggcaaaaccctgtctctaccaataaatacaaaaattagccaggcatggcagcgcatacctgtagtcccagctactcgggaggctaaggtgggagaatggtttgaacctgggaggcagaggttgcagtaagccaagatcacatcactgcactccagcctgggtgatagatccagaccctgtcaaaaaaaaaaaaaagaaagaaagaaaagaaaaagaaagggaaaaaaaattgctagaagagtagattttaaatattctcaccacacacacacacacacacacacacacacacacaaaacaaatatgagaggtgacggacatgttaattagcttaatttaatcatttgcaacagaaacatatatcaaaacaccacattttaccctataaatatatacaattattgtttgttcataaaaataaaatcagattttaaaaaatattcactgtgtttttttcagccatacataggctggaaccttcttcacattttggctccaacaatctagcttagtcacagcgagcacatctaaaacaacctctaggaggccaaaagtcagaggactcccatgatcctgtgctcttagacaacttttaaatgtatgataggagacaggcagaggaaaacacaggtaataatgggattatccttttctttcctttctccagtggttctcaacttgtttaattgcagcaatttttaagattttttttcttggcacacttgaaaagattgtataccatagcctaaacaggctagcaataagtaaaattcaatcagtacctaaaacgtaaaagagactcactgtgtctacaaaaacattgacggtcattgccatagtcacacagttccctttagctttctgtcactgtttcgggaagagctggtatatcagttaggatttccagctgtaaaagacagaagaaataaaataacaggatctcaaacatagatagtagtttacttctgtctcaggttaaaaatcacgaaagtaggcagtccagggtttatacgatgactccataatccacagaaacctgggttccttccactttgctactctgacctcttcaaaatgagagcccatcttatctcatggtctaaactccagccagtatagaggacacagggaagaagggaaggccaattcctttaaagacactttccagaagttgcacaagacactccacttacatcctctggccagaagttagtaacatggctatgcccggctgtaaggaaaggtgagaagtgaaacctttattgcaggtggccaatggcccagttaaaaatagagggttccattactaatgaaggagaggaaagtggatactagggatggcaccagtagtctttgctacaaatggttactgccctgatcacatttcttacataatcaagaggaaaagttcttaactgttgcagttactgcctcatcattatatggcattccattttaccctttaatttttacttggtcaagtttaggcctgctgtacaccagaacacatgaatagctttgctcagcattctttgtgacgttgctcacagtaacattatggatacctaataaattttttaaaagacaaaatgttctacgttttgtggcctactctggatggctttaaggtaaagtgggtgagtatccctaccctttacatttcaagtgtaggggtgtttagctgtctcttctggctctcatttactgactcttctgggtaaatccattgttctttcttttatacaagagactatctgagcacccaaaacttgaaagtctctaagctaggtgctatagtgttaaatatttcagtaagatattttccctgcttaatccaggagcttgtcatttccttgctggaagtacacatggataaaataactgcaaggtttctgaaagacttaagtacaaaaatgtcctgcaaagaaaaagggaaatatctcattcagttgtgagggattaggaataaaaatgaattggagaggtcaaaatgtaagcttgtcctcaaaaagaaaggactaatttgcagatggagatggggtttcttccttccgaggtctgccatggtgtaatctgtcctgtaatgtctaatgtctacctgctattattttctaaatggtgagttaaatgggaaatatgtgtagcgtataaccattttctatcctttgctttaggtttcgactcattggttccccatctactacttgtctcgtctcaggcaataatgtcacatgggataagaaggcacctatttgtgagagtaagttgaaatacttttctccacaaattcctctgtgtgatcctgacttgcccctggagtacaaagaataaattgaatccttcttgcacaaagtagtctctcagatatttgaaaataggagtcagatgcttcatggtcttcctggcttttctttatcttaaaaggtgatttatctgaaactgtgggcttgaacctaggcaaaataccctactttcccattataatagtaaatatttccagtatagagagtgttgtccttaatgagtacattttaaaggcgttagacaaaattagatctgtctttgccaactcttactatctatcaggttacaattccacaaagtaggctactcactttcttgttattctaatccaaataataaaaagaactcttcttccagttcttagcaattttcctaagcctctgatcattttgagttctaatcctccttcaattcttttaggcccatgtcttcagttgtatttgttctcgattagctgaccctccatttttcccataagatatttttcaatgaatctccaaaactttaaaaccatggaagaatgattgcaaattggcaaagtgttatagctgtgaagaagtcgtcatcgcacacagagttgatggcagcaaaagtaggcacagacttccagaaagctaatgaccaatataaacaaaagtaaagtaaataccctctgactgacaattccatttcccagaatttagcccaagaaaataatcatgaaatagtcccatgattttggtccagagatactcaatgcaataatatttgtgatagtggaaaatgttaaacaacctaaatgttcagcatggtttgaaaatagctagtagaagaaataaggcatattttaatggctatcagtttttcggaaaggtaaaaaagtgcaccaggaggaattaaaggttgagatgcctcatccaagtggaaaaagtacatctatgtagctacatgactgattattattcagccaccaaatatggtagtatagaaaatatatccatccatacatatgcatgtatccacatatgtatctaagaggatataattaaattgttacaaatagttatctttgaaccattttcactttcttctttctctttgtccatattttataaatttcctacaatgaatgtgttcattgtagtcactaatattcttcccccccaaattaacattgacttttaaacattaaatgaatgagaatgtatacaaggtgcctcccatatctgccaagaacttgaaattctatgaaataattcaaattatcaaagaattatcagtttactatacaaagttttcaaggcatggcaccttttgtagggggttatcttttataaaaaaatttccacttctacatttataggtcagtgatcatttaattgagtcaatactggttatgtgtgtatatgtgtgtagtcacttagccaatatgtgaatattattatcttatgatagaacacagtattcatttatcattttattgcccttaaatctgccattatttcatttctcatgccttatcttttgtgtttccttttctctctttttcttcataaataatgccagaagtggtatatttaaactgcaaagaggttattttaataacctataggaaaaaatagtccagcaatagataagtaccttaacaatctgtgataaaatcacatgtattatccacttaaaattataaatatataaacccaaaaaaacatggattttttttgtgaaatatgagcagaacccatatcatacacacctaaatttcaactaggtaaaaatgtctgattattagcaaatattttaagaaaataacagtattgtaattccatttagaaaatcattggattatttgcatttggtatttaaattcatagtaaaataattcattattaaaaaataagctgttttaccatactcttccttctctcagtcatatcttgtgagccacctccaaccatatccaatggagacttctacagcaacaatagaacatcttttcacaatggaacggtggtaacttaccagtgccacactggaccagatggagaacagctgtttgagcttgtgggagaacggtcaatatattgcaccagcaaagatgatcaagttggtgtttggagcagccctccccctcggtgtatttctactaataaatgcacagctccagaagttgaaaatgcaattagagtaccaggaaacaggagtttctttaccctcactgagatcatcagatttagatgtcagcccgggtttgtcatggtagggtcccacactgtgcagtgccagaccaatggcagatgggggcccaagctgccacactgctccaggggtgagtgtgacccatcaagactttgctgggtgtgagggtacgtatagatgataggagttgttgaaattaaggaagaagtgtataaggactatgaaattggcataaacataatagtagcttcactgtctgttatctctgttaataattgtctcaaagtaatggcttattctctcatctatagtagacatattttagatgcatttttgaatttaacatttacagcaaatatatgaagtagctactattggtatccccattttactttgagagaactgagtcttagtgatattaaagaacttttccaaggctctgactccagagcctaatcataatgtacagtggaatgtatcatgaacaataatgtgtaatagtgatgatcgtatctctatccctggagtggggcagtaggcaagtgagccatgaggaccaaaatgagagcatcaaatcaaaaaggccttggacttcaacttcaactttttctcattataattgaaaagactgaagctcagaaaaagtgttttgctcaaatccaaacaaatatatatatatgtatatacacacacacacatatatacttgatatataattatatattgttcagattgaggctcaaattcattctttgaggttttttgattgtttgtttgtttgtatgtttgtttgagagaaggtctcgctctgttgcccaggctggagtacagttgtacaatcatagttcactgaagcctctaactcctgggctcaagtaagacctctgcctcagtctcacaggtagctggaactccaggtgctcactaccacacctggctaatttttatttatttttagagacagagtcttgctatgttgcccaggctgatcttgagctcccgtcctcaagcaatcctcctgcctcagcctcccaaagtactgggatttcaggcctgagccaccatgcctagtttcaaatgcattctgatgccctgagaacacaccaattgtcctgtggatggaggcagccaacatttcggttaaaatacggtctaagcaatatgttctatcactaaaaagtctgtagcttttttttctttgagggggggttgttctttttgtttatttttaatttattaatctttaatttttgtgggtacatagtaggtgtatatatttatgggtatatgaaatgttttgatacaggcatgcaatgtaaaataatcatggagaatgaggtatccatgcccttaagcatttatcctttgtgttacaaataatccaattacactctttcatttttaaatgtacaattaagttattactaactatagtcaccctgtcatgctatcaaatactacatcttattcattctttctttttttttttgtacccattaactgtccccacctcccctccctaccctcaccccctatccccacgattttgttcttgatgcctcctcttttcttagctgaaatgactggcttaaaacatggagtgggaagaattaggactggtcacagggacagaaaggaagctaacagttcagccctgtgctgactgaaagagggtcagggagtgtggaaaatgaagaatacgtgaaggtgtctgttagatgagaccttggcaacagtactccttgctgttgccttacgcatgagcttgagggactgcctctgtaggaagtggaagagtggccaaaccacccgcactcacgactctgtgctccataaccagtagttgaaagcaagaggaatatgctgccttatagtctttggaacatgtttcagtagaaaaaacacagacaaggtgttggagagactttgattctagtcacagttctgcttggtttccttagcttccttgttagtgagatgtggctactgaactaccaatcttctcttttaatagctgcactctgcaatgacgatttttaagccctctggtaagcataagatataacaaaggaaattgccccatatctaacaagtgctctggaactgtcctttccacagtgtgtcagccgcctccagaaatcctgcatggtgagcataccctaagccatcaggacaacttttcacctgggcaggaagtgttctacagctgtgagcccagctatgacctcagaggggctgcgtctctgcactgcacgccccagggagactggagccctgaagcccctagatgtacaggtgccttgactctctggcttccagattgctctgttttccccttcacatggaggacttactcctgttgttttattttttcttctagtgaaatcctgtgatgacttcctgggccaactccctcatggccgtgtgctacttccacttaatctccagcttggggcaaaggtgtcctttgtttgcgatgaagggtgagtgtgacccagcgttgagaccaaggactcagtgtggagaatcactctcttgagatcaggggttaatccaattaaggagctgacctagtagataagaagtacccagagagattaatttatggaagggtagttttgaaataagggtagggactaagtggcaccactttcagaaggcaatgagaaaatggcacatacagctcaatgtcaggtacaaacctaaatacagtcactgatcttgagtacacagttggaacttgaaatgaatgggtacgtatttatttggaggcaaaagaacataattttataagaggtatgctagaaaataaatgatgaataagacaaaaattgtttgccccataagaagtaaggtagaggttgtcttaagaaacttaaaaccaatcaatagtggaatctgtaatagtgcatggataagtgtgttttaacccaataatatatcttcaggtcaggaatggccagtgtaattcttttaatgcaggatttttctcagccactttgccagccagtgacttctggacagcaatgcccctgcccaggccttgcttgggcccaggctcaccgcaggaaacaccccagatacttagcccactgggcggcgtctggctggtgctctgactgggaccctggggccaccatgactgcacactcagcccctggtgggaggggatgtgtgagtgagtgagtgtggggtccagctggccactccaagcacctgcacaggaatgggctctgagcagtgctggcggctggaccaggcatgtcgcactgaagggaacgtggtggtgcccaaacaggggtgcccatgaccccaaagcccagaggaggtgttacagcacactaatggctcttagcatttgataatgcctgcagcccaacagatgacagtgtgcttaacagctctgtcaatcctgtcgccccacatctcctgtcgcccagctctggcttgatccgctgctgcttcctttcgcgtggtacagctgccctcccacagcagagggcggagggccacagtgttacaggcttctttgtacctgcgtttggtgggtcctgagttgttgtcccgcatccaagaagaacaaggttatactgacaatagaagggtgaggagggtggagaagagttttattgagtgacaaaacagcttctcagcggagacgagacacgagggtggaccccagatgaagtcagggggtcattctctctctcagcgtggctggttctggggcttttatggacacagaatggggagcctgtgctgattggtttgtgactatgcaaaaaagactaaaacaaagacaccactcaaaggtgggcacaacagtgtaaaaaaccaattagggaagctcaggtatatgtaaactaaatgaacagtgaggatcaatcagaggaaagcacaccaaatgggaagagaggttctcaaaccagtccatggatttacctggaacttgtagctaggctttaaactgtcttcagcttgaaggtcgggtttcaccgggatctgccccatctgcctaggatttgtctgcctcctgcttctatcagtttcaagtggtattattagttgtttatgtgtatccattactcttggtggtgtgcactatgagtctggagggataactagattgggcaattaagcagttatttttaatgatttccaaagaatcttcggcatttacaaagtccaccacctaataatgatttccaatttcagaatgatttcagatttcagaaggcaagcaggattcaataagttgggcattttggggtgcaaagactcttcccccctcccttctttttttcttagagcacgtggttcagcatgcttctgtgagcctcctctggcctgttacagttgtagtagcaagaagaacagtgcccgttctctttctagatgttcctggctttgcttaccaaatcgagagctgttctgcctcatgacccactaatgagaataagtgggatgtcagagagccatcagtgaaagatgacacctgaaggttatggctcttgtgcccatggagaagtatggttctgtgttcatgccttctgtaggtgatgctgggctatgaagtttatatggcaattatgcacatcagctctaattgctttgccagtcacagggtaccatggttctttagaataaattggcctttgagtttctgtcagctactgaagaattcagatccctaatgaactaagacttttagctgggcctgaacctaagacctaaatgatagtcgaggaggaaatggtagtgaggaagctgagcatctattagcgaagaaatcaagggagagatgggaattgctcacacatttgctaccactttttttttctttaggttccgattaaaaggcaggtctgctagtcattgtgtcttggctggaatgaaagccctttggaatagcagtgttccagtgtgtgaacgtgagtagaaagaactatgtagtttggatagctctccttattttcgttttccagcatgtttttccgcatggcatcacctgttgtctagatctttacttaactaaattatggataaaaatacttctttgttggaagaatttcaagaagggtcttgtaggtcttctctgacatgtgtttttgttactaatctgcaaatcacttagtttaatgactgtttaattttgtggggaatgtgtggcaagaaactagatgacataaaggtgcagcacgttttagtcagtcatttatttttagttttcttatcaaggaggaatctttcttaaatttttatttttatttttattttctgagacactgtcacccaggacagagtggagtggtgcaatcacagctcactgcagcctcaacctcctgggctcaaatgaccctcgcacctcagcctcccagtagttgggactacaggtgcatgccaccacacctggctaatttttgtactttttgtagagatagaatctcgccatattgccccagctggtctcaaactcctgggctcaagctatcctcccaccttggcctccaaaagtgttaggattacaagtgcgagccaccatgcccagccaaatttttatgttcttttatcccctcgcatatcataaacaatttagtcagcttgttttttagcctgcagtatttaatgacatagggcttcccatgtgccaggactttccatgtgtagaaaaagcaatgaatagtgaatgaatagtgaagacacctccctactttcctgggatgtattttcttgttgggaagcagactatgaacaaggaaataaataagtaaacaaaattctaaaaattataacatataaaatggtagttaaatagggatgttatggagaaaataaaacagagttatatgataaattagtacgatggaaggagctgggatgatgaatcagtgtctgaaatgatgaggtgtcctaagtttccaaaccatccgcttaaataaaatatgccaaaattcagaaaaaattcagaaactcttagataaaagtacatgtttgacataccaagacattactgattgattctattctgtctactaaagcaaggcaagaattttttaaaccttgttttcctgattattagaaaatgtttattttaatttgtattgtgttaaaataacttatagaaatcaatttggataccttatggtgagtattatggtgaagaacattcaatacctgaggaaactcaagtattcaacaaactcaaccttacagagacacatagagctgaaaataaatatataaataaacttaggaaaacacaaacaggtaaaattcaagcatgagaagtcaatcattgtttgatgtactaggtcttttatatacacataattctgataaatttgggtatctcttcctaaattcatatcaaactagaagcatcaattgcttttagggaaggaactgttctaagcagactaaaaggaggaagaaatggtggctaataattggaagaaatcaaaaaaggctctttggcaccatttaatctgagtaaaaacagccttactggtgtctgatgacaccactggaaatttggtattggtcctgatggtaatggtcttgaatcaccaagaaacatttacattgctaaagatgatagctcatgtttattaaagttcatagatttccttgaaacttatggtctctgatgaccaaaactttgtctgtcttgaacctcattgtcaactcaggaatcttactatgcctgagttaaagtagacaaccaaatgggtgtttttaaaaaaaataaaaacaattactttccaaattcattgtgaacataggtacctgagtggtccaggaacactgtctttgggcttttgcaataaactgtaatttaggtctcacttcagttagttgcctctcaacaaaagccttacagatttaaattccgtctaccttagttatattctttctaaaagttatattctttttaagcgcacagtcacaggtcactattgtttcagtcatcttaagtgaaattctaatagaacttaaagctcttgttttctttctagaaatcttttgtccaaatcctccagctatccttaatgggagacacacaggaactccctttggagatattccctatggaaaagaaatatcttacgcatgcgacacccacccagacagagggatgaccttcaacctcattggggagagctccatccgctgcacaagtgaccctcaagggaatggggtttggagcagccctgcccctcgctgtgaactttctgttcctgctggttagtacctgcttccacatatcctaaatgggttcagaatatctaggtaagaacctccatatttctatagtgacagtcatttttgcttgtgaaaatggctttgctgtaactgtcagagacagaactacctcccaagtgaatgacaaacgggttatagataggcacgctgtctcaattgttggtattctgatggtccttcctatggggtgaagagtgtgggatggtaaggagagaagggggtggacagtgaagagaattgatgaggtccagatttagtagggaatgttttcaaagtactgaaaacaaatgctaaagaaaatactcttttattccacctctactactacgagttatctttatcctggagagatggatgtgctgtgcaaaaagtacacattgatgatgtaatttacttcagaactgataacgctataaaagtaatttgagaaactcagatgtagggatttatactttttatgttgtttccaagggtttgttcaagccactgactatgtttgtttgatccttcacctcaacattaacaaagggaactcaggaggccctggagaagcagagtttaaaattgtactcttagcctaatgggtgcagcaaaccaatatggcacatgtatacctatgtatcaaacctgcacattgtgcatatgtaccctagaacttaaagtatatatatatatatatatatatatgtgtgtgtgtgtgtgtgtgtgtgtgtgtgtatgtgtgtatatatatatgtgtatatatatgtgtgtgtgtatatatatatatatatatatatatatatatatatagagagagagagagagagagagagagagagagagagagagagagagagagattgtactcttagcctccatagctcattcctttgatatattagtctggctttaaacgacagtacctgacaactgtaggcacatgtgtggctgtgactgcccacaccagttccatcttccagtaaggacagaacagcactgaatcggtagcttgtcgatccctgtggtactcccccatctgatctagtttgaagttagagactgtagaggatagtgtttaaatgtcaagaggtctaggtttagagaacccgtctttcactgatcaaataggagggagtggcttatgacctggctggttgaggtcttcatgtacctctaatagccagagatattggatgtgttcatgtattcatatgtctatgtttaactgagtgtcttttcttgtgtttgtgtgggaacttgttcttagcctgcccacatccacccaagatccaaaacgggcattacattggaggacacgtatctctatatcttcctgggatgacaatcagctacatttgtgaccccggctacctgttagtgggaaagggcttcattttctgtacagaccagggaatctggagccaattggatcattattgcaaaggtgacttatttcttggtattccttattcttgctgggttgtatggaatgcatgaggcttgtaaggctgagagacattgaaatgagcttaatgaaagggataatatttttttcttctcggcaactgctttcttttcatttacataaaattatttcatcttattaactgtcctctttgcatggtcgatagcagtgcttctccatccagagcattaacaaaatcaccttgttaaaaagattctcaaactccattccatggcctctgattctgttttaaagtggggtcaaaagtctatttttaacaaactcatcagaatgctctgatgcaggaagaccacagaccacacttcaagaaataccactttgccttcttggtttgtatctaggaaaaaaatattgtaggcttaattttgagactattacaactgaaaagaagtctgtgcttgaagatgaaggatgtactgatggctgggcagaaaaagaaagtaaaacaaaggataagttaaacaaaataaagtagtctgggtgcggtggctcacacctgtaatcccagcactttgggaggctgaggcgggaagatcatgtcaagagatcgagaccatcctggccaacatggtgaaaccccgtttctactaaaaatacaaaaattagctgggtggtggtgcgcgcctatagtcccagctactcgtgaggctgaggcatgagaatcacttgaacccagaggcagaggttgcagtgagctgagatcacgccactgcactccagcctggcaacagagcaagactccgtctcaaaaaaaaaaaaaaaaaaagaaaagaaaagaaagtaaattaattagaaagatgtattaaattcaggctgggcacggtggctcaggcctgtaatcccagcactttgggaggccaaggtgggcagatcacctcaggtcaggagttcgagaccagcctggccaacatggtgaaaccccgtctctaccaaaaatacaaaaattaatcaggcatggtggtacatgcctgtcgtcccacctacccgggaggctgaagcaggagaattgcttgaacccaggaggtagaggttgctgtgagcccagatcgcgccactgcactcctgcctgggtgacacagtgagactcaaaaaaaaaaaaaaaaaagaaaaagaaaaagaaagaaagataaattttaaattcacaatcatgatttactaacttctttgttctatgtgcagaaattggccagaattatgcatttaataaagagcagagtgccagtatttgttgtgaagccagacagaattaacatggtactcctgttccctcacagcgtgaccccagtggctccagggctagatcaccgttagcctaattcctaatctttccacagctttccagttgcagagctgttaatcaacagtgaatgcacagtacattccatattctattactttacattaagaaatgggagtcaggaaatgttaaatcataaggtttttggaggaggaagattagtaacatgtttaaaaacatgcttcctcttagccaagggcaaaataggttttggctattttctcctattctcgcagttaaaacggacaatcaacaataaaatatcaatttctttctgatttgtctaatttcagaagtaaattgtagcttcccactgtttatgaatggaatctcgaaggagttagaaatgaaaaaagtatatcactatggagattatgtgactttgaagtgtgaagatgggtatactctggaaggcagtccctggagccagtgccaggcggatgacagatgggaccctcctctggccaaatgtacctctcgtaagtgcaagtgcaaggaatgtgggatcttcccggtcatggttattgctcattcattcatccatattggcatcaagtgtagtgtgatgtttatggcatatgctatgagctatagagtacaatatgagcatccacctattccaaaactcccatagtgagagtaaggccagacttcctcttctcatacttctcactgcagctctgcaccttttttgtctatatcactttgtggttgcatgagccacacagtaatgatttatttacagcctacgagccttacaagaaatgttttcagcatgagttagggagcaccttccaagctgcagagagcagccggcctgtctccctcactactggaggggacaggattttaagctagcacagctggatagagcagatttagaaattacgtatcattgagctctgtagaagagtagccctctgctggcaactggaaggtactgtaagatagaaaactacccacatcatggagcagatgagcaaagttaataatgaacagcctttcttaatccaagttagtgctacactttcccttctccccatctcttatgactcttctaatacatggttctacaccaagattgttcaagatccagttttacaattaatcctgtaaatatgctaatatgactcgcagataatatttctaaattatcagcttgacactcccttaatatcaaattatatttgcttttttggcaaaaatctcactggataacttactaaatgcttttagagtattctgaagatctggctgggactgacagaaaattcaggtcattggagaaccaaccgtatcaaatattagaacaaaatataaagcaataatacaaaagtcactttgcaccaggataagaagagacatacaaataagtggaacaaaattgatattaataaaataaaggggccaggtatggtggctcatgcctgtaatcccagcactttgggaggccgaggcggatggatcacctgaggtcaggagtttaagaccagcctggccaacatggtgaaaccccatctgtactaaaaaataaaaaaattagctggtcgtggtggcagatgcctgtaatcccagctactcaggaggctgaggcaggagagtcgcttgaacacgggaggtggaggttacagtgagccgagatcgctccattgcactctggtctcggtgacaagagcaaaacattttttaaaaattgtccattaaattaacaataaaaaggttgttaggtgaacacccaatacaaagcaaggatgtgatgaaactgatattgttgtgtgttgaaggtactattgtaaatttgcaaaaactcttatgaaaaacaattatgaaatgtatgtggaaaataatacaactattcctgccagttagccctcctagaaatttaatctaaggaaataatgtaaaatattaaaatattctatgcattttattaagggtttcatgagacagaaacctagaaacaagctaaatgcacaatagaagtcattgaatacactatgatgcatctactagattatgttagtttgcctttgttgtaacttatatttctagtatataattatgtgaaaacacacatataaggaaatgtaccagaacagaatgtatcaaaacattttttgggtatgaggattggggtgacttttttctttagttctgtattataaattttcttctgtaattgtattaataataatttttaaaagtcttctctgagtgcagaaggtaaaatgagagtatgtgaatgaaaccaatggctttttgcattagaaaaaatattagactgagtcctgaagaaaaatcaggatgacttgtcactggctgagaggtcctgttcaatcatgttgcatgccagagtgatgttttgtgacttttgtcttccttttaggtacacatgatgctctcatagttggtaagttttatgaaagttttgctgaggaattctggcatctataacagtaagtacctacctataatgaatgaaatgtaaaaagagagatcaaaatgtcttgaggtgtaaagagatcaaaatatcttcagttgtaagttcaactagaaagaaaataatgataagttaggccacaatatggtgaaactggcatcgtcatatgcatactaaataaccttcatcaaaggctctttactatctttgaaccattacaaatgaataatcattcatcagtgtcaaaaattctttatttgaatgtggtgggagaatgcaacttcttctttcagttgtaacctggagtatgcttccagatggtgatcctgctcatttgcacaaatagaaagccataagaccagtcttctgagcccatatctgtgatttgcctaaataagaatagttttgtaataaagtttgcttccaagggaatactgtggcatattactcttacatccctttttacgcatctggacactgagacacagagagttaacgtaacttgtccaagaccacagaatggggtagcctgggtctacttatctgtggagactgtgcactttaacaatcaataaatggacaaaatgacctaaatatgtaattcaacaagagagagaattccagtattttcacaatgaaatgcctgtgtgttaagtcttaggcaagagacatgggcagggccatggagagctggtggccagctgccccatcacggttctcacttacttttggaaaagctgacattggactaaacgttacaaaacggctcagctcacaccttaactttaataaccctgtgggagtgagactaatgctatagaaacccagagtaaagcagaatgtatagttacatctttaaaaaaaaaaaagcattggcaatctgtagtgggactggatactaagatagaatttaaaacctgtaagttatattttccatgcatttaattaccttgttttactgcctaggcactttatctggtacgatcttctttattttactcatcattttcctctcttggataattctaaagcacagaaaagggtaagtatagccatattatcccaagaaatgtaaactgtacttaccccctcttggaagtcaaaagaaagtaaaagacaaacaaacccattgctacataaacagatgtggtaattcttataaagaaagtccttgacacacagtatagacaaagaggtattcacactaaaggaagtatataggatactaagaacaattaaaaaataataataataacaaaaaaaaagaccatttggccaggtatggtgactcatgcctgtaatttcagcactttgggaggccaaggtgggcagatcactagaggccaggggttcgagaccaacttgggcaacatggtaaaaccctgtctctactaaacatacacaaaattagctgggcgaggtgggacacacaactgtaataccagctactcgggaggttgaagcatgagaattgcttgaacccaggaggcagaggttgtagtgagccaagactgtgccattgcacaccagcctgggtgacagagtgagactacatctcaaaacacacacacacacacacacacacacacacacacacacacacacacacacagcattttaagaaggaattgagttttacagaaagagaaagtaggcagaaggggtttttaaatagttgttcatgaggctgtttgatatcctagttttgctaagacattgcagacactgacctctaagcccagatcctatcatagcactagaagttagattgggtcacttatggcacacatatcatatggcacacataggctgccagtggggaagaattgaaactttccattgggtattttaatatataaacaaatattttgtaaacaccattaacttttttttttttttttttttttttttttttttaagaccgagtcttgctctgtcacccaggctggagtgcagtggcacgatcttggctcactgcaacctctgcctcccagattcaagcgattctcatgcctcagcctcctgagtagctgggactacagccatacgccactacaccaggctattttttgtatttttagtacagaaagggttttgccatcttggccaggctggtcttgaattcctgacctcaagtgatccacccgcctcagcctcccaaagtgctgggattacaggtgtgagccactgggcccagccatcattaattttttaaatttgaaagaaaaaaaacttgcaaagactaagatctgaataaagaaacgtctttgacagggaagagaacctacacagcttttgtactggttgattgaattataacaacctcaatgaggccagaatcaataatatcaatgttatatggttgatgagcaagttctatacccatagaaaaactgaatttgtaacttttaagtgaacggttttctatagcaaatattctaaacaagtacagtttcctacaacaagctttacagaaactgaagttttgatatttcacaaagatgccaatatactttttaaaaagtagtttgtcatagtagatcttgctgtaaagaacctagacaggaactcaatttcatggaaaaatactgaattggtagatatttaaatttaaatatccatccttcctaactaatgttctctatattttacggcttgacatatattctttgctcttttccattacaaaaagaaaaggtaagtagctgggcactttaccttaacaaagtacttgtgtcaatacatttttcctcttaaagtttctcattaagtaccatataattagtgagttaattttttaaaaaattactactacgtctgaattaaaggagttggggcttctaattttctgtatctatatcagtctctagttaaaaccacacaggggaaatgattatcccttcttcttggaagtattcaagatactttaatatcttgaagatatttgattatctccacccttctaactatgtcattcttcattacttatggtccattccttgttaatcaactagagggtcacactcccaagcctaactattgatttgtttcacctacataatttaagatcatttcctcatattaatcaccttcaggcataaacatgactcaataaccatttcataaaattatttctttggaaatgattgtcttgtaaagtctaagcaacctgagaccatataccatttcttcatgttttccatctcgtaaaacctgcctcctatttttttcatattctttaaagtgtaatgtccatggcacaaccattctctctctgaccagtggctaccagaaatgtggcagaaagaaagatcatgatcctcgttagacttaaaggtcagggatgtaaacctcccaaacatctatgtaacccacactaaaacctattctatatgtgtaatccaggaaagtttttaaacattttctaaacttttacttttgacctgtttcacttcttgggattgtaactgcctgatgtgttcttcctgcctgtcatacagacaaaaccagttccctgagataatggcatattgcagtaaagaaagagatgaattaatacaaggccagtcacgtggaagaactggagttatcactcaactcagtctccccaagaacacaggggctagggtttttatagatcatttggtaggaagggagctagggaatgggtactactgattggttggggatgggggtgtgggaaatgttcctcatgtgctgtgtccacctctggttgggggccacaggaccagttgagtcatgagtcacaagtccaggtagagtcagtcagttgccaaatgcaaaaacctgaaaaacatctcagaagaccaatcttatattctacatagtgatgttatctataggagcaattagggaagtcacaaatctctgagcagtaatggattataaaacctatgcctatattttagcagagttcaggtccctctcctaatcctaatctcttggcctttcattaggtttcaggtcctgagcaaggagagagctagttttaggaagagactgttattatccttgctccaaagttacattataaactaaattcctttcatggttagcttggcctacacccaggaatgagcaaagccggcccacctgtgaggctagaagcaagatgaagtcagccatgttagatttctttcactctcagaatctttgcaaaggtggtttcagcatagtgagtgcatttatctaacaaaacaccactgattttcatgttagaaataacacatagctaaaactgggaaaaagaagtaataaacttaaataatcagaaggcagaggtcccttctttcggaaggagttgggctgattaatcatgcagtcatacctccttgagtgggtgtggccaataagctaagtcattgtggctatgtgaggagggctgattattccttatctggagctcaagctttcctcacagaaagacaagggcataaagggcctcatggcaaagaagaaggaagccatgtgggaaacacagaatatgagtggagagtatcgtagtggtcaccaagtcagaagagccatttatcctggagctaaaaaagactgacagatatagaatagtgtagaacaagatggcctgctctatgggagagccacagtcacaccaggcctagagaggtgcaggctgacttctacctcaaacactggagacaattcagaagctgcataagcagtctgaagacttactaagaaactaaaatgaggctgggtgcgatggctcaggcctgtaatccctgcactttgggaggctgaggcgggtgggtcacctgaggtcaggagttggagatcagcctggccaagatggcaaaaccctgtctctactaaaaatacaaaaattagcctggtgtagtggcacatgcctgtagtcccagctactcaggaggctgaggcaggagaattgcttgaacccaggaggtggaggttgcagtgagttgagattgtgccactgcactccagcctgggcaacaaaggcaaaactccatctgaaaaacataaataaataaattaaataaaataaaacaagaaaagaaactaaagtgatagagaaatagaaggaatacacacacagaaatgatctcaccttctttaaaatgctcctcaaggaggtctactttaactatcctagtaaagatgacatgaccccacccccacattcctagtctctcttatcctgctttatttttttcatagccttattctcttttattataattaattaaataattacattccatgtttattctctctctccctccatgaagtcggggatttttgtcctatcttcaccaatggatacacaacaaatctaaactgtccctgggacaaagagagtctcaataaatatttatcaaatgaatgagtgagctacacaccactaacagtgttaccacaaggggaaatttctgccgtaattctctaccaagttgaacagtgcgtctttaacttgtcctaaacttactccaggtttcaaggctgctccttgttctaatataccaactgtctcagtctgttggtatatatacttgggcagttataacagaaactccatagactgggtggattcaataagcatttaagctgggtgcagtggtacctgcctatagtcccagctatctgggaggctgaggcaggagtactgcttgagccaatgagtttaaggccagcctgggcaatatggtaagaccatgtccctaaaaaacattatgtcatttctaaaaaccaagcatttttttctcatagttctagtgggtagagagtccaaggtcaaggcaactgcaaattcagtgtctggtggggatcgctttctagttaatagacttcaatcttttctccgtgttctcaaatcagagaaaaggagtaaaggagctctcctggtctcttttctaagggcactagtcccattcacaagggctctgctctcatgatctaattacttctcaaaggtctcacctttgagatcctatagtaattagatcctataaattttcaacatataaatttggaaagatacaaacattcagtccattgtaccaacactgcatttggtaagcacatatgcttaaacgatatcacacttgatttcatgtgccttctcaatcctcagctttccctgattaagaatacctaattactctgcccatttcctctgcaccctccaccttggcctttccactcactattactactatctcctgccttcttggtctctactattctcctcaccatccctgctccctggactatgatcccctgtgagcagggaccacctatatccacccaaagcaatttttatttaatgattttttaatctctacttgtacagcagtcaaaattaataataagagtagaaatggttaatgtatctacaaaaagagttaacatgtttatttataggtttatttaccatttattatcttctttggtcctcaaagcaactctgtgaggtaggtaggcccaatcatattgttatcccaaagcataaaacactctaggttcaaagaaattcagtggcttgtttaaagccagtaggaagttgttaggaattaggcctttagtccagattatttaactggaaatcttgaactctttgtgctagtattttgacaatgttagttgccatttctgaatctgactctatattactgaaattcagtatccagaactgtacatagtacaaacctaaagtattttccttttttctttcaatattctttttctccctatattttactgagtttgttttagctactttggtatattgaaccagtatctttctagagaaccgtatgcaatctctactttttttactctttattctgagtcattaggctataaaaaattaaggtatttctttaagggcatctttccatattgagatttcctggcgtttcacacagacttggcaagttcttcctgtgatttaatctcactgccttgttatttcactagttaaaaatatgcgcctgcacgttttgatatttcactgtgtatttacaacaataatttgtgataatgttaaataagataggtcataagataggtcatgcactcatcagtgaggaataatactggttagacttcttcattcagagcccattattgcctcttgttactgcctcgtacccactcccatttctacacaaaacagccttgtacacagtcaaaatttcaaagtttccattgttgtgatgtttagaatgataaaatacttaaggccatcctctgtgaagtctccctgaattttcctatgttcacattaaccaccagtaactaaccaaatagctcttcattcaacatatactcaccgagatcatattctccaaaaccccatgtaccactcatcacccaagaccaccttcagaacactactcatcttaccacttaaccaccactccttggaaggtcataccacctggctatataccactccactcttcctcatccatggatctcaagtgtgccttccctgtcctgtgaaaactctgccccctgaagcagtctgcctctttttctcaaatgatgctgtcattctaatttccataagatggtaaagaataactgagtgatgaggaaacagtggtacatgttgaagtgagttaactcttcaagcttccattctaaaatccctaataccaactcatacataaaatctccaggtactggtactgttttatcatttcattgataaaagatgaagtgtttattaacccccaaagaggcagtgtaccataccaagtgagggtgagggctttgcaaccgctaaggcctgtgttcacagtcactcactctctatgagaccctgagcaagatacttatcctcagtaaatttcattttccttgcctgtgaaatggagataataatagttcctaccttacttaacatagtgcctcatttatgatgcatgtcagaaaatgttagctattatttacacatgattgttattactgatattaaaaagtgagtaaatatttctttttactgttagttcttaaataccttcatgacagctactgctgctcccctaaccgtggatattgcttgtacagaaaacagaacacatatcttcactataggagaaaaaggaagcctcgtgtaacactgcagtgcaaagtcattcatgttgtgcagcttaagtgtcaaaatctcgatgtaaatcctatttactaatcaaaattatgtcagaaatagtgaaatgtgttaaggcatggacatctgcctataaacaatttagagtactctgacagaaaatataggatgattttagtattattttctaatctaagtttttgcttagtattaaaagatgagatttggttatgattttcctttcagacgtcttgcaaagatatcaggaacttaaggcaaataataccttaaatttcaaaatgcaaattactaatttctttcaaaacagatacttaaatgattaagacagtttttctatttttttctctgccaattagcaataatgcacatgaaaaccctaaagaagtggctatccatttacattctcaaggaggcagcagcgttcatccccgaactctgcaaacaaatgaagaaaatagcaggtacctatatacatactgaattcaaaatgttttcaacaactcaaatatcaaaaatggaaacaggacttgaatatgatattgcactaggtaggtcattgataccaaagaatttagaaagtacttcaggagttggaaacttcttttttttttattggattattattgtcatttccaatgttttggggtgatgactctataagttagtacagtcacagtcactactttttcaaagcattcctataatttcctgtatttatgctatgaaactttgagaagtagtatgcttttttcttgtggaacccaagaatttgctgcctgcttgtacctccaagtcttccagcttcccttaaatgcacagagtcactttaatgtcctctagagactttcactttacctccccagccaccaacccccttgatttctgacttccactgaattctctacttcatttggcctctttgactgctccttcttttggtcctcattcccttgggcttattaaatacctaacctttcattctacctattcaaagcaggcttactgcaagctgttgtgcagtacacattgctaaagatttggggtgaaaagggaaattataccattatcaaaagtggtatgtatcaatattagaaatcactgaactgaaaagtaactagtacaccagggacctgaaaactaccacctgtgagccaaatccagctggccacttgtttttgtgaataaagttttactggggcacagccacacccaatcgtttgtctactgtctctggctcccttttatactacaacagcagagctgagtagttgcaacagagaccccaaaagccaaaagtatttactatctggccctttagtggaagactttgctaacccctgaactatatcatactatgagaaatttctcactggctagttccccttttaacctgggctttccatcctcttcccaggcctctctctctcattggatactcctctcttttgttcaaatctttactgcattctcagggtatgcagtaaatacaggcattcagactctcgggcttcttgcaaattcaaaactccatttttctttaaaattcagagcaatttatttggctctggcttactttggctatgcccaagaatcctaaaatgtcctacccataggtgtttggaacattttcaggaataagatcaccatatgccctagaacagaattaggccagtcctgtagaaagcagaagcaaaagcaccacaatcattactgaatttcctttctttatgtcctacctctttctcatatacctgtgcattaatctaaatttggcatgttacacctacatacatcagaaatcctaaattcaacagaggacagtggaaggggccccaggaaaagtaaaggaagtggaaaaggtattttatagttaaccaaaacataagtagaagcaattcaaacttttctaaacaaaaaattacagattatgtcctattttctcctataatagaaatgaatttgcaatgccctgtttattatctgtcttcctagttgctttgcttctagcttatttgtcattactgtttatgaaaacaaatgaaatatgcattgcttttttaaaattcagaattgatattttactttttgaagctttaatgtttatctggcctgatccttctcaaatgggcatatgtatacactgggggatacatggctaatgctaatataccaaggggatataaaaatcataagatgaaaatggcatggtttcctagagaatatatttttctaatattactccaatagttcaaataaaaattgtattatttcaacatgaacacaaacacatttataagggaggaaaagacaaataaataatgcaggaagtttaagataaaataagacggctgggcgctgtggctcacgcctgtaatcccagcactttgggcggccgaggcgagtggatcatgagtcaggagatcgaggccattctggctaacacggtgaaaccccttctctactaaatacacacacacacacacaaaatttagccaggcgtggtggtgggcgcctgtagtcccagctactcgggaggctgaggcaggagaatggcgtgagcccgggaggcggagcttgcagtgagccgagatcgcgccactgtactccagcctgggtgacagagcaagactccgtctcaaaaaaaaaaaaaaaaaaaaaaaaaaaagataaaataagacagaaaatattgtgctttcagggatgctttagactatgtctccaaagttcttgcgtgaggcattcattttcctttactatcagagtgctatgggggaaaagtcaggcagaactgattcagggccagctgtgtggccactcatttacaaacagacgaaataacagcagactggaagaacaacaaccatttttacaagagttcattttaaaaatattccacaatgataaattatttgatttagcctcattcctgtcagattacctgcctaaaacacttttccgcctttctttctatctaaattccctgaacccagctccagctctgaattcaatcaaccaagatgctctcccaaacaactctagtccaaaatgatatctctctttgaaactcacatttcctgactacaccatttaaaaaataaactaatttattttaacagtaatatctcatcattgttaaaaacaagaaataggggaaaatataaaaaatataaaaattacctgcaataatctctatctagtagtattcttaagcttctttgcatattgttagacatttgcatatacaccttgagattatattgattgcacaatattgaatcctgctttttttaccaaatgacaaacatttctcccatcattataacagtacataacctatagtaattgacatttcctgtgttgttttttgcctgttaactctattgcattcatgtagttgcttatttattcttcaaacattcttagccacttacaatgtgccatacattgtgcttatgtgtgttttcttttccatgctaaattaacttctgatgaatagagacaattttttaaagatctccccaatctctgagtataatcaaatgagaaatgttcagtaatcaactgagcacgttaatcaattgagaaatttttcatgcacgtccctgtgaagagatcaccaaacaggctttgtgtgagcaacatggctgtttatttcacctgggtgcaggcgggctgagtctgaaaagagtcagcgaagggagataggggtggggccgttttataagatttgggcaggtaaaggaaaattacagtcaacggggctttgttctctggcgggcagaagtgggggtcgcaaggtgctcagtgggggagctttttgagccaggatgagccaggaaaaggactttcacaaggtaatgtcatcacttaaggcaaggaccggccatttacatttcttttgtggtggaatgtcatcagtaaaggcggggcagggcattttcacttcttttgtgattcttcagttacttcaggccatctgggtgtatacgtgcaagtcacaggggatgcgatggcttggcttgggttcagaggcctgacaaaattaatttatgaaaatttcatttatcctcaactttttggaaatactcttacatcaaagtacacctcaaattgtgtacactgactactgatcacttttcggtaggtataaagtccttaaaaattttgtttcaactttcccttttaagattagaattttgaccacagtgttccatgggaacaaagtgaatcatctgtggcaaaatatgctagtcaagaagtgagttagaatctgtgccaagcgttaagaccttgtgcacccaggttctggggcggagtaaagaggcaggctccaaagacatagctgtgtgttggacatgagagtatttggaggaatacaggtaacaggtgatgctgggaagtcctgtgaaatggaaggagaacgaagatgaggaatctggtggcagtaataaccggggaacagatgagctggaggcctcatcaggaggggtgtcccttggtggaaggacaccattcccggccttaaaaggagacgcttcagcacggctggggaagcacgtggataccttgtactaaatccactactgcagctcattcttaactgtaagtagaagaggaggacatgctttctgaagctgacccctccaagatgaccagttcctatttctgtcccctgctaccaccatggtgtagaacaacagaatcaaaaaaacattttttctgttatgggtgacctgtacgttttctagaatggaaggaggctgtttagtagctcaactctgagaacactttttctttggacaaaattaaaaaaggaaaaggtcaagttaatcattaatctctctgttttctactaatgtctccattttcgccatactttctatgtcctacatagcagccatcacagagggcaataaacacttctaatgaccgtgtaatttatatggaatgctgaaggggtgggttggccctccacacctgtggatgtttctcattaggtggaactagagacttggaaaagaaagagacacagagacaaagtatagagaaagaaaaaagggggcccaggggaccggtgttcagcatacggaggatccaccggcctctgagttcccttagtatttattgatcattaatgggtgtttctcggagagggggatgtggcagggtcataggataatagtggagagaagttcagcaggtaaacacgtgaacaaaggtctcggcatcataaacaaggtaaagaattaactgctgtgctttagatatgtatacacataaatatctcaatgccttaaagagcagtattgctgcctgcatgtcccacctccagccctaaggcggttttcccctaactcagtagatggaatatacaatcgggttttacaccgagacattccattgcccagggatgagcaggagacagatgccttcctcttgtctcaacagcaacgaggcgttccttcctcttttactaatcttcctcagcgcagaccctttacgggtgtcaggctgggggaaggtcaggtctttcccttcccatgaggccatatctcaggctatcacatggggaaaaaccttggacaatacctggatttcctagacagaggtccctgctgccttctgcagtgttttgtgtccctgggtacttgagattagggagtggtgatgactcttaacaagcatgctgccttcaagcatttgtttaacaaagcacatctgcacagcccttaatccatttaaccctgagttgacacagcacatgtttcaggaagcacagggttgggggtagggttacagatcaacagcatctcaaggcagaagaatttttcttagtacagaacaaaatggagtctcctatgtctacttctttctacacagacacagtaacaatctgatctttcttttccccacatttcccccttttcgacaaaaccgccatcatcatcatggctgtttctcgatggttgctgtctctttggagctgttgggtacacctgcagactaacaacagacaaaacaggcacacaaggattaatatgaaatttataatcgtagtacttccgatggtcttaacccaagtgacagggttaagatttgcgaggccatcagcaactcctgcgattgcctcagttcctggcaccaaatttaaatgggcttttgatgtttcaaaaatttgttcctttaatttggaaatgtctaaagtgagattatcttctgttccctgtagatggcatctgaccatgtcccagtgatgctcagactcattataaacttggggtgtaatacaaaaatctgagatattccagtcacactgtaactggaaacgatggtctaagttcataagcctgtctcccatccaaatgacagtttgtctaagatcattaatttggtttgccaatttttgatcaataccagattgtgaattccacaatcttgtagaatttttttgccaatcattaacaaagtttactgactgaacagaagagtgcaatgcaactcctgccatagcagccgtagctgtgactgcaattaatcccataatcactgtaattaaagtaaaaatgaatcttttggatctatttaaaatggcttttaatacttcagtcaaaatatggacggatggcaaggcctcccacggttggtccatggacatagaaatccacacggcttctcttgccctcaccagcagaatacactgttgccaattaaaagttgaataaatgcaagtaaacaatctgcaattttcacagcttatagtttgagagtctggtttaataactatatttcctacaactagcatataagggggctttacacaggtttggaaaggaactgttagactggaatttaggttgatagtataaaatagcttacgatctcgtttctaaagtttgatttctagaccaaattctaatgcagtatgaggccacagtaagcctccataattctggatgttcaggaccagaaacaggacttattatttttggtcttggggtagagattcctttttctccctattcccaagggtagaaagactgtaattttttagcttatgtttgtctaaactttctgttaagtcgctatcaacagctagactcacttgtgcactgggacacgactgagtttgtcctgtgcaattgtggtagaattgacctcgaggtgcccaatctataatagttccgaattcactgttttgtaatatcaccgcactattggccacacattcttcccaaactaaaacttctgtattttttgatcctttgggaatttccttggggcaaggtttccctttaggtctaaattttaatgatctttgataagaaaagtcttgtaaataatttacccgtggcctgagtgacatcccgcttaccatgtgataagtgaatctactgatgggactgacagtaggtacttctaccaaccaattttggactgcaggcattaaacatcctggtgctctccctaggcagataggaggataatgatacccaatggaaatatttatcatcatcccttcttcctcaggtttggcagggcaatgatcatctgtggggccaggtacccatacactatcattaacatatacttcaataggattatccatccatgtgactggtgtttccatctccgcggtggcgcttttctttgcatctccgatgggttcatcgtagatcttcaaatgtctagtgggtatccaaacaggaagctgattttctcctggtgaaacacaagcaaaacctctcccccacgtcaccaccttccctatttcccatgtcttatttttattatctttccaccaaatcagttttccttcatgtgggctgttctttttaccagtaaaatgttgttctgcagaagtagtagtctgatttctataaatgtttaaaaaatttaaagtatagagtgctagattaagttgcatctgaggagtggtacattccttactgtctcccccttctttttgcttaactgagttttgagtgttctattagttctttcaactatggcctgtctgtgggaattatagggaattcctgttgtatgtgaaactttccactgatgtaagaatttttggaaagctttactacagtatcctggtccattgtcagttttgatctttttctggaactcccattacagcaaaacaagataataaatgttttttaacatgggaagtactgtctcgattatctggccctaaacaatgtaaaatcacagtactttgatacacttctgaggctgtgcctacgctgacaagccctgtaacagcctttagtttaggccaatttttggccactgatttaaagcaatgatagagacatctgctccagtgtctactaacccttcaaactgttttccttgaataatggccttacacgcaggtctgttctctgagacccgacttgcccaatatgcagcctttcctgttggatcagtgcttccaaaccctcctgttctttttatctcactatttccaaccttaatataaggcaggagtaataattgcgcaatcctgtctcctggactggcactccaaggaattgaagagctaataaccaattgaatttcgccattatagtctgaatcaaccacatcagtacgaatttgaactcccttcagacttagacttgatctacctaagattagtcctacagtcccctcaggcagtgggccatatacccctgtggagattttttgtgggggctcccctggaagcagagagactgcctttatagtacataaatccacagctgcactgccgcttgtggcgggggacaattgttgtactgtggtaactggctcattccctgaggcacttgggacagtgggggttgttgtccctgaaaaccctgaggaacaaagggctgaattgggaatgccccagtttgttgcggggcctgaggctggcccctttgctcattttcccgacaatggttgcccatttctatcaaatttagaatgacattgactagcccagtgttttccttgtttacatcttggacataagtcaggtggctcttttttatttgagactgggcaattcttttttagatgaccaatttgatcacaattataacatttccctccaaatgttctaacttgtcctcctaaagcaactcctgttattgtggaataaagtttagaaaatatccaaagcttatcagcctgtaaattctgggtagttcagttgtctaccatgctgttaattaaatgaaaacatcctgttatttcagggtccttccttgacaaagtactatacagctgaagaacatctcgaatacaattttggtgggaaaggagccaattgatttcaacagaatcagatctgagcttcataaagtctttgaagtgacttcacagagacgcagacatgtgcacttgaagatgctgccccttccctggtacctagcaaagctcctgcctctttgtgtgcgtcactgtgaaacccccacccttctgcctcgtgctaaacgcacacagtatctagtcaggggaaaagactgcatttaggagatagaaaatagtttggattacttaaaggaataaggtgttgcctggaatttctggtttgtaaggtggtcactgttcttttttaaaatatttgtaatatggaatgggctcagtaagaagagcttggaaaatgcagaaagttatgaaaaataagtcacttataattatgctacctactgataaccactcctaatattttgattcattttctgcctatcttctttcacatatgtgtttttttacatacgtacttttcccccttagtttgtttccttttattttatagagcagaaccctagtcttttaaacagtttagagtgaaatatatgctatatcagtttttactttctctagggagaaaaattaatttactagaaaggcatgaaatgatcatgggaagagtggttaagactactgaagagaaatatttggaaaataagatttcgatatcttctttttttttgagatggagtctggctctgtctcccaggctggagtgcagtggcgtaatctcggctcactgcaagctccgcctcccgggttgacaccattttcctgcctcagcctcctgagtagttgggattaccagtagatgggactacaggcacctgccaacacgcccggctaatttttttgtatttttagtagagacggggtttcaccatgttagccaggatggtctggatctcctgacctcgtgatccacctgcctcggcctcccaaagtgctgcgattacaggcatgagccaccgcgcctggccgctttcgatattttctaaactttaattcaaaagcactttgtgctgtgttctatataaaaaacataataaaaattgaaatgaaagaataattgttattataaaagtactagcttacttttgtatggattcagaatatactaaattaactttttaaaacacaacttttaaaaaatgtatcaaaataataaacgtgttctgatatttttaaaataa

SEQ ID NO: 109 - DNA, 7492 bp, Homo sapiens
ggctggagagtaaaaagaactgggggtaagagcccctctgcctagcactgctcccccaaggctcccagaaatctcaggtcagaggcacggacagcctctggagctctcgtctggtgggaccatgaactgccagcagctgtggctgggcttcctactccccatgacagtctcaggccgggtcctggggcttgcagaggtggcgcctgtggtaagtcccccaagaaagagacctgggccagcggagggacaggggttactgctccacagccccatcgaagcctccctcctgaccttcagcctgcctgcctttcccttgctctctctgccccatggtctaccctgcccatctcccgctgcttccccttgttccacctgagccccttctctaaggtgcttctccattagtgcttccatatcaggtccctcctctcctgatggatctgttaggtcacttagaagctttactctgagactaacccccttttaacctgcttacctccactcccatcataggactacctgtcacaatatgggtacctacagaagcctctagaaggatctaataacttcaagccagaagatatcaccgaggctctgaggtgagaagctatgaggtgtatgcctttagggctaaggtctcaaggtcttcttccttctcatcccttcctctccccaggcccacctcctcctgaccctaaaccatgccagggatttagagatgggtggcgatcattattatggtggtggggcatggggtgagatggggattcacagatgaggaatacaggcattggatcttcctaggccataagcattcctttggagtctctacccacatcatatctcaaatactaatatttagttatagtccacataaagtgtaatgatatgtaaaactgagttgagttgttgacatgctattaccttttgtgggccttcaatttggtacttatttatttctattttatagttttatatgttgatgtaatggattatttttctttctgctctcagatatgttcaggtcccttgaaaagcccctaggccctatgacagtccatagatggatgaaattgctccagggcaagctgggctgggacgggtatccattcaggaagggagaaggctgaaggaggacaggctgtcaggtgggagcactagtggaaagctctccagagcaggggagccagacacctccacagagtaggagaaggttagaaattgcagtagaggggctgggcatggtggctcacgcctgtaatcccagcactttgggagatccaggcagggggattgcttgagcccagaagtttgacagcaacctgggcaacataatgagaccccatctctaccaaaaaagaaagaaaggaagaaagaaagagagaagaaaaagaaaggaaggaaggaaggaaggaaggaaggaaggaaggaaggaaggaagattgcagtagaggaggaaggctacacctgagggcaaacttactcaaataaaagacactgaaaatggggagatgaagctggagtatctccatttctgcagaacagaagagaaagtcccagttatgaggactggaggctggagtaaccctgtcagcttcagggattctgtgctattcttggccatgaacttgggcagcaggaagtcaaagagcaatcatctcccagtcatttcagattttcctgtcctggtagacccatccctctccctccttcagagcttttcaggaagcatctgaacttccagtctcaggtcagctggatgatgccacaagggcccgcatgaggcagcctcgttgtggcctagaggatcccttcaaccagaagacccttaaatacctgttgctgggtgagaacagagcctggaaaagagagggagaggagggggtgatgtggttctggcgtgtgggtggcattaggacagtctggaccagctcagtgttgaatagataatcacctggtgattacctggttgtcacctgtcttgggggttgagtgcctaaacccagaggagctctctggggttggcagaaggatctgtatttctaatctgttttctggtcattaactaggccgctggagaaagaagcacctgactttccgcatcttgaacctgccctccacccttccaccccacacagcccgggcagccctgcgtcaagccttccaggactggagcaatgtggctcccttgaccttccaagaggtgcaggctggtgcggctgacatccgcctctccttccatggccgccaaagctcgtactgttccaatacttttgatgggcctggtaggcaacagttctcagttcccacctcatagacctctgagattacctctgtctccttgaaccagtgactctagaaccttgatgtttgggctgctctttatcccacctgcaccatacgctctctaattacctcctaacgggagcacgggcgcagttggtcatctacatggagcctcctgtttgaaacttcctccctccctcccttccttctctccttctctctccttccctccctcccttccttctctccctccctcccttccttctctccttctctctctccctccctccctcccttccttccttctctccctccctccctccctcccttctttccttcctctctcttgcttgcttgacagtctcactctgttgcccagactggagtacagtgacacaatcatggctcactgcagcctcaacctcccaggctcaagtgatcctcccgcctcagcctcccaggtagagactacaggcaaacactaccacacctggctaatttttgtagagatgaagttttgctatgttgcccaggctggtcttaaactcctgtactcaagcaatcctcctgccttggcctctgaaagtgttgggattacaggtgtgagccatcacccctggctgcctatgcttctttttctcccttaagttcccctgttcaaggcataccttagaggtatgggccagagaggactgggtcagagagcagggagtggctgggaaggtaagggacagtgatgggcattcctgagagaactgggtgatgacaggggaatctgaaaggggagaaagaagcatccaagagacagtgaacatagctgggggaattttaaaggtatgcattaattagagtttataataggcagggtgtgctctagcctagcgggctctgacctccttcctgttcacctttgcctttgtccagggagagtcctggcccatgccgacatcccagagctgggcagtgtgcacttcgacgaagacgagttctggactgaggggacctaccgtggggtgaacctgcgcatcattgcagcccatgaagtgggccatgctctggggcttgggcactcccgatattcccaggccctcatggccccagtctacgagggctaccggccccactttaagctgcacccagatgatgtggcagggatccaggctctctatggtcagtccctccccctagtgagggggagggtcagtctgactcccacgtcaaggcttgaagagacaggtctagcctccatgtagggatatagcttagtgtctttcttctcctccagcccagttactcaggcttcttcattttcaggagcagtttttctcagactcttctatgtctaatcttccttccaggcctctctccttacacccatgcttggggatggagaatgcaccttctttttttttttttttttttttgagatagagcctcactctgtcacccaggctggagtgcaatggcatgatcttggctcactgcaacctccgcctcccgggttcaagccattctcctgcctcagcctcccaagtagctgggattacaggcacacgcaaccacgcccagctaattgtttttgtattttagtagagatggggtttcaccatgttgcccaggctggtcttaaattcctgagctcaggcaatccacccgcctcagcctcccaaagtcctaggattataggcgtgagccaccacacccggcaagaatgcacattttaacaatcctccttctccctttctggtgtctctcaaacctagaacgtgtctcccgctgatatcaacataatattgcctaccacaaatgaaaacgctctaggattcccttttcccctctgtatggggactctgagcaaaacttacaggagactggtgtggaggacaggtgctgtgagttctctccctaagcagcattactttaccttataggcaagaagagtccagtgataagggatgaggaagaagaagagacagagctgcccactgtgcccccagtgcccacagaacccagtcccatgccagacccttgcagtagtgaactggatgccatgatgctgggtgaggcccctcccctccaggctgttggcaggcggtgggggcagcctgctgatcctgaggcctggacaaatgggagtgacatgggacttcagcatgagcaatggaggttagaccccaggcattaatgaccatggaaggagacatgtgacatggggagggagagttcggagccaaattaaaggtggcttaggcaggcacttaccaaggctgccacgctctaagggccactagaacacatctggaaatgcagcaagatggagaaaactatattacccagattgcctgttagagagggtgcacctggttggaaggacaactaggaagccacttggaggggagggtgaggttcctaaggaggaatagctatctgcagggcttttgttttgttgagtggaccaaagctgaaacgctctgagcaacaaagcattctgagtcctctttgtctgcctttaattttctctttgaattaaagttgaatgaatttttgaagaatcagcctgcagggagagggcaaattgttagtcagcctgagatacccccaagtttctgtctacttgacctctgtctttttgacttgttgacacaccattacgctcagggccccgtgggaagacctatgctttcaagggggactatgtgtggactgtatcagattcaggaccgggccccttgttccgagtgtctgccctttgggaggggctccccggaaacctggatgctgctgtctactcgcctcgaacacaatggattcacttctttaagggtaaggaggctagttacagtgtcttacttgaggagggcctaatcttaaagaaactataaaagggagggagatgagaagtttctgaataggtggaccggaggagaccaaaagctatcacctgaggacagaggtgacttgttctttcctcacatgctctcaggagacaaggtgtggcgctacattaatttcaagatgtctcctggcttccccaagaagctgaatagggtagaacctaacctggatgcagctctctattggcctctcaaccaaaaggtgttcctctttaaggtataaagttcaaagcaagggcaaatcccttcttaggaggagtgggctaccttatactgagaagcaaagcttgcgcttgaagggagatgttctgcagctgcagtgggctgggggtggacccctgggggtcctaagctctctcctcttcctctcccctctccccacccatcccatatccagggctccgggtactggcagtgggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtccccggactatagacactaccccatcaggtgggaataccactccctcaggtacgggcataaccttggataccactctctcagccacagaaaccacgtttgaatactgactgctcacccacagacacaatcttggacattaacccctgaggctccaccacccaccctttcatttcccccccagaagcctaaggcctaatagctgaatgaaatacctgtctgctcagtagaaccttgcaggtgctgtagcaggcgcaagaccgtagatctcaggcctctaacacttccaactccagccaccactttcctgtgcattttcactcctgagaagtgctcccctaactcagatcccctaacttagatttggcccccaactccatttcctgtctgtcttagacagcccttccaactgtgtcatctcttctctggaggtcaatggtggagggagatgcctgggtcctgttcttcctacataaaatgcaagaaaacagcatggccagtaaactgagcaagggccttggaatccttgagaatcacatttatgtgcttatgattacgggcaagctaattaaccttgttgaatctcagattccccatttgcaacattaggttaagaccagtactgcaggattgttgcactaaatgaaatactgtatgtgaagtgcctggcacagtgtctggtacatttgtgtttaataaaagctaactccatgttcataagagaggactgaacagctcttcctctagctgtctggctgtataactcttacagtagtctgtataataagggcatctctattagatctttaggggacagaggatttgtcaagatggttagctctttgttttggggtgcagagaaagaaaagagcagcaacagcagaggctggactccctggttcagtatttaatgccattttattcacatgctcccatgttctccctccctcccattgtagccttgctgcccaggggagggatatgtcttcctttatgcatctgggaaaccaggaacagaccctgcgcaggagagtcagagggggaagagttagaatgggtcagtggctggaacaaagttctggttaaggaggaaattagtgccacccacggtgagaagcagagaaggcacttgcatcctatgcagccctgaagaccaggctcctttgggcaaaaggcaagactctggcaggtgggtcaatgctctctccttggagcaagaagccagcttttggggaaggcaggtcctgaggcaggcactgccctgtggtcttccccaggttgaggagagaagtggaagccccatggaagacagtgctcccagctgaggtaggaggcggaggtgggggtgggggtagtttaagcctatggggcccagggggaaaggccaaacagaaacccaactaccccctaatgaagggcctggaggttggggtatcttggagctcctcagagcccttcttcccatcaaaaaggtatcaaatgccttggaagctccctgatcctacaaaacaaaaaaatgcttatttttaccactgtgaggcaagctgaggtgaacatttaaaaggctatttcaagacgaggtgcggtggctataatcctagcactttgggaggctgaagcaggaggatcacttgagcccaggagttcaagaccagcttgggcaacatagggagaccctgtctctgc

SEQ ID NO: 110 - DNA, 47985 bp, Homo sapiens
ctccccgctgccctgcgctcggcgggctggcatcgggcccggggaaagcggagcaggtaagggccctggggcccgcgcgccctggccaggccggcagaagctcactgaccccggcagcggttacggggcttgagggggcggtggtctatgctgcctcaagttcgaggagcctttgcctctgattctccctagcccccttgcccccgcctacatctgtgcaggcgaaccgtgggctttgatttgtggggagattgtctctgccagagggaaatacagagattgagatgcccatcgctctaatcactggccacacatgtccgctcgcttcctgctcaatttagtggaagggatgcgccacggtggcgtttgcagagaaaatggtgggccttagagactggacggtggggttggtaagggtggtgtctcagactgtggggagggacgtttgataaccaggttcctgaacccggaaaggcgagtattgggatctatgtcctgggctctagaccaacactaagtggttttactctctcctgtctgtcggacagtagttcggtgtagcactgtttgcggcgaggagaaaggaaggagaggagaaaactgcactggatcaaggaggttagtgtgagtacagacactatctaaaccattggagttccatatgaattctatgacaggaacttaggtgcggctgtctgaatgggatgtggggtggggctagcttggggactttccctaaactgcattttacttaccaagcttaggacttttaaattgtatgttgaagaccaatgaagacagcaaacttttctacagatgcttttatttgcatttcagataatattgagaaaaagataaattatattaaagaatattattattattattattttttagatagcctttggtggggaaggatagtgattttgtagaagcaaaaggcttcccctatagcttttctcttctgctggagactcctagagataggttgaaagggacgtggacagcagtaggttgtggttctagagtatgggatctggggtctcccatctctcctgccatccttcagttttccagatccctctacctacctgaccatcttggtgaaggaaatggtgggcttttggggaaatccctagaaccctacaggtggttttaaaataatttgccttgttgggcctagtagctcttgcctgtaatcccagcactttgagagacccaagcaagaggattgcttgagctcaggtgttcaagaccagcctgggcaacatagcgagacttcatctctacatataatttaaaaattagctgggtatggtggcacagtctgtagttcctgctacttgggaggctgaggtgggaggatcttttgagcctgggaggtcgagactgtggtgagccatgatcttgccactgcaatccagcctgggtgacagagtggggctctgtctcaaaataaataaaaaataaaataaataaaataaaataaaataaaataaaataacgtgcctctgtctgttgccttttacttttcctgcctcccttttccatccttcccatttcagtgctggggaagccccaggcttttttttttttttttttctgccagcaaatgggtctctaaatccaggcaggcaggtacagggacctatgtcttagatggtaagtgtcacaagtacttaacatccactctcttctttttctccatctgttccaaggtcttcccataggcctgcagtagggctgtttaccattggaagcaagggaaagaggaggagatcaatctagaagcatggaggttggtgtgaagtgggggtagtctctggggatgacaagagagggtgggcataggaggtgggtgagatttaagagggtctcagtggagtgctggattgccacagtgctgccatgcctcctgtggatttcagtgcaggaaatgataggaatatgggggtaagggtgggctggagtatgactgggggaagacttgatggggggaccatgagatggtacacattagtatatagaacctgggctctggcgaggcagacattggggtcagggatcaggttgcttgtctgttctaccagggactcggtttccattacctactgtttgtttacttgtccatagatctgcctgcatgtctgctgcagggcttaagatcactggaagcaaagaaacaaagaggagattgctcctgatcagtatagactggtaagagtgtggggactgcctgggtagacctctagagtgggttggtggagaccagtgtgcatccagtaaggaccagtgaccagtctggaggatgaggatcctcagtctctccttttccagccacctttcccaccatccctgtcatttactccataccctcaccttaattctggtacagggaaaagagtgtgacagtgtcttagggagtggggtggactgagaaacgtagaaaggtagtttgctaataatatgtctgtcccatcaagaacaaactctctactcccatctgtccctccatctgtctgtctgtctctaggtccagagatctcatgaatttatgtatctactttagggtgtactgccaagagaagcaagaggagaggagggaactgcctcggatcattacaggttggtatgagggtggggccctgtagacaggtgaccagagtaggtccagtagaaatcaaagtctgggacttcttggttgctcccatttatcgtcagacctcctaccatcctttccactgttcatttggtgtatagaaatgtgtatagaagtatcttggaagaaaattattgggcattggggaaggtggagagaagatgaaataagaggaatggagaggctgctaatcatcctctcttccaccaagcacatggttctaccattttctgttcctctgtgtatctatctgtatgatgcaacaaaatcagaagagaaattttagtccatttccttcctccacttctaggtccacctccagaggcagctgtagtggcctttgagtggctgaagaccagcaccctcacaggcctacacccacaactaccactctctttaccccagcccgagtgcgctctaccataccttgttcgtgcttttagcaggggtgattacatgggccgcattcaggaagtgggctgggtgactgcaggactggtgatctgggctggcacctgctactacatttacaaatttaccaagggaagagcccagagtgtgaggactcttgccagaaatggatccacagttaagatggagactgtggttggggtacagagccagaccttggccataaatgaagcagagattaagactaaaccccaagtcgagattggagcagaaactggagcaagaagtgggcctagggctgaagtagagaccaaggccactgctatagccatacacagagccaactctcaggccaaggcaatggttggggcagagccagagactcaatctgagtccaaagtggtggctggaacactggtcatgacagaggcagtgactctgactgaggtcaaggccaaagccagggaagtggccatgaaagaagcagtgacccaaactgatgctgaggctggcaaaatagttaagaaagaagcagtgacacagaccaaggctaaagcttgggcgctggttgccaagacagaggccaagagagaagcaatgacccagaccaaagctgaaactcatatattggctgaaaaagagacagagattaacagagtaatggttacacagagtgagaccttggcagtacccagggaagtggccaagatgggggccacgaacaagactggaattgtggatgaaaccaagacaagagctctggaagagactgtgagtgtggctaagactcagtctgaggccaggcctggtgccacagttgatgctaggggaaatcccaatggcatgtccagggaggtggctggagtggacatgaagtcctgtgcacagtctcaggctgtgaccaagatccagggtgatgacatgcctggtactggggttgaggacatggggaattgtaaaaccatgtctagggcagagtctggggcagacacgagggcttctgctcagcctcaaatttttgccaaaacccagactgaggccattcctggggcaaagattgatgccgggggtaacaccaatgccatgtgtaaggtgggggcaggggcagatgtgagagcttgtatacaacctcagactgtggccaagaaacaggctgaggtgacgtctggtgccagggttgatggtaggggaaataccaatgtcatatctaaggcaataactggagctgacatgagagctgctgctcagcctcaagctgttgccagtactcacgctgaggccatgtctgatgctaaggttaagaacagaggcaatcccaatgccatgactaaagcaggggccaaggcaaacttgagggccaattcccaggttgaggccttgcctgatgccagggataagagcagaggcaatcccaatgttatggctaaggtgggggatgggacagacatgttgtcctgtacacagcctcagcttgtggccagtgttcaggctgataccttgtctgatggcaaaattaaggtcaggggcaatgtcaataccatgcctaaggaaggagctggggtggatatgaaggctcaaggtatggcccagagccagggtgaagccttacctaatactagaggtaaggctaggggcaaagccaaagccaagtgtaagacagggcctgggatggacatgaaaacctgtacacaacctcaggctggggtcaagaccccagctgaggccttgcttgattccagggttgatggtaggggcaatcctaatgccacttctaaagccgggactaaggcagaccagagggtctgtggtcagcccctggttgtggccaatccccagggtgaggccttgcctggtgccaagaataaagtcaagggcaatccccatactgtgcttaaggtgggggctggagaaggtacaacagactctgcccagcctgaggcagtggtcagtttccagggtgaggccttgcttggcaccaagaataaagttaagggtaatcccaatgttgtgcttaaggcagaagttggggaaggtgcaatgggcactgcccagcttcagattatggccagttccaagggtgaggccttgcttgattctaagaataaggtcaagggtaattccaatgctgtgtctaaggcaggggctgggacagatacaacaggctctgtccagccccagattgtggccaattcccagggtgaggtcttgcctggtgccaagaataagatcagaggcaatcccactactgtgcctaattcaggggttgggccatatacaacagactctgcccggctccaggctgtggccaattctcagggtgaggtcttgcctggtgccaaaaataaggtcaaggccaatcttaatgctgtgtctaaggcagaagctgggatgggtgcaacaggctctgtccagccccaggctgtggctaattcccattgtgagaccttgcctggtgccaagaataaggtcaggggaaattggaatgctgtgtctaaggcaggggctgggatggatacaaggggctctgcccagccccaggctgtggccaattcccagggtgaagtcttgcctggtgccaagaataaggtcaagggcaatcccaatgtcgtgtctaaggcaggggccagagaagatacagtgggctctacccagcctcaggttttggccagctcccagcgtgagaccttgcctggtgccaggaataaggtcaagggcaattccaatgttgtgtctaaggcaggggccagagaagatacaatgggctctgcccagcctcaggttgtggccaactcccagcgtgagaccttgcctggtgccaggaataaggtcaagggcaattccaatgctatttctaaggcagaggctggggcaggcataatgggctctgtccaggtccaggttgtggccagttttcagggtgaggtcttgcctggggccaaaaataaggtcaggggcaattccaatgctgtgcctaaggcagaggctggggcagatacagtgggctctgcccagccccaagctgtcgctaattcccagagtgagaccttgcttggtgccaggaataaggtcaagggcaataccattgctgtgcctaaagcagggactggggcaggcacaaggcactctgcccagcctcagattgtggccggttcccagggtgagaccttgcctggggcaagggacaagtctatgtccacttctgaggcagaagccacagcagaagatgaggcctatgcaaagcctgaggctgaggccatgcccacttctgagagtgagggtgggtcaggcactcaagcctgcagaaagactcagcctaacatccatgactactactggaatgggattggtgttgaagactggattgctgctgagcggtggatcaaatttaggtttcagaccatggatggagactgggaaaatagcgtgtcctgggctgatgatgagaatgaagccagtattgggtcctggagtggggctagtgataaggctgggattattcggtcttgggctgtggcttgtgatgagaccagtgttaagtcctgggctggggccagggctgagaatgtggttggtattgggacttgggctagagctggggagcaggccagtggagggctctgggctgggggtcagactagtgaggggacctgggctggggacaaggccagtggaggagcctggactggggctgagaaccaggccagtggggggtcttgggctctcgctgggaatcaggccattggagagctttgggctgcgggtcaggccagtgatgggtcctggcctgggggacaggccagtggggtgtcctgggttggggaagaggccattggagggtcctggactggggctgagaaccaagccagtgaagggtcttgggctggagctggggctgggaatatgagtagtgtttcatactgggctggggttgtggatcaggccggtggagggtcctgggctgggactagtgatcaatctggtggtgggtccaagcctagatttgaggatcaagccagtggagaagggtcctgggctggggctggtggccaggctagtggagggtcaatgttggggcctgaggaccagtccagtggaaggtcttgggctgacactgcagaccaagccagtggagggtctaggctgggccacgtagatcagtccagtggtggggcctgggctgggacacttgatcagtctggtggtgggtccaagcctagatttgaaaatcagaccacagaagaagggtcttgggctggggctggtggccaggctggtggagggtccaaggtggggcctgaagaccagtccagtggaaggtcatgggctaactctggggaccaaatcagtggaggattcttagttgggattgtggaccaggccaatggagggtcctggactggggctgggcatccagctagtgttgggccaaagcctatatttgaggatcaggtcagtggcagagggtcctgggctgatgccagggagcaggttgttggagattctaggctggggcttagggaccagtctagtggagattcctgggctgacactggggaccaggccagtggatggttctgtgtttgccctgggagtcagacgaatggagggtcttggggtggggctagtggccaggatgttggagggtctaggccagggcccacgaaccagtccagtgctgggtcctgggatagccctgggagtcaggtcagtggaagctgctggactggggctggggctgtggatcaggctggtggttgttccaaacctggatttgaggatcaggccattggaggggggttctggcctggtgctggggaccagactggtggaggctccaggccagggtctgaggatcagtccagtggaataggttcctggggtgtggctggtggccaggtccttgggggagctaggccggggcctgcagaccagtccagtggtgggtcctgggctggcactgggaatcagtccagtggaaggtcctggattgggcctggggatcaggctgttgactgttccaagcctgaatttgaggatcaggcttgtggaggaggctcctgggctggtgctgggagccaagccagtggagaatcctgggctggatctaggcctgggaatgaggccattggaggatctaggatgggatctgaggaccaggccactggaggatcctgggctagatctgaggaccaggccagtggaaggttccaggtcagttttgaggtggaggccaatgaaggattctggtttgggcctggagctgaggccgttatagggtcttggtgctggacagaggaaaaagctgatattgtgtccaggcctgatgataaagatgaggccactactgcatccagatcaggggctggggaagaggccatgatttgttctaggattgaggctgagaacaaggctagtagtggctcctggattagatctgaggaggtggcttatatgggctcctgtgtaggggctgaggctggggctggggctgaggctggggctggggctgaggctggggctggggctggggctgaggctggggctgaggctggggctggggctggggctgggcctgggactgagtctggggctgggatttggtcctgggatggagatgcaaccactgtagagtctaggcttggggctggggaagaggctggtgtagagtcctggaccttggctaggaatgtgggagaggatgagctaagtagagagtccagccctgatattgaggagatcagtttaaggtctttgttttgggctgagagtgagaacagtaatacgttcagatctaagagtgggaaagatgccagttttgagtctggagctggggataacaccagcatcaaggataagtttgaggctgctggtggagttgatatagggtcttggttctgtgctggtaatgaaaacacaagtgaggacaaatctgcacctaaggctaaagccaaaaagtcatctgagtcaagaggcatatatccgtacatggtccctggggcaggaatggggtcatgggatggagccatgatctggtcggaaactaagtttgcacaccaaagtgaggccagcttcccagttgaagatgagtccagaaaacaaaccaggactggggaaaaaactcggccctggtcttgccgctgtaaacacgaagctaatatggatccacgagatcttgaaaaactcatttgcatgattgagatgactgaagatccttctgttcatgaaatagccaataatgctttatataacagtgctgattattcttattctcatgaagttgttcgtaatgtaggtggaatttcagttattgaaagcttgctcaataatccctaccccagtgttaggcagaaggctttaaatgcactgaataatatctcagtggctgctgaaaaccataggaaggttaaaacttacttaaaccaagtatgtgaagacactgtcacctatcccttgaattcaaatgtgcagttggctggactaaggttgataaggcatctgactattaccagtgaatatcagcatatggttacaaattatatttcagaatttcttcgtttgttaacggtgggaagtggagaaactaaagaccatgttttgggaatgcttttgaatttctctaaaaatccatctatgacaaaagacttgctcattgccaatgcaccaacatcactgattaacatttttagcaagaaagagacaaaggagaatattcttaatgctctttcactatttgaaaatataaattaccattttaaaagaagagcaaaagcatttacccaggacaaattcagtaaaaattccctttatttcctattccaacgacctaaagcatgtgccaagaaacttcgagccttagcagcagaatgcaatgaccctgaggtgaaagagagagttgagctattaataagtaaactctgattggctgtatgttcccaaacaaatttgagtaatattttggttttgcactctggaagtaatgcacattgtaaattgcattataactttgaaactgatgttacctatgatggtctatagctggaccattttatgaacaccaaatgaattcaagcttgtactaaaaatacatgtgttgatttttatcttgtctggattgagatatttttagtatgcttcatgagcagaaactgaatggattcttcataagtaaggtaatctttggtcctttgtgtggacttatgtttatacatttaagactatttttatgtcatcaataaagttgtgtgttttaagcagcagaaaaaagtcattgtccttgtccttgagtttatgatctgtttggaaaggcaagatatatggaaacaaaaagatagcaataaaactgggagcttccaatcatggccagatgcctcctatcagtgtttagaggcggcagaaactgctgcaggcaacagtgctcaaggaaagttttacaaaggagggggacccttaggtaagctgggcttcaaggatacaaaaggatcagaagggcactcaagatggaaggagtgatgggaaaaaaggcatggagatgggaatccttctccagagagaaatgctggcctgcttgaagtgcaaagtgtagggagggtagtgacgagagagagagagagtcaggcagtagaggtgagtcctgttcgtggagcacccctaactgctaaactggggtgtctgaatattactacatccacccctgggagacatcaaggccttttgtgaccggaggaatgacaagacgaaaggaaaatgatatggtagatttatgtgcagcaggagtccaagctggggcggggataggagtggtgactggagattggaaaaacaggaagctaccacaagttactccaggcatgagataataaaggtttgaaattttactggaggccatgggaatggtaaggagaggatggacgtgagaggccctttgaaccaataagtgctgagatgtattctggagacatacagagaggaccaattttattttagggtccttggggcatttgacagaaaagtgtcctctttgccaattctggtatccatgtaagtaaacagttacaactttgaaataataagaaagtatactagaagaaagaagttttagtgcttgtatcagatttcctttataaggttggttaaggtggggcctttatggaaccatagagagtgttgttgggatacacatagaagatctacctctctcccaccccatagtgagggtgagggtgtcgggggaggagcactcttaaactgctggtgggagtatacactggtacaaggtccattggaatatatgcatatcctttgaccctgtaattccacttgtagaaatgtatctttaggaaataacacgtaattggcttgtaggaagctgtgcatcttcaaactgttttgaagggtgaaaagttgtaaacgacccaagtatctcaagataggcagttggctaagcaaattgatgtatgtctacacatttaaatattatgccgctattgaaaatgttgatggacatctacatgtgcttacattagaaattcagcatataatcttaagtgggaaaaataggctgtaaaagcacatgccatacatttaatgaagaaaaagtatatatctaaattatcttgctacatactctgagaatattaatagttttctgtgggtgttagactgatgggtgatttcatttgttgttttttctctttctttttttttttgttttaagacggagtctccctctgtcgcccaggctggagtacaatggcacggtctgggctcactgcaacctctgcctcctgggttcaagcgattctcctgcctcagcctcccgagtagctgggattacaggcgcctgccaccacacctggcttttttttttgtatttttagtagagacggggtttcaccatgttggccagactggtcttgaactcctgacctcaggtgatctgcccgcctcggcctcccaaagtgctgggattacaggcgtgagccaccacgcccggcctcatttgtttttactcatctctatttatgatatttatataagaagtggaattttatgcataatttaccaacaaggaagaagatggattcatattaggcaggcctggtcagtagtatttgagggacctggagcaaaagtataaatggaggctcacatatttatgcctacatatttggaaagtataacttaaaattttaaataaatattatttgtaaagcaataagtgttttaaaatttaaatcatattaggtatttaaaaaataaaaccattctcaatactagcattcgatggccaccaacttactctactgtaaaaaaataatgtcacacttgtagtggattctaccatctgctgccctgattccccttcaggaatgaaaagcttattattttaattgccaggagtgcggcaagtagacagtcctcagctgtcagccctcttcaggaatttcctcagctgaagaaagccacctcccccaaggttacaccccctacctgggggtatttcacatccaattactgatggatatggccttcttgccccaaattgggacagcttaactcctccctctgtccaatcctgcttccttcttttcccttccacaggtgttgatcccaagagcattccctagtaaaaacgcttcatgctgaactctatctctgggcctgcttcctgggaagccaacctgcaacagttggtacaagaagtggttcgagaaagcaaacactgtgatgaaattttggagatgaatcacctgctacccagctgtcaatgaagactccatcattggtggtaggtggagtagataggcctctggaataaggtagcagaggaattgttaaaattttcaatggtggttaactgggttggcatactggtaaaatgggacacattaactggtgccatgtatcagacctttgagaaatatgggatatattaaatataaggaaggccagaaaattgggcggctgttgctaagcagattgagctctggaaaagaataacaaaaagctgaattaaattaatcaacaattgaaagctatgtttgaaagtcagatggctttattcataacatataaagaggctctcatcttttccaggtagaaggtggagaaatctgaggagtagactcaggatttgttaaaagcaagcttcaaagaaagttaaaattctaaccaagacaagtcttctatgccgagttatgtgccatggttaagaaggaatgggactctgacacttggaatgggggacatctggattgatgtccctaaaaatcttatatccccagattcccctgagccccttgagaagtgtcctactcctccctattaagggctggcactccatcttgcttcaatatatggaatcctttcccctgtaagataacctgggttttcctcagaatctgcccgcacctcctatcctggccactgggcctataactagggttaagccacgcataatctagctggtgatgtgctgggtgtaataaggaaagaaagagaatacaccaacaaagagtttcgggacataacctagccagcatatactagaaggtgctgagggagtaagtatggcatcaaattctaaggagcttgatcaggagggctggaatataaactggaatatgggagaattaatcaatttgaaagtgctttcccagaatacaggatttaataccctggagaaaaccacaggaaatgacacgaactcattactgcgatggctcctcgaagtatggaaaaagccatggcgtacataaagtgaggtgtaaatgccagagttgccatagaagatggcgggaaaagggatcaaagactcagagaggtgagaattatataataaacctattatgtaaggccagaaaaccctccagaagattatattctacaggaggatccaaaggacaaaccatttaccaaagctataagaaatattctggtgagagggacatcagcatcactgagaagttcagtagtggatctcttttgcatgccagggctcagagtaggagaggatcttatggaacaaggatcactgatagaaatgatgatgcctctgaaacaatagaggcaagatagttgcacttaactgtcagaagttaggcggatgtaaataccacaatgcactgcagggtcagagtggcaggtggggaggcctgacctgcagagagctatggagatggttaacagaacacagtacccctagtgggtagatggttaagagacagttaataggacatggacagtcaatacaacataatgtcctggggggaaataggcagccaacaatctgcactctatacaatcaaaagaaatgaaaggtgttcacaggtttgagggaggttgcctcaataaaaagtcataattacttatccagcttctagtctcaagtcagcttttgatccacaatacatggtttgaaagaaaggccgagtgcccaggaagaaggaccctacaacgcatgtgtagtaatgatttctctggtccttccatttactcaggtaactgtgtaccaaggaaagagaaatactcgaacattttgagaacagatggacactggttctgagttgatattgacacccagagacctaaagtgtcttaattgtcccccttattagaatgggggcacatgggagccaagtattaagggggatcctggcctaggtagggttcacagtgggcccactgagttcacagacccactcagtggttatgtttttgatctctgaatgtataattggaatagacatagttggttagttggtacaagccctatagtagttctttggcctgtggagtcagagctatttgtagatgagaaggccaagtggaagcttctgaaactgccctcaccttccctggccaagatagtaaatgaaaacatatggcatctgtggagtggaggatggcagaaattattgccgcctttgaagacctagagaatgaagaggtgtggtctccatcatatcttcgtttaattcaccagtttaatcccctgcaaaatgtggacagagcctagatgacactagactactgaaaactcagccaagtagtaagacaattgcaatggcataccagacatgatatctttgctacagcagaaagcatggccttaagtacctagtttttagctattgatttagaaaatgtgtttttttccctatctgtatcataatggaaagttcatattcacacagaatggataacagtatgcatacacagtttttcctcagtgctctactaactatcatgtcctctgtcataatatagtctgaagaggtctggaccactcgaacatccttcagaatatagtactagtccacaatgtctgtgacatcatgctaattggaccaaaataagtaggaaggggccagcacattggaggccttagtaaggcacatgcactatggagaatgggagatgaaccctacaaagatccaggcggttggccacattaagtataatttttaggggttgaatggcctggggaatgctagaatatcctctcaaagggaaggacaaattaaggtattttttaccttcttcacagagaattttctggaagtgcactgcctggtaggcctctttgggttctggaaatatcacatttcacacctggaattactgtttcaccccatatactgggtgacacaaaaagtgccagctttgaggagaactatagcagaacaaggccctatagcaggtccaggatgcatttttaggcagtcctgccacttgatgcatacaagagacagtccttatggtactgattcaggtgaactccaaaagtggggcttagcccgggagggttcttggcttcactcaggaaagaattcaagagcaagctgacggtaaaagaaggcaagtttattagagcaatagtgtatagcaaaatggctgctccatggacagaccagggctgtctcataggcaaaggagccctgagtagcagtgtgcagcaaagttgctgctccacaggcaaagcagcctggagcagcagtagcagcagcagcagcagcaatatatagcaacagtagcattctggagcagcagagggagcagtagcagcagttctgctggctagctatatttatacccactcataattatatgctaatgaaggaatgggtttttggaattttctagaaaaggagtggaaagttcctagaaccatataaggcaacttctaggtcattgccatggcacattgccatggcatttgtaaactgtcatggcactggttggagtgtctttaataatgagcagtgaggacaaccagaggttgcttttttcatcatctcctggtgtctttactgcatcctgtttttgatgagcagggccattaccagtgcttggaaaacaagtcctgctgatgtcctatctcagtaatagaggtatctgtgttggaaaaagatgccatgtggagtttttggaagtccctatgggaaaggccctatgggaagcccctatggggaaatcgcaacttagctagggttgtggagcaaagccatgtcatatgaatggaaaattatataccttttaagaacagctcctgacatgctactacatcctggtagagatgaaatgcctgactatagaacatctagtggccatgcagccagaactgcttcatgagctgagttctgtcagatccaccaaggtataaggttgagtagccccggcaatgagatggaagtttcttttttgtttctctttttgagacagggtcttgctctgtcacccaggctggagtgcagtggcacgatcatggctcactgcagccttgacctcctggctcaagtatcctcccacctcagcctcctgagtagtaggaatatagtcacacaccatcatacctcgctaatcttttaatttttttgtagagcttaggctccactatgttgctcaggctggtctcaaactcctgggcttgagggcctttcctgccttggtctcccaaagtgctgggattagaggcatgagccactgtgtccagccaagatggaagttttatatatgggatcaagcacaagcaggactggagggcataagcagttgcacaatcaggtagagcagatcctctatgatagccaccactgttgcactagtacctttccttatctatagctatgaccttacaccagatcctatgtgacacaggcattcaagtgttctttattttttttttatttttatttttttcttcttctttaggacaatttgcttaatttattgccttggaattttttttctctttttttaattatacttttagggtacatgtgcacaatgtgcaggttagttacatatgtatacatgtgccatgctggtgtgctgcacccattaactcgtcatttaacattaggtataactcctaatgctatccctcccccctccccccaccccacaacaggccctggtgtgtgatgttccccttcctgtgtccatgtgttctcattgttcaattcccacctatgagtgagaacatgcagtgtttggttttttgtccttgtgatagtatgctgagaatgatggtttccagcttcatccatgtccctataaaggacatgaattcatccttttttatggctgcatagtattccatggtgtatatgtgccacattttcttaatccagtctatcattgttggacttttgggttggttccaagtctttgctattgtgaatagtgttgcaataaacatacatgtgcatgtgtctttatagcagcatgatttataatcctttgggtatatacgcagtaatgggattgctgggtcaaatggtatttctagttctagatccctgaggaatcgccacactgacttccacaatggttgaactagtttacagtcccaccaacagtgtaaaagtgttcctatttctctacatcctctccagcacctgttgtttccttactttttaatgatcaccattctaactggtgtgagatggtatctcattgtggttttgatttgcatttctctgatggccagtggtgatgagcattttttcatgtgtcttttgcctgcataaatgtcttcttttgagaagtgtctgttcatatccttcgcccactttttgatggggctgtttgtttttttcttgtaaatttatttgagttcattgtagattctggatattagccctttgtcagatgagtagattgcaaaaattttctcccattctgtaggttgcctgttcactctgatggtagtttcttttgctgtgcagaagctctttagttgaattagatcccatttgtcaattttggcttttgttgccattgcttttggtgttttagacatgaagtccttgcccatgcctatgtcctgaatggtaatgcctaggttttcttctagggtttttatggttttaggtctaatatttaagtctttaatccatcttgaattaatttttgtataaggtgtaaggaagggatccagtttcagctttctacatatggctagccagttttcccagcaccatttattaaatagggaatcctttccccatttcttgtttttgtcatgtttgtcaaagatcagatggttgtagatatgtggcattatttctgagggctctgttctattccattggtctatatctctgttttggtaccagtaccatgctgttttggttactgtagccttgtagtatagtttgaagtcaggtagcctgatgcctccagctttgttcttttggcttaggattgacttggcaatgcgggctcttttttggttccatatgaactttaaagtagtttttcccaattctgtgaagaaagtcattggtagcttgatggggatggcattgaatctataaattaccttgggcagtatggccattttcacgatattgattcttcctacccaagtgttctttaataagtttgtgtgtgtgtgtgtgtgtgagagagagaaggagggagagattctagaccccagacccttcaaaacatgggacttaggggggccttctggctcagtcctaagagccctcctgcctagttatgaggctagggtagcagtggacaacatttctaaatgttttggagagatagctggtcttatagtcagttctgggtctgactctggccccgggtccccagattcttactctagtgttgttgtagtagtagacttagggcttagaggctggtttaagattttgagtacagtgggtttgctgggtcatgcacatataagaaatcatataacaccacttttcaaaggtgaaaatgcaatccttcttcttgggcaaaaaggtccatttctgaaaatcatatgaactgattggtccttgaggcagtttagtgtaggggaaagaatataatctggagtgaggaatgaatggggagggatattaacatttctcttccccttttatttttcagacataaaggagaagatttgggagagggagaggattaatcctgatttgaactcttcgaatttgaagtgcttatgtactatgatttgaatatggtttatccccatccaaagtcatgttgaggatgggttcccaatgtgacagtgttgggaggtggtacccttaagaggcatttgtgtcatggggaatctctcctgatgagggtatgaatgcagtctctttggagtgggagagttcttgtgctcatgggactggattagttactgtgaggaggttggttgttataaagtgagtctgcctcttgtgcttggtgtcttttgcgtgtacctgtttccccttttgtttctttgccatgttttgatgccctcaaaagaagttgtcggatgtgactgcccagtcttgaacttcccagccctcaaaactgtgagttaaataaaacgtttctttataaatgtctaagtcttaggcattctcttatagcaacacacaacaaactaagacactgtgggacttccaagtggagaagctcagtattgatttgagaggtatgggtctagagctcagaataaatgtctgggctgaatatacatattacagatgataacagaagagtaagtcaggtagcctcagtgaagagtacagatggaaaaactgaggacagaacactgaggaagcctagtacatgtggggctttggcagagaatagcgcagaattgaaaccgagggtacagccttccagcagtattatcatgcatgtccttgtacatccttcttttttctttaaaaaattgtgataaaatatacataacatttaccatcttcaccatttttaggtgtacagttcagtgacattaaatacattcacattgttgtgcaaccattaccaccattcatctccagaactgtttccttttcttttattttttgagatggattttcgctcttattgcccaggctgaagtgcaatggcacaatcatggctcactgcaacccccacctcctgggttcaagcgattctactgcctcagcctcccaagtagctgggattacaggcacctgtcatcactcccggctaattttttgtatttttcatagagacggggtttcaccatattggccaggctggtctcgaactcctgacctcaggtgatccacccaccttggcctcccaaagtgctgggattacaggtgagagccaccacgccccgcccagaactgttttcatctcccaaactgaaatgtttacccattaaacagtaactcctcccactgctccctcagcccctgcaaagtgctattctactttctatttctatgaatttaactactcaaggtgcctcattttagtggaaccatatatgatttgtccttttgtgacttagcataatattcttctattagtctacttgggccgctacaacaaaataccacagactgggtggctcacaaacagcagaaacttatttgctggaggctaaggagtccaagatcaaaatgccaaaagtttctggtaagggcttttttcatggcttgtcaatggctgctttctcactgtgtcctcatgtggcctttccttggtgcgttgagagagagagagaaagagagagagagacactttctgatgtctcttcttataaggatactaatcctacaaaatcagaaccccacccttatgatttcatttaacctcaattacttccttagaggtcctatttccaaatacagccacattgaaagttagggctttaacatgtgaattttgcggggacacaaccattcagtccataatggttctcaagcttccagttctttacacagaattggagtactctatgttcaatttcagaacctggtttttaaaatgtaattttcatagttatagggtaccataacaattacagaaatcctacagaaccttccttcatccttccccaccccagatttctgcttccaaattaatttcaatttccttttaaaattacttttaattccagattacttacaattctcttaactatttcttctgatattgcctttatattttttattaactattttatttcttgatttttaaattttatgtatcagctgggacttcctacagtggaaggattcagttgtcttatacctcccatcctatacacaaccatacttctcccatattctcccaatatattgttgttgttgtatcactatattatgttcaatcaatattcagtgtttacattatgtctatgtaaggatttttcacaattgagacattagaaggagaggcaggtaagtgcatggactctgccactagacagcctggcttcaaatcctgaatttgtcatgtaatagctacatgatcttgaacaaatctcttccactctctgtctcactttccccatatttaaaatgggaaatggcatatctcataagatttctatgaggattaaaagattaagcactcagagtcatacttggtacatagtaattggcatctattatatattattgttgtccattatataaattttttccctagagttcatggatccttctgtattcctgctccattttggaagattacccttcaggcctaatgtacagctattgtcctagaaactcccttgtcatcatagtggaattttcttagtctctttttcatgttggatcttgctttccctacatcctatggcttaatctttcttgatttatgacctcattttgacaaagtaaatctaggtttatgagaaagagtgtatagtatataaataccttgagattttgcctgtctgaaaatgcctgtattctacccttacacttgactggtaattattggatataaaattctaggtttaggtcatttccctcagaattttaaaaatttacttttcaaatcaaagctgtatatgcatatagtttaaaaatccaatacagtcatgcactgcataacaacatcaatgatggacagcatatacaatggtggtcccataagattataatgaagctgaaaaattcctatcagctagtgatgtcgtagccattgtaatgtcgcagcacaacacattaccttttctatgtttaaatgtttagatatgtaaataccattgtgtaacaattgctaacagtattcagtacagtaacacgctgttcaggtctatagcctagaagcaatagtttataccatatagcccaggtaggtagtaggctatatcatctaggtttgtgtaaatatactctgtaatgttcacacaatgactgtatcaccgaacaatgcatttctcagaacgtatcttcattgttaagcaatgcatgagtataatcatacaaggctaatgtattagtcctcttgagcttccataacaaaattccacaggttgggtggattaaacaacaaaaatttattttctcatagttatgcaggctagaattccaagatcaagacgcagtcagcattagtttctggtgtagcctctcttcctggctcgtatatggccaccttcttgttgtgtcgtcacatggccttttctctgtgtgggcgtggagatagagagagatctttgttgtctcttcttataaggacaccaatcctatcagattagggctctattcttagtacccaatttaaccataattacctccttaaaggctctatctctgagtacagtcacattaagggtttagggcttcaatatataaattttgggggacatgattcagtatataacagcttactatgaaaaacagcaatatccttgtatcgcaacactattttctacacccagaagcaataaatttcaactcttttaatgtattattttggtattatctacctatgtcaaaataacatacttatattgtttcttgatttttgagttttaagtcactgacttcccactatgggagatgagtttagctcttcttttatactcacccctgcttattgtaatcatacatttctacatttcttataccctgccctctcaattgctttagtcttattttagttatattgacagtattatgttgactatgtacttgttattgacagttgagttacatagtatattaggattattttttcctgtcctgcacaactttttattttctctagatttaatttcttcccccctctctttttctatgtatttatcaccaatttatttccaaaatatactcccaattatgtaaatattcttccattatgtttaaataaattaggtattccaacaatttcattttctggacaaagtttctcttgggaatctttggacctgctttaaactagactggttgcactctaggcatgcaacacaacttttattttgggatttcttttcacaataatcttggtgactttccttgctcactattgtgttagattcactgtttcctggatctcacatctccctctttcttggtttatgctctcttttggcagaacagaacatatcttccagtagcttcctgagaaagtgtatatgcaaagcacacttctgagatctttcaggtttgaaagtcatttttctttttttttaatcaaaaaattttatgtaagcaaacagcatacagtattaaaggaaaaatatttaatatattcaagaatcacatcatgacaaatgatacaaatttgtgaaatatcatttcttcctctttttgtatttttttgtagatggttttgccacattgcccaggatggccttgaactcctgggctcaagtgatccacttgccttggccccccaaagtgctgggattacaggtatgagacactgagcacttttctattttaactaaacttgccatcttttcccctgtgcttttctgttactgtcccctcctgttttcctactacattgacaggttatcttgaaaatgtcatttttctactccaatacttgattgatagcttggctggagatggaattttgaactggaaattctctaagaattttgaggacattgtttcattgtattttagcttccagtgttgctgttgagaagtcagatgttactccagttcttttttatatatttactttttcactaggtaatacattcacatggttcaaattaataataaaaaatgcagtgaaaaaccttcctccaaccaacattcttcttccactcagttccccttttccgaaaacagataactattgttattagtttctttttcatacttccaggatttcatcttgcatatgtaaggaaacataaatgtaaatattcttattttaccccttttataaatgatgaaatatagaatatatatacgcatatattcacacacttgctgtcctgcactttgctttttttaggttgtttatttgcttgttttacttaacaatatatcacggaagtctttccacatgagtacataatttactcacattttacagctgcataatctccctttgtgtgaatgtaccaattttatttagaaagctctcttccaatgaatattttgattatttccagtcactccaatgacaaacattgcttcagtaaataatctccagtcttctgccagggtcggggagtgatagtcactgaggtacttggagtggaagggtgagggtctgtttttgaaacatttaaccaagcctcctatttttggtcttattttcacccttgcttattacagaatactattctctgaggttgggggttatgtgatgtaagttatattacttctcacctttctctactttagggataggatgcagctatctcaaatctaataagttgattgcaatgtgcccatctgtactccagcttctaaaattgtgttactgttgtctcctatccttttctttttttattgtacctttaaatatctttactgtaattttaatgggatttttaggaagaaataaagtctaatgctaagttcatccccaaatattttattgggagttcatgccttagaattttgaaattatccttctgaaatcgtttagttgtgtgtggtttgagaagcctaatgctcttctatttcttgtccattatacatgacatttttttcctctctgaaaatgtttaggttcttcttttcatccttaatattttgaaacttatcaataatatgattttttaattttgtaggttgctatgaaaagaaaaatcatgatattaagtaagtctatttttattcattttgataggaacttaatgggctgtttcaatctagtgacacatattttgcattagttctttaatgattttttgatttcttgtattagcactttgattgtttcttcttaccatttttctgttctttcgttatggaacttgtactatttctgttttacctcccatatgataattttattatctttttcctattttaaaaaatctctttcttattgtgttctacatttggggattttttcccctactcttttgatcttctattgatacatggagcttttcctgacctctgattgtttcttttaaaatagaattctgcacgtgtctcatggatattatatattcttatctatttatggatattatagatttttatggctttcttctgtttcatgtattgtctattttactctcagcttcctttttatggccttttgtcttggtctcaccaaaacaatgttagtcctctaacaaacatatatttatctttaagaatgagcccctccatagggttaggagggatccagttatatcattgtggcacacacaaatgccagttttcatagatactttttttttttctgagcattctgttgcccacactggagtgtagtggcgtgatcatagtttgctgtaactttgaaatcttgggctcaagtgaccctcccacctcaacctctgtaggtactttttattaggctaattagtttacatggagaggaatcctccaatctccttccttgggcttataagcacagttgacagtgctcaggaggctgagcgagggaaaggaccttgagtggggagaatgtctcacctttcaatatgcaaactctcacttaattattcctttttttttttagtacaacttattatacccaccttagctgcactcataagttcagaccttttctggtttaacttctccagaaagtaaaccatctgttttctgagagaactcacctagtataggggctggaggagaagatcttggggtctaactgccccttattaaaaatttcaactaatgggctgggtgcggccgctcacgcctgtaatcccagcacttcgggaggctgaggtggatggatcacttgaggtcaggagtttgagaccagcctggccagcatggcgaaacctcatctctactaaaaatacaaaaattagcctggtgtggtggcaggcgcctgtaatctcaggctgaggcaggagaatggcttgaacccgggaggcagaggttgcagtgagctgtgattgcgccactgcactccagcctgggtgacagagcaagactctatctcaagaaaaaaagaaaacaaaaatttcaactaatccttttgttcttagtccaatgaggacccttcagcagttaactggtgcctcaaattcctgagcttctgtactgctctgtggagtgaatcacatactcctaactcatcatcatcattcatgggagattggagtttccgcttttcctgtttttctaggtcattcaatgtttatccactgatcttccaatattttgttaatatattccatgaactattatttcttctccatttctgtttgtatttctgattattttaatgagatttcaagatggacttgagataaatgcatatgttgtattctgtattaggactctctagagaaatagaaccaataggggaatatatgtgtgtatacatacatatatatacacacatatatatatacacatatatatacatatatacacatatatacacatatatatacacatatatatatgtgtatatatgtgtatatatgtatatatatgtagagagagagagagagagaagagagagagagagattcatttttaaggagttggctcacataatgggaactgacaagcctgaaatttttagggcatgctggcaggctgaaaagttaggtaagagttgatgttgtgatcttgattctgaaatccgtagggcatgttgcaggctagaaagtcaagtaggatttctatgtcttgaggcagaagtccttcttctccaggaagcctcaagttttgctcttaaggtcttcagctgatttggtgagacctatccagacaatgaaaaacaatccattgtgtcaatagattataaatgtgaatcacatctacaaaatgccttcacagaaacatctagactagtttttaaacaaacaactggacatcacaacctagccaactttacacatagtattaaccatcacagtctaccttggcacccatacacatctccttaaaccatacgtaatctctaaatatagacaataacaaagcaatacctccacttatcatgatacagatatcctgtgttcaactgaaaatgcaccaaccttttccccagaagaggacgcaaagtccttgggcaatgtttacacttctccttgatatcctgtaacttaaatgctatgatgtaaagctaatacatattttgttatatgacaagggaataagatatttgctatatacacacacaaagatgtttgctatatacacacaaacaaacataatgaaatgaggaaaaaatacacatgacaattacagtcctcatttctacaattggttatgtggtcatagctggtttttataactattttctttcactatccattccatattccctctgctctcagcaagtactccagctggtcatggttctttgctaggtcaggtgacctacaccttcattcctgaagagtttgggtctttattagtcctgcttgaattgagtgattgtagctttccattgactttaatcacagggcatggaaacactaaggggtattagtaccagtactaatactagtggatattagtactagtattagtactaagggatactagtgcatggtagcactaagccctaagggatatcctatattccagacaagctgttccttacttccattgtggaatagactcacatttcccccttgttaatcaagaccaataaccccagctagtacagcaaatctgttcattgcctgtttattcataggcatgagaagcccaaagtggcctggtggcagtcttaacttcaatggaatcattgttgagtttcctactggaagcatttctccctttgaaactaagatcttcagaccagcagagcataagatcatggaggcaggaagcaaaaattttggtagtgaaacactaggggtgatagagagtgatgccactcccatttccaccccttgattcctgggcccatgaaacctggctatgaaaaaaatagcaccatatattggattgctgatgtagatcacataaaacttcctggagaacattactcctatagagagttgcctgtaagaaattgttacctacctcatgctgtaactgagtcttcaaaaggccattctgttaagtcagctgcttcaggataatagggaacatggtttaataccagtaattccatgaccatgcacctattgttgcacttcacttgctgtgaagtaagtttcttacgagaagcaacgctgtgtggaataccatatagtgaataaagtattctgtacatccatggatgacagttttggcagaagcattgcaaccagggaaggcaaatccatatccagagtgtctgttccaataagaaaaaaatgatgccccttccatgatggtagtggtccaacataatcaacctgcctccaggtagctagttaatttccctggggaatgtttccataatggaggactcagttttggtctttaatgctagcagggttaatctccttagacagggatggaagggctgtctttactggcaaagaagaatcagttgaatttaggggtttaaattccttaacgaaggtccccagcttcatcaggttctacccatatgttctcatttaaactttcagaatccaattccctcctaatcaatgctctcactttaacatcagacaccctgagagttgggaattcaatttacattgtaattcagccacttgcagacatagaaacttccaggtcatttatacagtacttgtgttgggaatttgaagccctgagctcatccctttcttctgcaactttatccagcacgattaacagcaaccaactaatctcatcttacttgttagtttgacaaaaaatgtcctcaggtataaaatacatgtttggtcactcagaaccttgactcttccaagtatgtgattaggagtatccagtgatgatattttgtgtatttttttcttttctgttttcttttctcctcccttccttcctccctttctttctttcctttccttttctttctttctttctttctttctttctttctttctttttctttctttccctccctccctccctccctctcttccttccttccttccttccttccttccttccttccttccttccttccttcctccctccctccctccctccctccctctctctctttctttctctctctctttccctctttctctctttatctctttctctctttatttctttgacaaagtctcactctgttgcccagggtggagtgtagtggtgcaatcttggctcactgctacctccgcctcctaggttcaagagattctcgtgcctcagcttcctgagcagctgggattacagccagctgccaccacacccagctaatttttttggtatttttagtagagatggggttttgctatgttggtcaatctggtcttgaactcctggcctcaagtgattctcccaccttagcctcccagagtcttgggattacaggcgtgagccactgtgcatggccatgttttgtgtatttctactgcctcatcatgccattgactatccgtgttctctttaccactggaaacagagttattagtatctttaaatctaatcagattagagaactaattctaaaaccacagaattcacagttaagattctttatagaaataatataaaaataaaaagtacagagaattagaacagtgcagtaaggatgatttaagtttaaaattttaaattaatgctgtttgttgagataacagttatattttaaattagaagtatgggccagatgatgggacatagcttctcggaaaaaaatatatccacattcttatttgcaaaatcagaaagctcatttatctttctgaatcacttgtcaaggataaattggcaagtcaatacttgaaaaaaaatttggttgtcatcagagcagaaaatgaagagtcattccatgtctaattaataactttataaacagcggatttctaaaaagtgggcccctcttttctccccactaacattataaaattataagtgtatcttaattggaagaaacattcttcaataaacaaagtaaggcattgttatcaataaaataataaaaattggggcctgatccacaaaatgtctttttctcttattaccccctagctaaagaacgttcaattcctcaactgtagttatatctgcatccaaatctctaacaaatgtgtcgtgttattagagcttcagttgtattataatacggtaattttggagtcctaataaaggaaaaggagtcaggctggcgggagcaggagaaagcaagaagagaaagcagataatctataagcctgtctttcttcatggtccaggacacacacccctcctgcgcagataactcacaatcttcttgtgtccagctattaccaaaccctcgtctgatagaaaaatgcaagttagctcactgcagccttggcattatcagtactgcacgcagccctctccagcacaagcaccgtcctaaaaaatcgccagcaagcctttgtctttttgcagtcagctcctctcttcctgatttgcttgttgctttcttgcagcatattttcatactttctctaataaatttacctttatttacctacaactgtcttcataaattctttttactgctcatgccaccagcctggatagttgatacccgtggcagtaatcttgtatttgactaattggttttggtcaaggcttcacataaaaaattatttcttcacttaattttctttcacttttaacacaagttagaaattacatctttacctaaatgagtgattcatattcaaaggcaacctaatatgtagtgtctgttttactgaatgttgagatttaaacaatgaggcttctgttcagtaagttgtattctgatttagaaattttacatatatttgaaaggaaaatatgggctaaataaataatattgctgtggaaattatctatttagatttagaataactgtaccaacaatagttattacttttctttttctttttcttattgagatagagtctcactgtgtcacctggggtggagtgcagtggtggaatcactgttcactgcagccttgacctcctggtctcaagtgattctcctgcctcagcctcctcagtagctgggactacaggtgcatgccactatgctgagctaattctttttttgtacttctgcctcccaaagtgctgggactgcaagggtgagccaccacacttggcctgattattacatttacttttgtattttgaagtacactgagatagttgaaaagtaacagaccttttaagacagtatcaaagatgtgaaacaaaaaacaaacacctcatcagaagtacagaagaacctaatggatatgactgaaggtggaatttgttatttgggagatttaatcatggaattcttcctaaattaaaaagagatggaaattataaaagaaagattgagtgacatagaaattaaatccagtagatctaatatctactcaaggtttgtaaaaaaaaacaaacaaagaaataatagaaagaaatttcctgaaagtctgggtcctctagatttaaatgccccaccaaatgctgagtaagaaaaatttcagagcacacataagaatagttagacagatcttaagcacataaaacatataaaatcctacatgcttccagagggagaaaaaaggtaatttttaaagagaaaattaaaatgtaattggatttttttacccaaaaaagtttatgttagaatgtaatggagcaatgtctctaaaattctgaaggaaaaagatcatgaacctagaagtctgtacacaaccaattaatcatttgtagtagtaatattctgtaaagtttaatgcaattgtttgtaaagaattcctaaaattatagtgacatactataataacagagtaaaaaatagagaaataaaactgaagttcaaggtaatgtgaacacatttggaagcagagttaggatataattgaaagcatattaaaggtcgtatcttacttgagattgagtgcagttatagatagtggttaaatggtgacattagtaggaaatacatttatatacatttggtaaaattttcacttgtagtcaatagcagactagcattaaaatgtagaattttcaagtgactagagggaaaaatttgtcagaaaagaaaaactaaaaggagcaatacgaaatcatgattaatagaaagcataaatataagatggcaggaataaaaccaaaaagaagtaatcacaattaacatggatggttaaattcccttattaaaatacaaggatatccaggttggactaaatagccaacaatataatcttttcaagatacacatcaaaaacaaacacacaaagattgaaaataaaaagatttaaaaaacccaggtaaatgtgaattaaaaaatcagaattgctaagattaatatcagataagttaaattcgaagcttagctggtaagctttgaatatcagagcttatcagagcttaaaataactatcttattttatatctatatattttattttatatttataaatggtgtgatccgccaagaatatacaagaaactttatcaaacagcatagcattgaaatatataaattaaaattattagaaatatagcagaagccctattatccaatgaaatttggactggtagctcatcagttaattgaaaaataattgagacattggagaaaataataaaatatatattaggcattttaacttaaaatacacaaattctctttcacttggctgcctttgatatagaaccaacaacttaactttgagtataaatcttctggttagagtttcacatcattttccttgtataagccacatccatgatgtatcagctataattttcagttctgttaactataagtacaatgttttatagcaaatctccaaaacttgtttatcttgtatcactaaaattttatatccattgaacagcaactccccatttccccctacacccagctcctagcaaccaccattctattctctgtttctgagtttaactattttagatacctcatataagtggaatcctacagtatttgcccttctgtgactggcttatttcatttagcatgtctttcagtttcatccatattgtcacataggcacaagggcagaatttctttctttttaaagactgaataacactccattatatgtatattccacattttctttctccattcatcttttggtggacatttagattgttttctatcttgactactgtgaataatgctgcaataaacatgagactgcagatatctctctgagattctgatttcaatacttctagatatatatacagaagtagaattgctggatcatatggtagttctattttagttttttgaggaacctccatactgattttcataatggctgcaccactttacattcccatcaacagtgtgcaagggttccagtttctccacatcctcatcaacactggttatcttttttttttgataatagacattctaacaggtgtgaggtgatatctcattgtggttttgatttgcatttccctaatgattagtgatgttgagcatttttttatatacctgttggccatttgtatgtcttttttgaagaaatgtccattcaagtcgtttgcttattttaaaatcaagttatttggttttctcctattgagttttagaagttacttatatattttggagattaacccttatcagatatatgcatgatgctattttaaacagaattattttcctaattttattttttgattgcttgtgtatagaattataactgatttttgtatattaattaatcttgcatcctgcaacctttctttaaaactgttcatatacaaggttatgttatctgcaaatagacatcatattttttcctttccaatcaggatgcattttatttctttttcttatccaattaccctggctaggacctccactaaaatggtgaataaaagtggtaagagcagatatccttgtcttgttcctgattttcaccattgaatacgttatctgtgggtttttcatagacatcttttatcaaatggaggaagttctcttcccttcctagtttatcaagcattttttattatgaggagtgtttaattttgtcaaatgctttttctgtgtctattgaaatgatcatgtgttatttctcctttactttttaaatctggcatattacgttgattgattttcagatgttaacctgactttacattcctggggtaaatccttcttggtcgtgatgtataattatttttatgtgtgcaagtattgtgttgagaatgtttttgtctgtatttataagttatattggttagagtggttttcctttcctgtgacgcctttatctgattttggtatctgggtaatactggccttacaggatgagttttgaagtgttctctttaagtttttggaagaatttgtgaaatattcatattaatttttctttaaacatttggtagcatttaccagtgaagccgtttggtcctggaattttctttatgaggtttttttttaaaaaaattattactaattaaatgtctttttttttttttttgagatggagtttcgcttttgttgcccaggctgattggagtgcaatgatgaagtcttggctcaccacagtctccacctcccgggttgaagcgatcctccttcctcagcctcccgagtagctgggattacagatgcctgccaccatgcctggctaattttcatatttttagtagagacagggtttcaccatattggccaggctagtctcaaactcctgacctcaggtgatctgcccacctcagcctctcaaagtgcttggattacaggcatgagccactgtgcccagcctaaatctctttactaaattggtcaatttttattttgtatttcttctttagtcagttttggtaattttcagttttaggtatttgtccaatttcatatatgatatctaatttgttggcatacgatttttcatagtattccttataacacttcattttgtaaggctggtagtaatttccctgtttcattctttatcctagtaatttgggatctctctctttttcttggtcaatctagcctaaggtctgtcaattttgttgatctttttaaagagccagactttggttctattggttttctctattatttttctattctgtttcatttgtctcctctctaatacttctttctgcttgacttaagtttatttttctcttcttttcacagtatctttaggttaggttcttgatttgagaccttttggtatttatagctatatttttctctgtaagcactgtttcagctgtacctcataagttttggtatgttgtatctttgttttcattcagctcaaaatattttctaacttattttgtttgactcattggtgacataggcatatgtttaatttgcacatatgtgtgcatcaacccctattttttgttgttgattcttaatttcattatggtcaaagaacattcttcatatgatttcaatccttttaaatttattgagactcttaaaatctaatatgtgctttatcctgaagaatgttccatgtgtccttgagaagaatatgtatttttctgttgtttagtgaagtgttctatagatgtctgccacttcttgttgatttaaagtggtgttgaagtcttatatttccttgttgatcttttatctagttgttctatccattgttagaagtggagtattgaattattcaattattattattgaattgtatatttttccaattctgtctacttttgctttatgtattttggggatttgtcatgaagtacatatatgtttataattgttatatctttttgaccttttcatcattttaaattatccttctttgcctctaataaaaatgcttgtcttaaggtataatttttctggtattagtaaagccctccaggtcccttttggcaactgtttgcatggtatatctttttctgtcctactttcaacttgtttgtgtctttgaatctgaagtgtgtctcttatagacagcatatggttggatcacacgttttaaattaattctgtcaatctctgcctttacattagagtgtttaatccatttatattaatgcaattacttatagattgggattcacatatgccattttactatttgttttctatatgtctcatatcttttttgttctattcttctattactgcttcttttgtgttaaataggagtttcctagtgtaccattttcattcctttgccattccatttactatattttagaatttattttcttagaggttgcccttggagttacaattaatatcttaacataaaaatcaagttcatatcaatgtcaacttaatttcaaatctttgctcttaataacttcataacctcctcactcctttgcatcgttattgtcatacaaattacatttttatacattgtatgaacatcaacacagatttatacatatagctttataaagtcttgtaagttagataggagaaaagacagaattataacaaaattcatttatattgtattttatatttacctatgtcattgttgttgcatgtattggcagaacagccagggaaggagaccatcaataacaacccttctgggatcacatacaattcggggagttaggaaggctatgtacatatatgaagctacgttcacttaggagaaatcagagaaggatggagcaggcttgaaagaattcctcaagccacacacagacctataaacatagggcaaaagcaccagtggcacagggacttaaacacaacttctgagcaaatactgactcaaccataggctactctgacccaggggcaaatcctagaaatccaggatgaaaaataaaatcagtatcatccctggaagtctagaagaatgtgtgtatgcccaaggctatgcccttgaaggagcaatcacagaaggatcctccaaggtactagtggctgaatgaggtggtggataggggacaaggaaatatgtaaattcactgaactatgagagccatctccaagccatccacatatccaatggcaaaggataaaaatctaattggctaaaggatgcttaagcacaacctttaactaataaatagcttatgccaagctacggtcaaaacctaagtagccaggctaaaagataaaaataaagaaaaaatatctgagcagggacaccagagttgcacatgttgggggaaatagacttcacagaattagttcagccaagccaacaaacaaacccatgaccaagcaaacaacaacaatctccagggtgtgggcaggtggttcagtattcagggtttctataatatattatctaacatgtccagctttcaacaaaaaattacaacacatgcagcaacaactacataggtaaatacaagacaatataaatgaattttgtaataactctgtttttttctcctacttacttgactttataaagcaacatgtataaatttgtgttgatgttcatacagtgtataaatataaattattgtctaccaagatcttcactgttttaaaaaatgcctgcaggcatagcttttttttttcccccttttccaagttaagtcagtaccctcaagcagagctgcagagtcctttatccttatgtcctgcctttcctcctgggaagaatccctgaaccactgcaccagagctggagccagggacctgcttttatctgagtgatgcccctgctctgtgagatagttctaggaaggggtggcagctcctggtcctcttggattgcccattttggagtagaaaatatatttgaggaaataattgtcaaaattttccagatttgttgaaagatataaatttataaattcaagaagtttcatgaattccaaatggaataatctcaaagaaaaccacctctaggcacatcttattgaactgctgaaaatgaaaagtaaagaaaaaattttagactgatcattccaagatggccaaataggaacagctccggtctacagcttccagtgtgatcgttgcagaagacgggtgatttctgcatttccaactgaggtacctggtttaactcactgggactggttggacagtgggtgcagcccatggagggtgagctgaagcagggcggggcatcgcctcacctgggaagtgcaaggggtcggggatttccctttcctagccaagggaagcaatgacagatggtacctggaaaatcgggacactcccgccctaatactgcacttttccaatggtcttagcaaacggcacaccaggagattatatcctgcacctggctcggcgggtcccatgcccatggagccttgcttactgctagtgcagcagtccgagagcaactaggctgggggaggggcatctgccattgctgaggcttgagtaggtaaacaaagcagccaggaagcttgaactgggtggagcccaccacagctcaacgagacctgcctgactctgtagaatccacctctgggggcagggcatagcctaacaaaaggcagcagaaacttctgcagacttaaacgtccctgtctgacagttttgaagtgtgccatggttctcccagcatgtagtttaggctctgagaatggacagactgcctcctcaagtgggtccctgactcccgtgtagcctaactgggagacacctcccagtaggggccgactgacacctcatacagccagatgcctatctgagacacaacttccagaggaaggatcaggcaacaacatttgctgttctgcaatatttgctgttctgccacctctgttggggatacccaggcaaacagggtctggagtggacctccagcaaactccaacagacctgcagctaagggtcctgactgttagaaggaaaactaacaaacaggaatagcatcaacatcaacaaaaaggacatccacaccaaaactccaaatgtaggtcaccgtcatcaaagaccaaaggtagagaaaaccacaaagatggggagaaaccagagcagaaaagctgaaaattctaaaaaccagagcgcctcttctcctccaaaggatcgcagctcctcactagcaatggaatgaagcgggatggagaatgactttgacaagttgacaaaagtaggcttcagaagattggtaataacaaacttctctgagctaaaggaggatgttcaaacccattgcaaggaagctaaaaaccttgaaaaaagattagacgaatggctaactagaataaactgtgtagagaagatcttaggtgacctaatggagctgaaaaccatgtcacaagaactacatgacgtatgtacaagcttcagtagccgattcaatcaagtggaagaaagggtaccgattcaaccaagtggaagaaagggtatcagtgattgaagatcaaatgaatgaaatgaagtgagaagagaagttcagagaaaaaagagtaaaaagaaatgaaaaaagcctcaaagaaatatgggactatgtgaaaagaccaaatctgtgtttgattgatgagagaatggaaccaagttcgaaaacactcttcaggatattatccaggagaatttccccaacctagcaaggcaggccaacattcaaattcaggaaatacagagaacaccacaaagatactcctcaagaagagcaaccccaagacacataattgtcagattcaccaaggttgaaatgaaggaaaaaatgttaagggcagccagagagaaaggtcgggttacccacaaagggaagctcatcagactaacaggggatctctcagcagaaattctacaagccagaagagagtgggggccaatattcaacattcttaaagaaaagaattttcaaccccaaatttcatatccagccaaactaagcttcgtaagtgaaggagaaataaaatcctttacagacaagcaaatgctgagagattttgtcaccaccaggcctgccttacaagagctcctgatggaagcactaaacatggaaaggaacaaccggtaccagccactgcaaaaacatgccaaattgtaaagaccattgatgctaggaaggaactgcatcaactaatgagcaaaataaccagctaacgtcataatgacaggatcaaattcacacataacaatattaaccttaaatgtaaatgggctaaatgccccaattaaaagacacagactggcaaattggataaagagtcaagaaccatcagtgtgctgtattcaggaaacccatctcacgtgcagagacacacgtaggctcaaaataaagggatggatgaagatctaccaagcaaatggaaaacagaaaaaagcaggggttgcaatcctagtctctgataaaacagactttaagccaacaaagatcaaaagacaaagaaggccattacataatggtgaagggatcaattcaacaagaagagctaactatcctaaatatatatgcacccaatacaggagcacccagattagtaaagcaagtccttagagacctacaaagagacttagactcacacacaataataatgggagactttaacaccccactgtcaacattagatagatcaatgagacagaaggttaagaaggatatccaggacttgaactcagctctgcaccaagcggacctaatagacatctacagaactctccatcccaaatcaatagaatatacattcttctcagcaccacatcgcacttattccaaaactgaccacataattggaagtaaagcactcctcagcaaatgtaaaagaacagaaatcataacaagctgtctctcagatcacagtgcaatgaaactagaactcaggattaagaaactcactaaaaactgcacaactacatggaaactgaacaaccttctcctgaatgactactgggtaaataacgaaatgaaggcagaaataaagatgttctttgaaaccaatgagaacaaagacacaacataccagaatctctgggacgcatttaagcagtgtgtagagtgaaatttatagcactaaatgcccacaagagaaagcaggaaagatctaaaatcgacaccctaacatcacacttaaagaactagagaagcaaaagcaaacaaattcaaaagctagcagaaggcaagaaataactaaaatcagagcagaaatgaaggaaatagagacacaaaaaacatttaaaaaaatcaatgaatccaggggctggttttttgaaaagatcaacaaaattgatagactgctagcaagactaataaagaagaaaagagagaagaatcaaatagatgcaataaaaaatgataaaggggatatcaccaccgatcccacagaaatacaaactatcatcagagaatactataaacacctctatgcaaataaactagaaaatctaggagaagtggataaattcctcgacacatacacccttccaagactaaaccaggaagaagtcaaatctctgaatagaccaaaaacaggctctgaaattgaggcaataattaatagcctaccaaccaaaaaaagtccaggaccagacggattcacagccgaattctaccagaggtacaaggaggaactggtaccattccttctgaaactattccaatcaatagaaaaagagggaatcttccctaactcattttatgaggccaacctcatcctgataacaaagcctggcagagacacacacacaaaaaagagaattttataccaatatccctgatgaacatccatgcaaatatcctcaataaaatactggcaaacagaatccagcagcacatcaaaaagcttatccaccatgatcaagttggcttcatccctgggatgcaagcctggttcaacatatgcaaatcaataaacgtaatccatcacataaacagaaccaaagacaaaaaccacatgattatcttaatagatgcagaaaaggccttcgataaaattcaacagtgtttcatgctaaaaactctcaataaactaggtattgatgggatgtatatcaaaataataagagctatttatgataaagccacagccaatgtcatactgaatggcaaaaactggaagcattccctttgaaaactggcacaagacagggatgccctctctcaccactcctattcaacatagtgttggaaattaaggccagggcaatcaggcaggagaaagaaataaagtgtattcaattaggaaaagaggaagtcaaattgtccctgttcacagatgacatgattgtatatttagaaaaccccatcatctcagcccaaaatctccttaagctgataagcaacttcagcaaagtctcaggatacaaaatcaatgtgcaaaaatcataagcattcctatacaccaataacagacaaacagagagccaaatcatgagtgaactcccattcacaattgcttcaaagaggataaaatacctaggaatccaacttacaagggctgtgaaggacctcttcaaggagaacgacagaccactgctcaacgagataaaaaaggacacaaacaaatggaagtactttccaagctcatggatgggaagaatcaatatcttcaaaatggccatactgcccaaggtaacttatagattcagtgccatccccatcaagctaccaatgactttcttcacagaactggaaaaaaatactttaaagttaatatggaaccaaaaaagagcccgtattgccaagacaatcctaatcaaaaagaacaaagctggaggtatcacgctacctgacttcaaactatactacaaggctacagtaaccaaaacagcatggtactcgtaccaaaacagagatatagaccaatggaacagaacagagccctcagagataataacacacacatacaaccatctgatctttgacaaacctgacaaaacaagcaatggggaaaggattccctatttaataaatggtgctgggaaaactggctagccatatgtagaaagctgaaactggatcccttccttacatcttatacaaaaattaattcaagatggattaaagacttaaatattagacctaaaaccataaaaaccctagaagaaaacctaggcaataccattcaggacgtaggcatagtcaaggacttcatgtctaaaacaccaaaagcaatggcaacaaaagccaaaattgacaaatgggatccaattaaactaaagagcttctgcacagcaaaagaaactaccatcagagtgaacaggcaacctacagaatgggagaaaatttttgcaatctactcatctgacaaagggctaatattcagaatctacgaagaacttaaacaaatttacaagaaaaaatcaaaccaccccaccaaaaagtgggcaaagtatatgaacagacacttctcaaaagaagacatttatgcagccaacagacacatgaaaaaatgctcatcatcaatggtcatcagagaaatgcaaatcaaaagcacaatgagataccatctcacactagttagaatggcaatcattaaaaagtcaggaaacaacaggtgctggagaggatgtggagaaatagcaacacttttacactgttggtgggagtgtaaactagttcaaccattgtggaagacagtgtggcggttcctcagggatctagtactagaaataccatttgacccagcgatcccattactgggtatataccaaaaggattataaatcatgctattataaagacacatgcacacgtatttttattgcggtactattcacaatagcaaagacttgaaaccaacacaagtgtccatcaatgatagactggataaagaaaatgtgatacatataccccatggaagactatgcagccataaaaaaggattagttcatgtcctttgtagagacatggatgaagctggaaaccatcattctgagcaaattatcacaaggacagaaaaccaaacaccacatgttctcactcataggtgggaattgaacaatgagaacacttggacacacggcggggaacatcacacaccggagccttccgtggggttggaggatggggaagggatagcattaggagaaatacctaatgtaaatgatgaattaatgggtgcagcaaaccaacatggcacatgtatagatatgtaacaaacctgcacgttgtgcacatgtaccctaaaacttaaagtataataaaaaaataaaaaataaaaataaaaaagtggtatataaaaaaaagaaaaaaattttaaggtagttagaggaaaataactcatttcttctaggggaacaataatttgaatgactgtgattttcttatcacaatgaaggccagaaaacagtggaacatctttaaagtgttgaaagaaaagaattgccaacccataaatctatgtccagcaaaaatatccttcaaaaatgaagacaacatgaaaatattctcagatgaaggatagcaaacataatttgttgccagtagacatgctgtaccagaaatgttaaaggaagctcttcagactaaaggaaaatgataccagagggaaacttgaacctcaggaatggagaagcaatagaaatgataaatatctgagtaaatagaaaatacttttttcctcttttgttctttaaaaatagctgttacactagtttcctactgctataacaaattgtataaaatgttaccacacactcaattgcttaaaacaagacaaatttattatcatacagttctagaggtcagaagactaaaatgggttgaaagggctgtgttaccactggatgctctagtggagaatctatttccttgcattgtccagcttctacaggcggcctgaattccactgtttcactgcctgattctattgtcacatctttttctgactcatctgcttccttccttcctttacaaggacgctgtgattacactgggcccacccagatagaactggataatcttcctatctcaatattcttaacataatcacatctgcaaagtcccttttgctatatgaggtaacatattcacaggttccaatatgtagacatctttgaggagccattattcttcccacaacaacaattgtcaaggattcaataattcttatacaatttaaagtgttctagagcttaggaaaatgtagaaatttacctaattctttctctaaggctaacataatgcttatgtccaaacaaagaagaatagaagtaaaaaagtaaacatgagaggtcagtctaacttagaactatagatgtaaatatccaaaatagaatagtagtaaattcaagctagtactgtggcaaaataatagaatagtgcaaatagtcatatttttatgtctatgttatctttgctagattttagcatcgatattatggaagctatgcctggactcaacaacacgaacttctactcaccaaggctgatcttgtactaatactaagtgcccaacctgacaacagagaagatgatgagcctttataagacaccattccttaggggcatcagccagtcccatggtgttaggattattacatgggacacctttcatcatcatgaaaacagaaacttttcctcatggaaatgaatatgtattttagacacacatttaccttctttgctgacaatgattctgtcatcaccatctccatggacttccagaatgccttaatcatcatcagagtatcctacacaaagttgtctctgaccaaggaactcatttaatggtaagtgaagtgcacatccaaagattcactagtctttactacttactttaccatgcagaagcagcttgccttacacaaaaataaataacttactggaagcttagttatgggatcagctgttcctgggagtactgtacgacaagattgcaatagatgctttaacagagccacccatatatggtgctttttttccccatagtgaggttacacaggactaggaataaagaagtcatgaaagcagtggcccttttcactattgcaccagttaacctactgaagaagtatgtgattctttttttctgtctccacaaccttgggctcttaggtatatcagggatgaatgctttcaccagggaataaagccatggttccattatattaaaagctgagactacattctggccatttttgtcctctcgtgccactgaactgacaggcagggaaaggggctgctatagtggctagagggattgagcccaattactaaggggaaataaggttgctgatatacaaacagggagagcaatgctcagagcccagggatactcactggggcacctcctagtactgctttgcctaatagtcctgggaagtgggaaagtgcagaaattcaataaatacaggattgaagattagggtcactacatcagggaaataattttgaccaggtttctgtaaggggaatatgaaatgggtggtagaagaatgaagttgattattgactttggcctcatgatcagcttcagtgggaaactgtaacagctatgcacatctttgttaatttatttttctcttcctttcctctgattatatgaaaaatacttgagataattgttataaatcaggtttcaggtgggcgaatatgattgaattagcattatcccgtgacagtacggtggctgatgggattttttttgtccctgcctccctgttgggagaatagaataacaagaatagatgctgaatgtgaaaggagtgggccatggtggttagtctttattttcccacacatcctgattcatttcctgtccttctctgtcttgttctatgccctgggcggctgatccttagggactgcatcccccagactccatttgtaattgacttctgcttgggtttggtcaatggaatgccctggcacagctttggagggaagaagagagaagacaatgtatttcttcactgctcccactctgatttgggctatgttttattggcagggactgcatcccttcaagattttagcttcttccagaagtcccctcctccatgactctagctctcactaggctccagaaatactatttcttcctcttgccctcttaggcctagggtaacagctacctgctattgctaacctctgggtgccacaaaattgcttgttgggtctcataatcttgcatatacctctgtaagtagtccctacattaaagtcccttgaaccatc

SEQ ID NO: 111 - DNA, 194457 bp, Homo sapiens
tcctagctctgagaatgcctgcggaatgatcgccccccagggcggctgccgccgctgccgctgctgctgttattgctactgctgctgccgccgcctctgcttccactcggctctgactggcaggcagaaagtgcaactgacgagggaaaggtctctgcagtgagtggagagcctacataaaagagagtaaagaggggcaaaaacccagatcagaatgcaggcgacgtccaaccttctcaacctcctgctgctgtctttgtttgccggattagatccttccaaggtatgaacaatattttgagtcttgtttgaaataaatgtgcaatatgtaacaaacctaacagaaatgcaaataaatatgtcaaaaacgggacgagagacagctctttcagctaccttatggtgtctggcgtatccccactgcttggaacataacaaggtgaactaccggaggaatagctcctcaaggtagagtcctactgcgcggggggagggactaggagaaaatataatgtgcatgggcagcgggcaatgcggctctccggggaatttagcttattccgtgtccaactgcttaatgctctcttttgaagtcggacgggtaatgcaaaggagtttgcagtagaaacaatgcaatttataaacatgtattaggacatggtgaaccgtttctttgttgaaagcagggaagcgttttccagctgatcctggtcaataatactcccatcgcagacgtgctgcggtttgtgtccaaaacatttgggatgctgcttgtaaaacacatggcagagcagcagagctatactctctgccatggctgagaggcgttggtgaaaggagcttgtgtttgtttcttccttttcattaagaaaattagggggcactgaggaagttctgattatcagtgttaagaaacaggaagtgagaaccttaacaaactaaggagggcaataggaaggatgagttaactcatagacgttgaactctgaaaattatctagtactggcaatgaaagtgaacgctaaactcctttgataaaaagacaggaaaatatggacaaatattttcaacgatgtctgagaaaagtcttgatgacaaagtgagataatttgaaagcttcagccttctaagaaaatcataatgacagggaataagagataagccacctggtgaaaaagagtaagagatacaatttattattttacttatttaactggccaacagcaatttgacaatataggaagaatgattccatgctataaaactaatacaagctatattttggaatattataaagttatttttaaagctttacatcatgtgtgtagtgtagacaaattaagtttcctttcattactgaatagaactaagatgtaaccaagcataatttaatactgtggttgtgatatttgtaggcctaatatagtatacagttaaaacttagaatcatgtcgtatatatttgtaattatttctgtactctttcatatttagaaggacctgatgagaataaattcattttattttaaagctttgattgtactggtattattgatgtaaacgcttcactctgtgtgaatgtcatcttaataatcttaaaggcatattttatatactaaggtgtagctttaaagcattttacacttaggaaaaagtgttgattttgtttttatatttaattttttttcttcttgactctgcaccctgtagtgacacattctatccactgccactctttttatatgatattgtttaaaacttttgaatacattccatatgatttgggaatattcttggtaaaacattttctaaaagcaaagttaatcactaagttactgcagaaaaagtcacttgacttaaagtgagttttatttgtttttctttaaaataaattcagaaatgtagagcttcattaacaattttgtgtgtgatttgatttgtctgttatctttgatgcataaatatcttcactgcttgcacccctttctttccaaaattaaatatgtagataattttctgttaaatatgaagacatttttaaaataagcaatgcatctttggtcaatataatcttttctagttttggtgagtttatttgtgtgtattcaatgctacaaaactttttactttcttcagaatgagctgtggatatttgctacaaatgagctgaaaaatccagggaaggcatacattaacttttcaaactgtccttctcagcttccacatactgcaatacagtgtgcaaagaacaaaagatgatttttttaaaagacgatatttgttctatatcatagacattacagagaatattaaaactttcaaaacaagtaattttaatgttgtaaaaagttttaggacttttagacaaaacattgctttaaaaaatgaagagaagctacttttgtattaatattatatatttatatttatataatatatatttatattgctcccccccaaaaaattacagatggcaccattgtgtcctcaaaagaattgtcaattaggttataaactaagaattttgtaaaattttatttttcattctactagttacttaagggcttagattttaaaagtcaggattcataaagcaaattatatatggtgaaattaaaattaaaaatccaataatatagtactacaaaaaatacagtttttggacaaataagaaataatttgtgataacacttaaatgaacagaaatgctaaccaactgcctttttgcatactaatacatttggagtgatatgggtcatcatcaaattttcaaataattttaagtattattctatattgttatactttgtttattttatatatgtatataatatatatacctcacatggataaacagaaactggcaaaatgggaaagctcttaaaattgaatagattttttttaggtataggattttacatatatcaaatactggaaatctacatcttagaaagtacttcttatatattagtttacctgaagacaactgggttttctaacaacagtgccaattctatttcatggaagactatataatgtttacatttataatgcggtgtgtgtcttttttttttttttctgtcgctgaagcttacaggtcttatatggcattttataaagtgcttaagtatcgccatcttatggtaagataagttacttgaaagtcagtattgttttcaggtttttaaaaatggccaagattcattgttcatagactgagcttagtttcagcatgtacttagtttcttttctctcatttactgtatcaaaaaattggcaagattggtattcttttccaacaaaggaaggcaatccacactaattaattatttgtatttttatagggacagatgatcaatttttcttttaggaaatttgtttgaaatactttctattaattaaagtataattagtaagtttccagttctttttagaaaaactcagatgtatatcactgcctattttaagagatgtcaattaatttcatttgtaatggagtgtttgaattatagacgacatgccaaatcatcattctgtaagcaaaatttcaaacaccgaaagcctgtaggaattcaattattgctcaattttatagggaaagaactatttctgtgtagggaatttctgagggcggctgctagatggcatctctgtgcttttaaactgaaggcattgatttcagtaatgaccttgatggtagaagagtggacttctttctgttgcaggaagatttttagcggaccattatttgaacattgtaacaaaacagtaatccctgtgaatcagaaccatgaatttctctgctctgaactataaagataggaggatataaatatgactgagcaggtttcaaacacaacattgacactggagccagctacatatttggggaacagttaaaaagaggtgacatggccatatctgcacaccattgtgactgctaaactttagatgagtcatacttgtctcataaatatatcagaaaatgccctatcaggggaaccgtgctgagtttgaggaaacatttactgtcttcttatgtagaaatatgttaaacttatcttcatgatactttctcacactacagacataaaatataacaatgattcagcaataatctccatcaccaaactgtggtttctgtccaaggcaacccaggcaattagatctcttgccctaaataacataattgctttaaagccctataggcatgataagcagtaggaatattttaataattatattgttgaatgtttcataatgtaatataccataacaattttgatattgctaaagaaaataatcagacttaaactgcctaagtgtagctttcatacataaatctaattaaagttcttgttcttactatttttaaatgaaactgagaaaaagccaaaaaaaaaaaagcaagagaaataaactgagattactacttgctttaaaattcgccttaaaaatctgtcttttcctgtttctctcgtgcgctagagacatcctcttcataacaggatcaactcaaattagaacagaaaatatggattgatgacatttggcaaggacctgtaattatgcaccagtaaaccctgatgtggcaaaaactgaagagttcaaggcagcctgtctatgttttgatggagcaaatagcttcctggtctcatcttttctcatcttccttaacctaattaaacttttattgtggaagaagtaaatattctttctcactctttctcttggcaactagaaacagttaaatggtatcacctttcttcatttttcttttaaaattcttactgcttatagctttgcaactattctctttacaaagtggcaattgtgatgattgatgctctgttgggagggaaagcagcacaagtgggagaaacagaggattcaaggtccttcatttctagaccctacctcttctattgatgatatacatagatgtgactttggggaagctgtgattttcatgcccatacctatagaatgaggagcctagatgttctgaaaactttgttaaactctagaatgaatttttaataatatttgaccatttatcaaaaattaaccaattcttttgtagggtctagttagtaatatcataaactttgtgagacctgaggacaagcttccttggatagtatcatgcagttttcatcttctcggttttgcctttaaagctttcaattttctactttccacctcaccactctgcttccctccctgtattcatatacacaatccatatactcaggcttcaatccattcacctatcaaacattgctcccctgaagagatcattcattaatctagtatgtctgaaaaccaacacgtttcctacttcagccataagtattttatttaactgaaagtcatctagggaaatgtaaagtaaaaacttgttttccatatgaaaagaattactggatgtattaaagagatgtgaaaggttatttgggaaggctacatataaaacgtagcacatattctgttactgactcttctaggcagacacatccttgaggattttagactggcaattatttttaaagcttcaatttttgtactaagaaaatgtataaagaaaaaagcgagactggataaaccttcagctaagaaactaagactttgcatctgatttacttaagtattaattaaacatcaatttacttaaaagcacaaaacacaacttaattggcagtagtgaaactggggaaagatacaaaaccagactgttgtcttggtaggttatgtgaaattaattacagtgaatcactgggattatctgtacatttccatatatctgagtgatattacttcctgatagcattcaagtattaggacaacatcaaagctctgtaaacactcattaccctggtttaaatctacaatatgatgttgaaatggtggtccttgaacattttagttcacctaacactggtcattaatctactcagtctatgcccacttaccaatcaaaaaccacgaagtatatatatatatatatatatatattttttttttttttttttttttttttttactttttgacagagtctcgctctgtcgcccaggctggagtgcagtggcacaatctcggctcactgcaagctctgcctcctgggttcacgccattctcctgcctcagcctcctgagcatcttgggaccacaggcgcctgctaccatgcctggctaattttttgtatttttagtagagacggggtctcactgtgttagccaggatggtctcgatctcctgacctcgtgatctgccgcctcagcctcccaaagtgctgggattacaggcgtgagccaccgcgcccggccaccatgaactatatttttaacgaaactaatgctattatgacaatattttaaatacacttttaaattttgtacttccaaatcagtgtaaaaacagaagctggacatgaaataagaagtggctttcagctctaacagtacaacttttccgtagtgagttaacatgtctgaagctcagttttcataacaatgaaataatataacagcaatggagcttatacaattatttatgatattaatacatgtgaaaacatattttaaaccataaaatttagtgcaaatattccacttacatcaatcaacctataaccaaatctaaagtctattgcggaccatatattaaggactcctaataataaaaaaggcttatcacgttccttcactcttgctgtttcctcttctcagctttgtgaaaaatgaatattgtataaagttatcagcatagcttctcaaaaccagcccatcattttggtcaaagctccaatttaaacttgtcaccttacaagtttacatcataattatatccaaaaaggcatattttacaagtttcttaggaaaaaatgtaaaacacgaagagtggcttcataatatcaaagcccaactgcatcaagaaaagaacttttaaactaatcatggagaagagatcacataggggaaagatatatttaaacaaagaatctaccaacagataaaactgttttttatggccagtgtgcaaagtatggacttcttatgtcttcacaaactatgataatgagaaagtagtttacattcttttgaagattcaaaaataatattaaggagggaaggtcagaaaagggattttctcaagttactcaatcaaggcagagggtcatggagaaaagaccgcatttaggaatataatttctctactgtttcccttggattgctctctgtccctctgcttatattgatcttcttgctcttctcagtagagacttctaaagagtttttcaaaagaccttgaccctcaattagctattgtaatatttctgctgatgttactcatccagtagcaaatccacctcagtagctcatgagttaattttttttcttttctatactcaacatgcaaataatatgaagggtaaaaaaaaatacaaaaggaaatatgtaatatctagaatagaccccactcacgaacaactattattttaaaaatgtttaaaaatacttacacaccataccataatgaggtttaatttatctctgttactttctataagaggttgcagattatttgggggaatctaaaatacagaaatagcataagaccatctctatctacagtgccaggtaatttcaatggcaacattcaaaaatgttgctgaaataataaaaaattgatttttccaagaacattgattcttttttgctttaaaaacaaggtgttgtaaagcatgtatcacagagctatgccttctgttattttcataccaagccttcagaagtataaaaataagtttagagagaagattgcagatgctgttgtattcatggttttgcctctccctggaaagcttttttccctcttctccatatgtcaaaattttacctatattttaggatgcaactcaagtacaactttttccacaaattcttccctgacattccttgcaccccaagagtggataatcctgataaactaagaacccctagaataaaataatgatgttttatttatatttgtatctttagctacaggtactgtgtctgatgcagaatagttgttcatgaacaaaagttgaattggatttcctccctaccccaaatttgcaaaacaattcctaatcactcttttctttttgaaatagtatttagtgtacacatgcttttcttactttattagtagttattttattgtatctctcttactaaattgtaatgtattcatttattgtattttatcccttctaataaattataagggcaggttcagtgctttgggcactatcctattctttcctatctagcagctagcacagtgtcttattgatataagatatttaataagtattttttgcatgaaaaaatgaatatatgaagaatacataagtcaaggaacacctaataaacttgaaatcctgggttaaatgattcatgaatataatctatgtttttgatccatttttccatcagacaagatactgaggcagtgaagtaagactgagtttaagaacctttaaagacttagaactcttatgccaggttacttatcttgacttacgccaaaaatcagctttccttaaatttcttgttaatttcctgcacaccccactatcctcagtgctatttttgacttgtagtagctctctaggttgctgcaacttcaatactcctgtgaattatctgtgtttcatgatgcttggtggcaaagttagtatatcctcttagtgtccatttcatttgcatggacttataagtccaaacatttcattaatgtgtacatgttgttttgactacttttattgtatgtaatgtcttagctttatttgataaattcatatattacctatatttttccaactctttttaaaagctgacctttttttaagtatctaaaggttctgtttaaattattatcttagtatatacacttataatggtactgtgccatataaagaaaagccatattgcctccatttttctactacattattccaagaacatagcaccaccatcaagaataatttttaataattaaaaacaaatataagtatagtggagtcagattcattggattttaacttctaaatagtatcagaaattaaatattttgtatgattaactttgtaggttaaaatgctctggaaaaaatgtcagtaataaagttgcttaaatattacaaataaacagacatctatataaccccaaagggaggacataaattgaatagacaagcctattaatttttccaactaagttgaagatgattaagaagaattgccccttgatgatttaaataatattactagagggaccaattccagatggcaagatttcttcaaatagagaatcagtactggaaatgttgattaactagcaccaaaatgtcactggtaaaatatgacttacaaaagatgccatctcttctgggagtgatctacatttacggctgcatcgggaattatttatctggaatcaggaccaacagtcattatttttacatgtacgtaagttttgtgtcataatgaaatcttcatacatatcactgtagtaaaaacaaactgaaatattatttggctcaagactctctaaagacctcttattatacttattatttatagatgctacagatatattctactctttataagttgggtactagaaacagagaataaaatgactttcatttgattgatcttaaagtactcaaggactatgcagaaggaaatgtaaaaagagtaatgcgaagcttacgctgaagagatagctattgtaatataatgaccccaaactgagcagaagacatttgagggtaatgaatcaagtgaatggaattaattcattgtttattcattgcaaccctcattgatgccaaagcttcatgacctctttgtcggtcaaatcaaggtaagactccatatctaaatatttgttctaaaacaaaaataaaataagactttgataaaattacaaatgagtttatatgtagcatggaggtgagcacattcaaatacagttaaaagaaaaacagtgaggaaagctatttgtttacgtatcagggatggtttaagttgttacagatgatgattcatttgtcaatatgtatttaaatatttcagttaactttattgcttcctacatcccccaacccctacacagagaatgattatattaattaatatgagacctagttacccttctattactgctggtattcaactttggaacaagatcttcttagttcaactaatcttaatacttcttagaaagaataaatagaagaaaggaaaaggcaagaaaacatcattaagctcctttttctttccctacttacgtcttaactttgcagagaaagaagaaacaagcttgactgcattttgtctatttgtacataatgatattggaaaagatcttatttccctctcaagcgactcaacctaaataatattaatttagcatacaaaatggagattaaggaaaagagaaatcataccaaatcagagaaaatcatatactaaataggatattgaaaagttgatagtattgtggacagagtaccaaattaggagttagaaaagcagggaacttacaactgctctgtaattatctagttgtatggccctgggcaagtcagtaaagttttgtgatttccatttcctcatgtacaagatgagtatgttgaaccaccaaatgctcttatacttttggtaggtcatcctgaaatggggcacatcaatctctcaaaaatgtagttcaggccgggctcagtggctcactcctgtaatcccagcactttgggaggccgaggcgggcggatcacgaggtcagggatcgagaccatcctggctaacactgtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggggacagagcgagactctgtgtcaaaaaaaaaaaaaaaaaatgtagttcatcattttttcattctttttacttctgctcatagcctctcaaattggttaagttaaaggtaaaaatgtatattgctttcattttgctgaaaattagaattaaagtcttggagaaaaatcactgcaattcattgtatacatatagtgacacacacacaaaattaagtacaaaaatatataagcttatttcacatcccaagcactatggcttatttaagatttattctgtatcttcccttccattagtttttgcaaatttaattgaaagataaatgagtaaattaccttttgtttctactgtctttatcttatgaaagttaaagcaaaagagatggctaaaattataagaaaatagagagaacctctatttcaaatctataacagagctgatggatggttatctagcttctgtctatatgtttccgatagtggggagtagaacagtattcaagaaattgggtttacttttaatcagaaataattatgagaaagtttctttttatattgagttacaccttctaatgatatttactgctgctgtgttatggttttttggcaaaatataataaaaattgtatattgactgtggtagacaaaataatatccttccaaagatgtctgctttctaattcgcaaaacctgtgcatatgttaacttacatgaccaaacggaatttgtagatgtgactaaagtaaggatcttgagataagaatatgatcctggatgttctgggtaggctcagtataatcaaaatggtccttttaagaggaaggctggaggcccagaatcagaaaaagaagcaaggatgacaaaagcagagattggggagatgcacttttaaaatggggaaaggatgcacaagccaacatatgcaggctgcctctagaagctggaaagccaaaagaaatggatgcttccagagaccctttagaaaggaatgcagccctgctgacagtttgattttaagctcctaagactcttcaggtttttgtctgccagaactgtaataaatttgtgttgttctaaaccattaggtttgtggtaatttgttacagcaacaatagaaactaatacattggcttatatatattagtaataattggtaattaccttattaatgtgtacaaacaaacataatcagccaaataatgctaaagtctatgcttgtgaatatgaaaattagaaagaccatagacataaattacagtgtggtctaaatattataaaagaagatagataatatagaaatgaaaaattgcagccggccacagtggctcaagcctgtaatcccagcactttgggaggcctaggtgggtggatcacctgaggtcaggagtttgagaccagcctagccaacatggtgaaaccccgtctctactaaaaatacaaaaaaattagctgggcatggcggcagacgcctgtagttccagctacttgggatgctgaggcaggagaattgctagaaccctgggatgcggaggtgcagtgagccaagatggcgcctctgcactctagtctgggcgacagagcactgcttattgaagaaggctttcaaaggattacacacagccctaactgaattacatgataagtttaggttttccctggttgacatttataatataaaaaataaatcattttgttgttaggtaaaaatctgcccataaaatctcacctgcaatttaagaactttttttttttttttttttttgagacagagtcttgcgtttgtccttttgttgcccaggctagagtgcagtggtgtcatcttggctcactgcaacctctgcctcccaggctcagacgattctgggcctcagcctcccaagtagctggcattacaagtgtgtggcaccacgctcagctaatttttgtagagctgcggttttgccatgttgcccaggctggcctcaactcctgacctcaagtgatctgcccactttggcctcccatggtgctgggattacaggtgtgagccgcaggctacccgtgattcaatacaatgatgactatgattcaattttttccttctccatcgctgtcatcagtcaaaacgtgagctaccaaaggcaatggcaagtcttccaatgaaagcaattttgtttagaaaaccaatgcatatttcatatagaacagacaaataaatgatgattgcttagtgacacagggtttcctctttcatgtgcaattgagaaaaaaatgtgttgtatagtttgcttatttaattgcaaataattgagaattgcttttaggtttaagaaaatgtataaagaaaattattaaagaagaatataattagttcagatatttaagattctcagagttctaaattatcacatgggataggctggactattggcatttatgtggtaactactttttcaataaatacttacagctggcactagtttaggagttggacataaaacatgtttataaagatacagtttctacccttctaaagtgcttaacattttttactggaggacccaaagatatttattaataattatagtactggatgacatgtcccatggcagaaacctgtataagacacaaggagagaatgtggcagggttgagagtgggggacctatagcagaatggaggataagagagagttccctggggacaggaatccttaaagaaaggttaactagacaatgaagaatgaaaagatattccagtaaatggcaacagcatgtatgaagtcaaagagatgtacaagcctgtgaagcactgaagagctactgaagagcttttttacatgacttgagtttttcttatccttaattatgtgagatgcaaagaggctgatgaagatgtaaaagaaagagagccactggtggtattaaaatgataaaaatataattatccaaatatttcaggacttaacctgtaccagattaaaaatatttctggaatttagttatcttaactccaaacaaggtgaaagatcgaatttaaaaaacatacaatttagttgtactattcgaggttctcctgagaaacaaccaatatataaattgtgtgtgtgtgtgtgtgtaaaaacaaagaaagacagagacagagagtgagactcattataagaaattggctcacatgattttgtaggcggataagtcccagatcttcatttagcaagctggacaccaaggagagggtatagttctggtcaggtattctggaggatgaagaaccaggaagagccaatgttccagctcaagtatgaatgcaggaaaaaagggatagccaagctcaaaagcagtcaggaaggtgcagttctcttctgctcaggcttattgttctatgcaggcctgcaccagattggaagaggcccacacacattagggaagttactttactcagcctaccaattcaaattttaatctcctttggaagcaacttcacgtatgcatgcaaaatattcgttgttcaaatatctgggaactccatagcctggtcaagttaacacataaaattaaccatcacagtagtaatacattttaaaaaaatctaagtgtctctatattctctatctttatattcctatctctgtctgtgtttacctacctagctagctatggatgatctatttattttaatcatctaaacaaaaattactaagaagaatcccaattcatatcttacctcaaggtctccatgatttcattgtgattgtctctgcttgttgaaattatgctgattggaccctatgataatcataagtggagattctttgcactgtagattgcatcaccatcgccacacatgcatattaatcaattatttaaatttgtataaattcttttataataagtctgttgttggggaggtttcccccaaataaagaatcttctactatagatgactctggcttgattaaactggccttcaatttagcataacctaaaacattttagtcattttgatttcagattctaatgaccagtgttttttcaatgtttattcatcttgggctaaaagtaattcttttattcatatctttcttatttttccatttctttccttccttcttccctttcctgcttccttcctttattccttcttcatattctttctttcattattttactcattctataaataaaataaaactccatcctaatgctaaaattgaggcaaaagttcaaatcatgtgtaatgggttggtatgttgacattagctaacagggaaataattcccaaaattttcccaactggaagggaatatgtttcttaagatgggaaattttggtagatgagagagaagatcaggagtttgattttgaacatgtaagtaagtttgaaatgtttatgagacatccaagtggaattgtagagtaggcagctgttatttgaagttcaggggagatgtctgaactgcatatatcattttgagaatcactagtgtgcagacggtatttaagcccatgaaactggagaattctgaggagttttgctgtaaaagaaatgagaaataaagtatacctagaggagaatatggcatcagacatgtttgtttttgttaatgtctaaaatggaagaaataacactctactatgatgctgattggaatgatacatgagagatttgttttaaaatgggaatgcagagacttcctttagaacaggtgggaagacaaagtatatgatacaaatgctgttggaagttcagctaagagagtgtgtgagtgcatggaagcttccttgtagttgctttcattttctcggtgaaataggaagcatggtcagcagctgagagggaggatgacttatgtgtagggagaagaaaagaataatgtcctgaaaactgcaattagcagcaaggaggacagcttttcacactgccaggctcacagtgacagagaagtgtggcaaagggcttgagaattctttcggggcagctgagtgttcagagaagaatcagatttcagtaaaagttaaaaggtgaaaaacattttcagagaaatgagcagacatgaggaaatgtcactaatgattgattgtgagttcctcacttgttgcagtctggactaaatcgataatgaatctttcatatacattgaaagacaagcctgagttttccccaggaactagttattttttttcactgaccctatgaaaaggtttagttagcccagttctcttctgatgtggaaaatgcacaaagccataaactagttggagggcattcgacacaaattataatagaaagtgggaggatgtatcactcccttccctctcactctgggccatatttaccctaggtggttgtgttagtccattctcacactgtgatgaagaaagacccaagactgaataatttataaaggaaataggttgaattgactcacagttccgcattgctggggaggcctcagaaaacttacaatcatggcagaaggcaaaggagaggtgggcacctttttcacagggtggcaggacagaatgactgcaagcaggagaaatgccagatgcttataaaaccatcaaatctcatgagaactcactcactatcatgaaaacaccatggaggacaccacccccatgatccagtcacctccactttgtcccacccttgacacatggagattatggggattacaatttgaggtgagattttagtgcagacagagccaaaccatatcattccaccccggcccctcccaaatctcatgtcttttcatatttcaaaaccaatcatgccttcccgacagtcccccaaagtcttaactcattcaggcattaactcaaaagtccacagtccaacgtctcatctgatacaaggcaagtcccttctgcctatgagaataaaaatcaaaagcaagttagttactagatacaatgagagtacaggcattggataaattctcccattccaaatgggaaaaattggcccaaacaatgggcctacaggccctacccaactctgaaatccaaagggcagtcattaaaccttaagcttccaaaataatctcctttgactccctgtctcacatccaggtcatgctgatgcaaaagatgggctcccatggccttgggaagctccacccctgtggctttgcagggtacagcctcactcccagctgctttcatgggctggcattgagtgcctgcagcttttccaggtgcacagtacaagccgttgggggatctaccattctgggggctggaggatggtggccctcttctcacagctccacaaggtagtgccccagtagagactctgtgtcgggctgcaaccccacatttcccttctgtaccgccctagcagaggttttccatgagggttccactcctgcagcaaacttctgcctggacatccaggcatttccatacattctctgaaatcattccacattgctgggtaagcctcaggaaacttacagtcatggtggaaggcaaagaagaagcaggcacctttttcacaaggcagcaggatgaagttagtgaaagcaggggaaataccagatgcttataaaaccatcagatctcatgagaactcatccactatcacgagaacagcatgggagaaaccgcccccatgatccaattacctccaccttgtcccacccttgaaacgtggggattataggaattacaattcgaggtgagatttaggtggggacacagagccaaaccatatcggtggtcatattttactcaagggaaaactcatccattgagtgttagaggtggatatgatataactatgaaagaagggcagagtagacagcaggtgggactgtaagttttaacaatatttagtcaaaactccacactgaaaattcccttggaacatctttaaagcaatgtaaaaattaacccatgtctaagagaatgtattatttctgcatgcccccccacaagacatacagaagaatagggttcacttttgttccttccaaaaattctaagaccaaaaataaaatttaatttcaatatactacgttaatggaaataaacttgttatttgttatatttagcaatttatttctgctctagcatatgcctaaggagacagggatcacatatggctcttaatctattatacaatgtctaattatccaacaaacatagaggaagaaaaatgttaactttagtattatgtgactaaagcaagaaaaaaaaagacctatgtgacattcttcccatttcccttgctatgggatgatataatagaatgaaaggagcgcataaagtactgcaatgttgttgagctacaaatctgaaaatgaaaaaattaaagcgcctgtctgtgtgagcatatatatgtttggtgtaaaagagcaagagtttgatctggttactactaaagagtgaaacctcaatgatcaaaactaattacattaattctagaaaaagtaagtgaatggcataaattacataattttttaaatgcactttattatttctaaattacataataacctaagataattctacaaattttatttgagctgttgtcttaaacagattcttaaaactaattgaaaaactgaatgagaagactttcaaattatcctatcaattaaataaacataacaatttaaaattattttttcatataatttaaagtcctactgaaaatttcatttactctaagaacgctcataccttttcttttccgtatcttatctttaatctttgtgggaattattatatggttcaaatgatgcaaaatcataataaataacttcttgtttgaaattgcaataaacaacttgtctcacttgaagcatgttacttctctccaaatcacacatttctccataatacaattgggaaaataatacctccctcaagggactacataaacatgaaatcacataacattttgaacagaatccactgcctggcatttagtaaatgctagataaactaacttatttttcagtagattagtcttcaaaaaatattgctcatgctatatgttctaccttgtaactaatgtactaatctataacctgatgctacttattcagttcatcttactcaactttacatgattccagtatatgttatgagaaagaaacaaagtataaacatattatttttcataaactctctacctgttcctaatccctcttcataaagtttaatgttttcaggttaatttatgaagcaatggtgttaaagtgtttatgttcatgggacaaaaagagaaaaaagaaaccacaaagacccttctaaacataaaaggctatatttgatggaataaatcttggccacaattattaaaaaaaaatagcaaccattgatttgccatgagagttgactaaagagaggtgaaaggacgccattttaaatattctgtctttactcacttacagatcatctctgttcttttcaacatcacttctggtattaaaaattcttttgcataaagtaggatagaattgaactaactagtgatccttagtgtccctcccagttctgaaatgtattttaatccaacaaatctttgccgagcacatgttcagttcaggtctcccagatgctgtgattctagtttgttccaattctctacgctctttttgtactcatgagccatttggtatttattcataatcacagttagtactgaaggaaaagagaaatacaaacagatctaaatttgactttttgttctaactcttaaacaaggtagaatatctccaaaaactcaaaaattaatttaaaatgaccattttaataatcatgtgaaaagtttctccaactgctatggggaaaatgttttgaatgagaaagtgttgattgtaatctccaaattcattttatttaattacaaatgcttttatactcttccattttaataaaagatgttaattctacctttgaaaaattggtaagactcatagtttgtataactactactgagatttccagagggtaaaatttctagtttactatcacctaatttttattgaaagcattgtttagggcaaattattcagaaaaggttttaaatattgaagttgtccatgagctagggggatatacactcccataactcaccttcccactttgtatcacttctagtaaaatataccttactatcaaaccaagtacatctattaatgtatgtgttaagaattttgagattcttagagtaatttagattcttagaagggaagaaaagaaaagttatctttcttggagtccagcatatggtaaagacttcaaattacttttctaatttacagaatataccataagtggttaaaaactcatgatatggagatgaacttttttgagcatctacttattagcagtagaatcttgagaaattataaacttctacaagcctcagtttacttatatacaaatttagggaaaagatgaagccggacttataagattattgtgggaagtacatgacataatagtttctgtcggtatctaaaacacagcaagacagaaacaaccaaaaacactaataccaattatagcctgatagctaattctattattgtattagtatttgtatccgtgtgtaattgtctctttttagggtaccaattatgtaagtcctctccatttgatgaaaaaggcatggatgcagctaaaaatcagcaatagtctgtccagtctcgggcagctgtccagggaccagatggtcactacagtctacctggatacaatgcagttcagctactgataataccaggtcagagttccttacatgggatttaaacacaaaatggagtaatttaaaattatttaatcagacagagcgaagctcagtctcaaaaaaaattatttaatcatatatttggtaaatttactctaaaataataacaaaaatacccacacatcaccaattgcaaattgactgtatcgttttggagtgttttggagactttcatgtcttaatcttaggttcttttgtattctgtccttattaattattcaaagagcttaaaatctcctattagaatttaataatgtccacttaagtatagctaggcttttgttaacttgcagaaaatccttaaaagttggctgtttttttcttccatcgtttctttcttactttgcttttctttcgtgctctttctttgatttttgcatattctttgtttccctgatcttttcaactctctgtgtgtgggtattacgctgcgttgctccctgtgtctcctgaatattctttcctcaagatagtagcctctgtgcaatgggctaacattctgctaccttccccttacttctgctatctcttttgataactctgagctgtgtggaaatagcaatctctgccgaaatcattgtactccttgttgtgttgcaagcattaataataatacctttctgtgacagtggtcacttgtagtttcaaatgacattttgctggctgcaataagactatttttatcctcaagaaaacattgatattttggcagaaaagactggctgtaagtcagctgccaaaaaaccctgttcctttaaaagaatacagccaactatttcttatgttttgaagatttctctacccgccgcaaaaaaaggatatattttaaaaactgaaaacctttgttttaatgttttactattcattatctaatgtccacaggatgttgttacgtttccatagaagtaaaagcatcagcatacagataataaacttaatttcatttctaaaactaaatgcatgtgtgtgatttagccagatatttactttctatccatgagactatgtaggtgtgttactgtgtcactttaagtgttaatataaatgttttctgacaatatccgcaccactgtacccaaacagcaattgtttacctgggagaaatctagatatagagttaatttcagataattgaaataatttgcttcctgtggagcagggataattatatgatttactttcatctgtaaagcacatgcctccacagaccatgaactgatgagtttatattggcttctcattgttgaattaaagtcgtaatcaactcagaagacaaatgccatggtaaaggtgactgagaaacagtttttctgacatctcttttatgaaagatggaataaagaaccctgaagaacaacaacaaaaaaaatgtttcacattcccaatttaacctgcacctttttctagagaacatggctcagaaatgtatcaggaacaatccctactacatggggcttatactgtagttgtgaacccaggaccaaacaaaaaagtagataagcaaatgtcaaaactatctagtatttgcaagctgtctgccacaagcccggttcagagcacaggcatcagttggttgtagggttatgtagcattagtagaccctgtcagaactaggttaaagcagtgcttttttcaagaaacccagcagaagcacaacaatacattgagaggacactatgggtccttataacctggataagaggaagtttatagcatcttcacagtgacataaaattatgaaagaagagccaccgttacaatgtctaaaactaaaaagtgagggtaaaactggtccaattaaggtatcaggatctttaaggcactcctttagtaactatgaaattattgatctgaggaatgatataaagatatttacagcctagttagcctactaaaaataattagcaatcagcaggttgatgtcaaacaatatactttgtgtggaaatactcaaaaccctagaaaatccatttaccctctcatgcgctaatttcttccacagacacgaatgtgtaaagtgctagtcattggcaaaaaacaaagcattaaacatagacccaatagtgggtgaaaatagttgttaaatttgtcattttttttttttagcatccaccgtgatccagccactaaattttttgttagtgttatctacgagttagggaaatgagaaaagctaactactggagagtcaataacaaccttgtatatatgcattgtaaatggggtcttgaagctaatcaaattaaaaaaaaaaggcaaatgaaccaaagtcctcagactgtaataatcttttttaagggtggatggtctaagctatattatttcaaaatccttgggaaaacagtgaaagaaagcaagtttatttttcctctgctctttttatcaaaactgccaataatcagaaattggctttagaaaaaaatgaaaaattccacataaaatccttcagtctgtgacctcatctctctttcttgtccttcttgatactttctactataggcctattaaaactaccattcccacatctgtgcctttggagtcttcattcctttgctttacaatatttattttgcctggaagaccaattgttctactctttaactctcaaagcctactgatttttcatggtttcactcaactatttcttcttcccccaggcagaattggcttttctttccatggcctctatgaaggttaattttaagtaccactttgaccggacagacagatacttagatagctggcaaaacattatttctaggtatgtttgtgaatatttttccagaaaagtttaatatttaaatcagtaaactcagtagacaaaacctaccctggacaacgcgagtgagcctcgtccaatcccttgaggccccagaagaataaaaaaagaggaagggtgcatttactctctcttcagttggaacatctatgctctcctgcctcagacattggacatggaatctcctggttctcaggcctttggcctccatggttacaccagcaccccacctggttcgcaggccatcagtctcagactaaattacagcactgggtttcctatttctccactgcagacggcatgccttggggatttgggcttctataattatatgagccagttcccataaacaatcacttctcatatatctatatatacctattggttctgtttttctgaagaccctaatacagccccatagcactatatttttattttttctaaaacatttaaacagcctatttttttagagtcatttatgtaggtatccaattctctcatgaacgcctcaaggccagaaattcaatccattttatttttgccattgccgcagaggaggcacactgtagctagtcaataagtggttgtggaaggaattgagactgatagatctataaacccactttctgtggtacatgcagtctatattcaatattccgtgcagcttactccacaagtgagaggagggtctaagcttttgagcatagggatggttttagaaaataattacatttaaaaagcaaaatggagacctgttgagaataaataaagtcttgtttcttatagttgtgaatcttttatatcaagacttcacctgaaaaactgctagattgtgcttcaaagcactgtaagttctagccctgggtctataatgttatctaagatatttatcatcattgagttctctggactcaatgttcttatccgaaaattgaaggagttagatataatcatttttaaaatgttttccaaaccaacatcctaaagtctactctcgagaattagccaatgaaagataacagacatttcagccagacaagataatcaactggaaagtactattgatcaagtagtagaaagggatgcatttttaatattatgatcaatgcactaattttcagtttttgccactgaaatgtatgaaaaatagcagaactgacagcattatgataaagacattcagtattcacaaagggataatttctactataaagtgagatttttaatatccttctggaaatatcacaagactattccctaatgggacagaaacattcaatctgctcaaggagcagtaggtgccacattatcattactttcacaaaggaagatgaaagcagtaaaatcaaacatcaaagacttgaaagaaattgaacataaactttaaaaaatattagttatgccacagatatatatgtacaaaggtgaaaagatctgatttaaaaagaaataaattttgaactaaaagtttactttaaaaaattatcttgaagtcaagtttatacttatatattatagttatatataatacataagtatgtgtatatacactatatataaaatacataaaaacaaacacatatgcatcctaaaatccttaaagcaaaactaaattgtattatccacctactgggacataaactacaaacaaaaaaagattcctttagttctcataggaatagtccccatactcctaacaacgtgattaataataagtgaacaaagagaaattaagaaatgatctgaccaaatttctatcatctcttgttcttgaactataatataattttagacatcttcaggtcagtaaagtcttgtctaattgggcctcaaaatatctttaatattgaaaacaataccatatacccaattaaatataacttattcatttaagctcaccatgttttctgaactttattctgcaatttttccatctttggaaaccatcaaaaatgtagccttgccatcaaagatctgtcaacaggtggggctgttctcagatgtgcaacaagaacatgagtttaccagaagacttgaaaatgcagacttcttcattctgaagtcttcataaaattttctatgtaaattgcaatttcacatttggcagaaaccagctgaaaagaaaagcgtagggccaccccaaattccaatgcaaaaactattccaagtatcttccaccttccacattcaagcaatcaccaatccccgtgtctgcaccaataatcaaatttaaatcagcccttctactccaattctttcattactgctctggcttagatcctcatctctcaccagaccagaacaattgatgcccacttctctcttatactgtatttttaataatacctggccatcagcactgctgtgagcgtaatctttccaacaatggttaaaaatgtaattatttcagaatcccactcaaaagtcatcaaaacagtttcattatctcagaacaaaacctaaactcctttatatggcatatagaggctttcaaaagctggctgtacattgctcatctgccatcactcagctacgtgcattttatacacagcagtaaggtgctttaacattcaaaacatgatttttgtcatgccgcaatctattatgtacgcgctatccctcaggatgagaatatcctcctctccatgttattctgccttgcaaactcccacccatgcttcaactcaaattgttcctcatgtatgaagtgtactccagcaggaaatcgggtcaggggagggtggtccttttctccttttgtatttggggaaatcattacaaaagctaattatattatgattttcctaactatgtttgtgtttgtctccccagtagaaggtgaggatctaaaagacaagaatcagagccctgtcttcattatctgtatccccagagcctggcagaatgcctgacaggaagtaggtaccagtaaatatttgtaaaaggagtacgaaagaaaagcaggaaagaagggggaaaagattagagaaaggaggggtagatgaaagggagaaagaaaagaattaattcattaggagagagtagtgtttagacaaattactttgtcttcatcttctcctcacttttccccattctctacttgaaatatttttatagctatatctgaagtaaataaatgccaagaataatcttaaagtgaaaagaaaaaggctggcacagtggctcatgcctgtaatcccagcactttgggaggccaaggcgggtggatcacctgaggtcaggagttcaagactagcctggccaacatggtgaaaccccaactctactaaaaatacaaaaaattagcggggtgtggtagtgcacacctgtagtcccagttactagggaggctgaggcaagagaattgcttgagcccagaaggtggaggttgcagtgagctgagatcaagccactgcactccagcctgggcaacacagcaagattccatctcaaaaaaaaaaaaaatctgtcattacaaaatggcaacctgtagcctgaagggcatgaggggacctaggggaaactcctgtgtcagttaatcactccagacctcccccactgacttgctggttggtataagatgctcccctttttaatcaagtctccacttagaaatacctcttcctttaccctagttccagtaccttctcatagtgccgactcacttatcctcaccaccattctgattgacatccttctcctgacatagacacggacacatcttagtgatggtatggacgggggaaaaaaagcccaaagagggaaaaaaaatcagtaagaaggcaaatctagaaaagatttgtgctcatggacaatgttaagaattgctggacatagaaatagaaaatctcacctaatgtgttggagttggttacatattattaaagtctgaataacacaggaagaaaattgattatttaaatagaggaaaaagtctatgtactttgacaccatcattctttaaatctttattgagtacctaatgctttggctctttacgataataaaaagacaagtgtccaggcatggtggcttacacctgtaattccagcactcttgggaggctgaggtgggcagatcacttgagtccacgagttcaagaccagcctgagcaacatggcaaaaccttgcctctactaaaaatacaaaaataccaaaaaaaaaaaaaaatagccaggcgtggtgttgcatgcctgtagccccagctactcaggggctaaggcaggaggatcgcttgagcctggagggcgtcaaggctgcagtgagctctgattgtgccattgcattccagcctgggtgacagagggagaccttgtctcaaaaataaaagtaaaaatacatgtaagacatggtttagttagtttgtaatccagctaagtaaaataataagacaaatagccctgccatgcaaaggctgttcactctgggtcactaatgtcatcaccaggaaagcaactgaaaatctcacagaatctgtaaacattgaagtagagataggagaaggaagaaaaaggcaggaaaggctctatggagctatctcaagcaggaatgttcccatttttaatctctgcacttcctgatttcacttgacttccttgttatctttcctaaaattctatgaatcaaaaaattcacaataaaatcatcattctttaaaaactccagtgatttctgagaatgttaaggagctgttgctttttgttcacatattagtggaatttgttaaatcgtataacattcttcctctcagactgaagtcattgagagacagggacaattttatatagtgtgagtagctaatttgaaggtaatgagaaaacacagtagtggaatagaagttggttttcttttgccttttccatataagtggccttgaaaaggcaagggtataatggaatacttgtgggatacatgaggaaggggtactaatgccttttttttttttttttttcagaacaaaaagagaggaagttctttttcatttaagtttcctttactagatgataccccattcctaagatccagaattgaaaatagtgctacacatcatctacactatggactaaacatgattctgtgggttaattggaaaacctaagctcactttggaaaatgatttctgtgaaagctatcttctctgacttggaaatctcttgcaacataattctttatggtgtgaagttttcttctggatgaggagagcaattgtaaaaaggatgtgatgggaccattcaaactagtgccaaatgcatcatgtaggtagagaagctatgaactcataggattaggagatttttaaaatatgtggactcacacaaagttatgtgctgttcattctagtactcaggcttagggtgactaggcagaatggtaagccactcgttttgttgcctcagctgccttgttaaaaccaatgcatcatggaactactgttaggtcaagaaaataaaccaactggctaggtggcttcctgaaacttgaaacttccaaaaggagaagttaagggttttcttcgtatgtttgatccaaaaataacaggcaaccaacctttcaggacaagagtcggtggtaaaagggaaaataatgagagtgggtgctgggggcggaagaatactctgaagaatgcctgcacataccacctcccccaactcctctaaaggaaaaaaagttagtttgtaccattcctgtttctcaggatacgtcagggtaaagaaacacagtccagggtcgggaggtggtctgcacctccatggtatgactgtataacacaattcccaaaccaatttctttttccgctgataagttttcccactttcagaccatgtccttaaaatgattggtgttcattcctttcgtcttccagttattccttttttttttttttttttttttttcactgactaggatggaagtaaaaaggcaggacctcgagcagtcaccttggatcccaaaatgaaagtgttatgtaagtggttagcagaaccctttgtgaccagccctgaataattgatcttttgactgttacataagggaaaaatcaacttctgcctttcttaagccattgttttttatgttactttttttctttttttgctacagcagcttagactgcattccaacacagtaaagttgaaggcaaatcacttatagccacaggggtcatggtatttgttttttttgttttttggccaaaatgaaatgagaaattgtcagagttttgaatagggaagacatttaagggtagacatgagtacgcagttggactacaactcagaaatataaacaagaagcccaaattactgagtgatttaaatatagatatagtatattgaaatcctggtgtgtattagatcctaaaagagataggtagtataaaagataaaaaggtgaaggtcaatatacagcctggaggaagtttaatataaatagcaactggtggaggttaatgagcaaacatgacaaaagaaacaatcagagaagtagagaaataaaatgctaatgaaacaaccacatttgccctaatttctatagtagatattcagaatatttcccttcaggaagcttacattgtacttatttttttatatctgaattttatccaactctcagatataagaaatatatcaaacccaaactgctaacaataaaaaaggaaaagtattttaaatacacatagacccttcaaaattcagaaagaccatatcagtgtattaactagaaaaaggagaacgccaagccaggatctcagtaaagacctccagatgctttggtaagtgtcaaatagaatgttagggcttactttctcttccctagctctaactgattggttttctgtcatctcgtacattttcctaacactagatcagcacataacatgaaaacattttcccacaagctaagccatttacattttagtaagtggatacttatcaatcagtgcgctggaagggaacaaatggcaaattcgaacaaagaactttaataaaggattcatttaccaaagtatgagaaggacccgacacagtggctcacgcctgtaatcccagccctttgggaggccaaggcaagtggctctcttgagtgcaggaatttgagaccagcctgagcaacacagtaagaccttatctgtagcgcacacacacacacacacacacacacacacacacaaattagccaggtgtggtgccagctactcaggaggctgagacacaaggataccttgagcctgggagaccaaagctgcagtgagctatgattgcaccacttcacttcagcagggcaagaccctggctcaaaaatgaataaagtaataaataaaaataaaaaagaaaaataaaaaacatatgagaaggttaaagaaaatcaacaagaaatgttacagtaccatggggctaatagcagaagagaacaactgctatcccaagcctaatgaaagaagaggagttagctatctaaactggagaggcatacacaccttggaaaggctcatgcgaaataaactaggactttgggcaaaggccgagaatgaagggaataaatatatggacttcattttcctcctgtctttgatgttctaccagtatctcccatttaccaaatataaccaaaaggcaatgatcagcccctttccctgcaaacacattgcaggaggtgaagggtgaagaatggatctggaggtgcaaattgaaaatatatgactcttcagtacataaaatatatgcctcttcagaatatattcagaaaatatataacctcttcatttggttatagtagaatgggtactataaataaatgtgttgtgttatttgaactaatgacaaagtagagtaaattgaacctatgaacaatatcttagcttttccctggaatgagatatttatggttcttggtttgatacccagtgactctaaactctacataaagacataggacatctgggcttgtacgtttctgccagatggtgtgggatgttcaaagatctggatagctaattttacacaataactgcttctaataggagttttatattgaaacctctgacattcttttaccagcagttgtactgccaagtctggctacaataaatgtgcatgacttaatagctaattctccagaaatatcacatttttttccttccttcgaaatctttgtcctattctgcagcccgcattttaattctacaacattttattcttcttttgattattttctgccctgaaggttagttcccgttagcctgggggtttatatactattgtgcatttattcaggttatttgaagttaatttttgccaaaaataacaaaagcactgttactgaggaaattccagtggctccttctgtattttcctggggtcctttagtaccctttaaacaatgttgctctctcctaaaagagttgctgtcggtgctattttctttgcttttaaacttcatcacagtttaaagaggtttgaatgatcttccctctttaagccagaacatagacttgagtttcttatactgactaatttgctgtcacagaaatgcttctttatactttacccacatgacaggacataccctcaaataaatgagagaggttatggcaaaatgccagttcccttgaagcactgcctttcatctaacccagtttctactttcttcccttggtttgtaccaacttgtttaaaataaaaatggatttctcctgtatactttcatgctgatattcttgtatggagttttactttctttaactcagaattaaatgaacacttgttgaaagaatctacttgcaaggagtgaagaacaaaattcccaggtccctttcttcatgattgtgaggtgaaaatagcaataactttgatagtttaaacaataatttcttttttttccctaaaaataaagtttagaaagtaaaaactgcttgataatggtgaagatccatttaaagtcctacatagctaatcaacagaaacacgaggctttattgctgaatattttaaaacacactgcactttcaattgaattttttactctcagtctgtctcttataaatttgcaaaaacatattctattctcaattaatgtattttccactgaaaattcttcaaaatcccattatccaaaagataaactgcaaaccctttgttgtggtatataaaacccgtatgctgttttctaatctcatttcttgcctttttcattctaccatacactccagcaatattcaacgtttcccaacatgcttttcctcccacccccatgttttagtacttgctgttctcttggccatgcttcccttaaactttcttccacatacatatacaaccaccatcaccacctacaatctgcttcaagactaatttaggaatctcttctataaagctttgctcagtgttaactgaactgagaagaaaatcaatgatcagacatatcaatgaaagtgaaagctgtgcaatataagcataaagtttattttcactactatttgttgaatatccatatgccccaggcactgcactagttactgtgatattaacatgaataaggagagtccatgccttctagcacatggttatctttggtggaaaagactcatttgtaaatcagtatttacaatacatttaataactgttatgttgacagtgtaaaagaaaaaaaaacaaaacctaaaatgaaactcttcttttcctcactttgaacagataatggggtagatttccagtcccatatgaggaatttattaaagggttgaatgtaaatgtccccccagctcttttggtctccttatcaaaaccaatgatataaaaaggatagaaaggaattcacaaagaggtgaaatgaaacttgtttgcatctcttggatctctcattaaactcaaagacaagtggtctgagagattttttttttaaagagaaagaaacaaaaatgatggagacatttctcctaaaagagtcaagccaggctgtaagtctctgtaagtctcagcctcctcaccccagatgcctgtggtgctaccttctgatacaaatcttagtgaagagggcttcaaaagaaccatttgcagaactttgaagtggattttctgcaattagacacataaaacttatactggacccagtcaaagtttactgcagtcaggggttaccctcccacctgaaaagaatttagaggtcaagggaaaagctgattttctgctttggaagcagaacaaggagagtgatcatggaggtgcctgtactcctcgagtttgtcaggaaaagaaataagtaagaatttcccacacaccatgggtggcaatgggggagtaatgcataacgagggctctgagtcctgcccaatagggcgacccagaagcattgaagagaccccagcagaatgaatctgaaggtgtggtgccaggtgtccagtgcgagaaaggagctccattctgcacatggtgcatctactagtatcaactgaactgtaggaaagagagcccactagggaattcgtgaaaatcccgaaaagttacacaatgaaatggttagcttcaattaactgaacaccacatagggttgccaaatttaactagcagcccaatgaacataataatattcaagcaagtaagaactggcttttccacgtctgctcctctctatacaccaccctggaccatcaactttggcagtgagttaactattaaggaaaagcagagacaaacaggttgaaatgataaagaaaactacaagtaatgctccaggtttttcagtttgaagccagactgagatgaaagaggaagaatatttaacacagaatattttctgttctttgattattataagggacaagataatttcttaatcaagactatgtttgttttttgaagtaattttaaagctgttagtttgatcaaaatgtaaaaagccatggaacctcctagagttttcactgggagccagagaaactcaccccattggatacattatcaaggatcaataaaaatcaaaaagaaagttgcatttggtcataatccatgcatcatttgtactcaacaatccagttagagaataaagctcaattctctaaaaaatatcataggtgatttttttcttttatttggtgtttctgtattttataaaggaaaaggaacaaaaagcccactttactataacttacattaattaatctcatcaacatccccactagaaggaaggagttttgctaggtactccagattgaagggggtgggatgtataatattcaggcaacactccatacaggtttattgcattgaattgcagaactccacgaagtttataatccctacagttctatccatcaccccttctttttacaacactgaactcccaaaaagaaaaaggtgctgataactaatgagcagtgactaacagtaaacttttaatttagcttcactaaacacctctacacctattacacggcaagcggaaattgttcttaaaaaaattgagtaatttgaagattttggtgaataaaatgaaaaatgttgacagaagtgttaacagatgaaaaggaaactgttgtgggtggtagaaaagatagctagaagagaggaaaggaagctaagtagctgaaccctgagatcttctcagaactctctgtacccttcaaggtacacattgctatatggttttctttctttcgatttttttaacatactagctctgtgtaacttacctcttgtgaaaacttcatgtccagtgtcctgaataacttcataagttatatctttcagtcatgaaaacatattggttatcttgcgacctattctgataatttgcttatttctaatgcatagtctctcctcgctgtctgcagtaaatcgctatctcctctgttttgaaatactacaagattagaaatcagaacaatattgatgactttttattatataagtcctttagtctgtcaaggatctgtatcattaggaaagggatttctataggtgttttctatctctaacttaattttatttactagacttaaatatttttaaaaagtttttaataaaaaatatctctactctttttcactaacaaaaaaggctttaaatgtggtatataataagttctaggaatgaaatataaaatgcaaaatttgatagattactaaatacagtatctattttaaatatgttactataatttacaaatgactttgatcatcttgtttactgaacttaaattttccatttacaaattaaatgtaacattatatataattacaaattagtttctctttcagcttttatgtgcaacaatctatcattaacttcttgagaaatttacaaaagtcattaatcctctaaaaatatacttctgataaatttttattttccccattatcttttcttaccagttctatagataagcattcctatggtaaattgccatatctaaaaagacatctcctagagccattgaacatttacatatgttatccaaatagtctcatcatagtctctaaatcagaattttctttctgttcaacttattcttaagcttaagacttatttaagtactaaacactcaaaatgttagaactattatgatcatatgtgttttttataagtagatgaataaatggaccatcttagaagtcagtgaactttctatctctgtaagaattgaagcagagtggttaacgatggatgctattgtgaggtttttctcagttggactagcagaactctagagttctagttaactctaatcctttctgtctgtagaggggttgagataccctgactgaagatattataaagcctaagaatgtgccaatcaaaagagagagtggtcagtcatctataaatataaaatgagaattaataaggcaatttggcaatactcacccaagaactacacagggctaagagtactctgttaggacaacatagccagactgctctgttgcaatatatcttctgtaacactaggtagctcatatgattggcaaatacagcaataatgctagtagaacagaaatgttgtatggttttatagataatttcttctaggcaagtggagctggaatagtgagagtgaaattataatgagcccttgacctagattaccctctgcaggtctcctcactccctgccttgctctaagctcccggcatgttgcagtcactgcagagtgcatctaaagagcagtcacaatgcgtctgagttctgctgtcttctgcattgtcccagtgcttaaaagtcagtatttccactcaattgctttcagcctttataatatttcatggtgcaaaccccagctatcttgacctctctttccaagttattcaagtaatctctctaggtaccaaccactgtttttgctagtgcttttggtacacaattacataggttttgccccagccccgtttcctccataagcctcgtaattttatttttagtacatagttttgcagaatacagggtttttcaagaatgcaagtgtcgtgttgcaaaagaaacacttttatcctctatagagagacttaaggatacagacagtggtattattcgtgttatatgatgaggcattcttacacagattattttctgataattaggggtcagtataaagaaaatatttaatccatttgccatatttctcgtgggaaattataaatttgcatttttattatgtatgccactttcttgtgagtttggttgacatatcagcaacctgcagttaagtcatgtccaatcactaacagattctgaacttgaaggaacttacatagattaatgctgccttatacggtcttgactcagcagctatctagcctcattggagattgagtcacctttctgtcttgccctgcagcctttttaaaagtctaatttcagtattgcaacccaacggcaacagatctaaattcaaatttaaagatctctctaagactaattttctgcattaagaactgataatatccaaatacccattgcataaggttgttgtagatgttttttaagccgagcacagtgcatgtcatgtagaagtgcttgatgagggatacctgttattatcaagattcacagtgaacaatgcactcaagttgtgggccagtcttttctcatccttatgcctccaaattcaacagagctttagaaagtgaaagtaaaaaagttaaaaaaaaaaaaaaaggaggggaggaaagaagaatctgttgacattttagaaatatgtatttttccaaagtctaggacctatcttgtttggctttatatttttatcacctttaacatattcaacaataaaacattattctgtaatattgaaaactaggatgcagtataaatgatatgcctgcatgcattgcagcctcacatgcagtttataggtagtccagaacacctcctggtcaaaagttttgtaactattttatctaaaattgttttctaacaccaggggctaagaccggggtgggaagcggggaatggggagatgttggtcaaagggtacaaagttttagttaggaggaataagttctgcaaatctattgtacagcatggtgactatagttaataatgtatacttgaaaattgctaagaaactagattttaaatgttttcaccacaaaatataagtatgtgaggtaacagatatgccaattacattaatcatatatatatatatatatatataatatcactttgtataccataagaacatacaagtttcatttgtcaactgaaaataaataaacttttaaaaataaagtcatttaagagactatacccactctatttgagaggaaaaaaaaatcactttaactcaagaatccactctcatgttcatacattttatacaggaaattattcttgtgtcttctccaaatccgcttttcatcgcctgattggagatcacaaacacctctacattctaaaattaagatgataaaaagcatgcatattctgaagaaacttacgatgcagctaatctgtatgctctgctagtccccaaatctacaatgtggtattgtagacagaactctcaaatagtggaataatgttgacttcaacactaataaattatatgaattgggaatagcattagacatttctgagcctattttctcctagtagaacaggatcaataacatcagtcatacctactgcctcacagtgtagaaaagaacaactgaaatgacttagttgaaaaggtatgatgggctaaataatgaagaatctgtaagattctaatattgcaaagatttttaaatgtgaaatttaataaaaactttcaagctaataaaaacagtggacacaattaatatgtaattcaaaacttcagtactgagtaaagcatataatgtggcttttttcctgctatgcctttaaaagtttcaatgtttcagggaaattgggttagctattacaggctcagtaattagagacagaataggtgatataagccattcacttgccaatgtcttcagaatgcagtagcaactctacagctcattcatttagccacataaatcatagcacaatccacagttgctgcacctctttctgctgtgcactcacattttgctctgattgtcagttaaatgcaggcattatgttatcaccctccctatcccttgggatattttcagaattaaatccacttaggaagaaagtattgtctacagtttctctaatttccattctcacttccttattattgctagatatctgatgcttggaattggttatttgtcaattttaatagtctctaaccttttaagaagccacactgttactctcttacttcctaattattcagcctcttcccagagagacctcacttatgtaacatctagtctttataattttcttaaatttcaaggaagaaaaagaaagcacatgtaacttagcagttatttaattcctgtgcaataaccaatcatgcacattattatttcagtcacatttggctatgaaattagcaacatttagatttttaggtgatgttttaactgaaaattgtgttgtgtccctttccatttctcttgattttgccttccaaatatcttttgtctttccagctttttcccatttttgccatcccatcctaatccaaaacaccagcagcacaaattggtttagggatagtgagctaaaggtggataattaaaaagtaagtaaaatataaattgacttgtagagtttttggctaatgaaagaaggggaagaaaaggacaaaatgtcaaacaatcacaaaatccccacacattgggattaagccatatagatatgagactgactccaaaagtcaaaaagtgtatctctcatcatagcccttcccaaatgatgtctttaaaaccatagctatgtaattggttttatttggcctctcaatgaacattgaataccaagagaggtcttgtggaactaaaagaaagattgagactttagcattcctgagtttttctctgatgattctcctttgatattatcaagttatcttatccaaagtttgatctacagccactttttttttattgtttctgctattagagatcctaggatggacattctctatcttggaggagttcgtgatctgattaggaagatagaggagtaataaagcattagttattatatcatgtcataatatatggacacagagttaagacagtcaaaaaccaaatagatgcaaaagataccatctctctttctttcattccctatagattatgtttggggaaatctgtccagttgtagttacatgtttttattttttactaaatgttcaaaacagacatttgaagaactactaagtgctattcaaaatatcaagctttccattgacattatagtaagtctagataaaatgaataagcttataataagcttatacttacagactcaaaatttttaaagccaaatttatatttaatgttgaaggtattcactagcccattgaaggtagaactctggcaaagtgtcaaagaacaaaaaggatatttgaatattggaagagaaatagatatttcctaagaagagaaggtgagggtagatggagtattaccagcaagaaaacagaattgaaaaaggtatggatttttttaaataataggtgatgtttgtgggtccagtggaaagtatggtatacctggaatcaaagacaaatgatgacgggtgggaatgaataataagagatgagactggactaactcagtagatcaggacatattataaaggcctttatgtggcacattagaggctttttattttattttataatcaaatatctagaagaggattttcagcagattttgtttttagtaagattgctatggtagcactgtaaagtttagactggtatagaaaaatgttggtaacagtgaagggagaaaattccaagaaaattctgtaaaggttttttttaaaaaaaaaaaaaaaaacctgttattgtgttgaattgagatatgacagatgcaagaaaaaatcataaagtaaaactgacagaatttggtgaccagtaatgtataaactgagaaatagaataaagtaataactctgtgacttgtagcttgatggtggatggtgatgccattaactgaggtaaagaatacaagaataggagtagactttggaggtggtggtaaagggaaagcatgaaagtactccttggtacccatagtatttgaggaacctgtggtatgtgcaataagcaattagatgtaactatgtatagcattcaagactgaagatattgatctgagagatatcaacacatttcagatagttgaaaccattgggtaaatgagattattccaaaatatatatagttagaagtgaaaataaggaaccaaaatgtgttgaacttcaacaagttagaagaagacttcagcaaggggaactgaacactaatgccagagagatgagaaaaaatagacagaagtgagaattgtcttagaaatcatggggcgaagaaaactttaagaagtagaagatggatgggcattagcagtataaatttcacatagaagtcaagtagtgctgaaaataggttatcgaatatggtgtttatgagggtgtttaaaacgctaaagttttgtccacaaaaaagcaagaaaggttaaagatgtcaagtaggcttgacaattcattaaattcttacttttacaaagaattagatatatcataatttgagtaagaatagcccagagtgatagtgccttggataagaatgattattttgttaaaatgtgattaatgtctgtctcccaattccagctggcatcatgataatgttcagcaaacctagggggtacctaaatccttccttaaatccaattacttctttttcctctttggatctccaatgacgatataggtaccatagtagaaaaacagtttaacattctatcttacaaactttcaatgtagaattctagcatgccaaaatgaaccatatggagaatttattttacataatacttcgtctactgaaatagcctcataatgaaccaggtggtgtgattggctcagcctttccctctccagcagtaaaactgttgaaactgagtttggtgtgcagaaaggttacacatatccatacacttaaaattctgtgtattttgacccaaagcataattgggaggaagacaattctcataggaacaacattgaaaatagtcatacttagctatctaacatcacttgaaaatgtcacttattagcacaatagccaattaaatgttttaaattttgactaaccccaatcaccactcctcctcctctaggatagaataaaagaggatggacttcattcttgaggaaaggaatttattgataaaacattagaaacactgttatttgccttttaatttactttatcttcaggtttaggtgacacatctagtttgaaatgttgaaagtagagttattacttttagccaaaagttattattgacactcaaggtgagtacacctcttagaagagctatgaaattatcaaaagctaaaattaaagctaaattaaaacattctagggtacatgttcattacaagcaagaaacagtgtgtcatgtttctagaaatagaatgaaatccactttgatttcacaatagtcatatatatccatctgttctagccaactttgcacatttactcatgttatttctgaaataaaacttataggtagaagaaattatacattcctacatgtaaatttgaagtaaatccttttacaatgaaagttaacaagttaatttatttcattctgtgacataagatagaaaagcaatttgcttttgggttataattctgtttaaattgttgggcaatttggtcagttcttaattataaaagatatggtagtatcattaaaataattttaaatggataatacaaaggtcattttaaatttatgttagaatacatatttcaatattgatactcagatatgaatctatactacaagtaaactccatttaaaataaagtattagcaccgtgattcataaagatcaagaaaataaatcagaaatgtgaataattttccttacattcttagctgtcaaccaatgcttcctttcccctcaaagctttccattaaagactctccctcataacccagaatctgagctagttgtctcttgttaacatgaatctatatttgtcactctcttatcttttttacccagggactaatacagcccgtgctaaatatgttggacacatgggtcacagtacctgctgggcccagcatcctgttctacctgctcacaaaagtatgtgaagggtaaaaatattaggtttattttttgcccaaagctagtcacttactggactgaactaaacatttgatctataggttggataacacagcctggtcaaaaatactctgaacaaacaggattaatggtaattggataaaccaaaaagtctgttttcttctagaacatggttattacaaaggggcttgcctgattcatagcaagaaggggcagaaaggcagataaagagaagcagagatatcaagagaaaacaacatctagtgtaggagtctttaaaattgtgctgtaaagtgccaaatcataaatattttagactttgtggactatacagtatctattgtgactactcaactctgccagtgtagcacaaaagcaggcatgaacaatatgtgaacaaatgagtggggctgtattccaataaaattttatttacaaaaacaggtggagggacgaatgcccacaagccaaagtttgccatctcggtcctagagtactgctgtccagtagaaatacaatgtgagccatatatgtaatttgacatattctagtagtcacaataaaaagttgagaatcaggtgaaattaagcttattaataaatttcatttaacccagtatgtccgacatgctatcatttcaatgtttcattaataaaaatattgagaagttttacatttttaaattaataagtcttggaaactagcatgcatttttgtacttttactcatgttatttctgaaataaaacttaaaggtagaataaaacttacagcaccccacaattaagactagacacatttcaagtgctgaatagccactgaagactagtggctatcataatgaaatatgcagctccagaccatgaatgagatcatgagagtagtcagtctcctgtgatgtccagagtccttttgatttttaattgcagcaatttttttttaaaaaagatagctcaggaagatcttgttactgttagctccaaagcctttgtgtgaataaataaatgaatgaatgaacaatggaatgaatgctcattggtaagtggttgtatcatctcctgctatatatattttatttatcttagtagtttcattatttttagataatatttttagaaaaaagattttgtcttggatatgtttataactctatatctcctttataaacatatgcaatacatatacacatatgcatgtcttacatatatttataatactacatctctttttcttatttcatcccagagagatgcaaaaaatctatttactagcattgattctattagtcattatatataccatctactcacaaaaaatgtttctgttgctttaaaatagataattgagctttaaaataaaattgtattcagtactaggtaactaacactaaagattaaataactctgagctttaaaatataattgtattcagtactaggaaactaaaacaaaagaagattaaataactcaaggattctataaactagccaagaaaacctatatgtaaacaagtcagtccaaaaaaggagaaaataagaaattatactttctttatagaggcaggctttcttgaactaagtcctgaaggctgggtatgtgtttccaagacaaatcagttgtttatggtggtaaatagcaaagccagggtacagttaataaatagtgacttttgatcaaaagtaccagtgagaaagttaatcagatagttagataggtaacttttaactagctaaatatttggtaatgttttttcagatcatctgaaaaactttaaatatttacatattttagttttatttaaaagaaaaattatcccaatcaacacctttccatttacaatccaccttctttataaagatagaaaaattgaaaaaattcaatatttgtttcagcagtggcaatcctttcattatttgaaacaaagaaagttgagtttgaatggttttgctgattcaagctcaaaacactcccttatcttaaagactggaatatcttataatttacgattctgaatgaaacctttatagatgcaaaatatttcaaagtctatcaagaatagtgcatgtttgctaaagaaatgacacctttgaaatcttgaatctggctgacctttcctttttttggcttattcaagataaatggctacagaaaatgactaagtattagggaaaaaatagaacctaagaaccttcagaattctgaggcacttacagatggtagatcatttcctttcattacaggaacccctgccaacatctgatcattccgatgattagttcaaactaatcatgaatgattcattaagtcagtcttcagtttattatgagggctaagctacatacaccaggaatattgagataggaatgagaccattgtgtttcatttaacatattttgccaaaaatgtaggttgatactttgattttcctttgtataccacaacataaacaaacaaacttcagtgaaaaatgttataaattatcatacagcattcacaattactaattcaaatattgtgtatttatctcatttgatcttccaaaatatatgtttgtgatggtcattaatttttgtcaggtgaaacggactcataaataaattagaataggaaaattcaagtgctaaaaatctgtgctaatccaaacagttcctggctagactgtcaaagcaatataaatcattcattaagatttactacatgctcaggtatccccatagcatatagtgccatttaaccttaaatagaccatgtaagttagattttctttctttttttgctaggcaaatagagaaactgggacatcgagagtttacattacttgcccatgtttgcagtaagtggcagatgtggaattcatttatttgttcaatcaataagtatttattgagttccttttccgagcttggcacttttgtaaggaatatagcaatgaataaagcagacaaagcccttgttcttatagaggatactagtagacagagatagtaaatttttaaaaatacagacaaggccgcgcgcaatggctcacgcctgtaatcccagcactttgggaggccgaggcgggtggatcacgaggtcaggagatcaagaccatcctggctaacacggtgaaactccgtctctactaaaaataccaaaaaaaaaaattagccgggagtggtggcaggcgcttgtagtcccagctactcgggaggctgaggcaggagaatggcgtgaacccgggaggcggagcttgcagtgagccgagatggcgccactgcactccagcctgggcgacagagcgagactccgtctcaaaaaaaaaaaaagaaagaaagcagataaatctattactagtaatatgggtgtggtaaggtgagaaatccacctacatcaagggataaagggtaaagggttcagctggtctgcgtattttatactctaaagtcatggttggcctctgttaaaatgacatttgagcagaaatgtgaagaaagcaagaggatgggtgttccaggatggagatagtaaaaggttttagtggtgaaccatgttggtgagttcaaggaacaccaaagagaccaacttacttctaggcgattagagagtgatcagagatgatattaagaaagtagctgagaccagatcccaaatggccttaaatatggtaagtaaattttagattgaatcctcagtaaaaactgcagccatcagaggctttttctttttttttttttttttttttaagacggagtctcactctgtcgcccaggctggagtgcagtggcacgatctcggctcactgcaaactccgcatcagaggctttttttttttttttttcagacggagtcttgctctgttgcccaggctggagtgtgcagtggcgcgatctcggctcactgcaagctccgcctcccgggtttacgccattctcgtgcctcagcctcccgagtagctgggactacaggtgcccaccacgacgcccggctgattttttgtatttttagtagagacggggtttccccgtgttagccaggatggtcttgatctcctgacctcgtgatccacccgcctcagcctcccaaagtgctaggattacaggcgtgagccaccgcgccaggccgtatcagaggctttttaatagaggaatggcttgatcaaatcttttgttataaaaaggtcactcttgctactctggagacaataggaagatagagatgtaggggtccaaaaaattggaatatatactaatgtatatttgtacagatggaatagaagtcaaagtgtgagggtggctctgattttgagagtagcaccaatatcatttgctgacctaccgtgagataaggtatatgagacaattttgagaaacctcagcatgtacgtgatattttaaatgatacgattgcatgaactcatttagggagtgaattcaggaaaataaaaatacctttctgtctttcttggcctaagaactaagcactccagcattcagaggtcaagaagataaaaagagccagcaaagaaggttgaagaggagcttgcagtgaggtagggagggaacataaacagtggtgttttggaaaccaagcaaaaaaagtatttgagaagaaataagttctggatatttattgtaaaactcagatgtgattggaatagtgttattatatattatacaattaaaaacaggcaaaatataagatatataatttcattccaaatacataggaagaactttttttatatgtgacattaaaagatataattagcaatcacttttttacaatcctaacttcctgcatagtttgtgcgaaaatggcaggcttgcttttgttttttgttgttgttttttattttattatatataagcataaaatatatatctataacaataaaaaatatataaatatataatatataaaaatacataatattatgtatagtcacagcattgctaagagaaaagactcatttctattttactaaagataactagagatatgaaatcagtatttacgcagaggagaataaaaagagaaaaccctgagtgttttgacatccagttcttttagtacccaatttgatgcaacagggaatggaggtatgttttcacaaatgtgtttcagtgagacttatttagacaaaaatttagaaaacaaaagtgaaatgtgaacattgaatgtttagagaaatcaccaataatgtaaggaaccaaataacatttatttagcactaaactaaaaaataattggcaaaaaaaattacctaaacaaatctgactcaagtcttaagcgaaaactctctctctctctctctctcatacaagtcttaacacaaatattcaggataaaaagacagtgtcatctacttccttaaatcttctctgataattgatttggtaagaaaaggaatgaaggaagaatgggaagaaaactcattttctgaaaatttgctcattcattatctccaattaatcaatgtaataaatttcataggttaaaaaaaaggctgacaggatttgaacaatttattatcagtatcacagacaataagggacagaactgacattaaaatctagatcaacttaatttcaaatacttagtttttgttttatcagtaattgtattttttttcaagtatgagaaccttgtttcaatgttaaaaaggcttgcatctccctattttaataatttgcttataatctttagaccagttatcttttggttttcatttgaattttcagatctattgtgataatttccaggcctctaagatttcccaaacacactggtggcaaaagttggcttggtcaaccaccttccctttcactaaataacactaattgacaacatggagctcttacttgtgccaggaatcattctaagtaaattaatacagaaattgatttagtcttgttgaaaaagctcatataagttagcagctattattatctatatgccatataaagagccgtggagcagttaaataactcaccgaaaatcatatgcctattaagtgatggcattgggacttgaaccattgtggaacattatctcacttttatcaatgactaaaagtttatgaacatttctatacctgcaacactcatattgaaacttaattctatactacactttatctttatttttagaaaaatattttttaagaaaattactatgtctcaatatgttgtccaggctggacttgaaatccagccccaaccaatcctccctcctcagcctcccaagtagctggaattacaggtgtgagccaacacacttggtaaactagaaacaattttatttctaaatggctatttttttggtcttacctccctaaacaaactaggaacttctacaaattagatgccacacttgaactttgcttgtatatactcttcaactataattacatgaatactgtgtttataatgaagagttaacaccaactgcaaaaaggaaatgaaattattttgatattccagttgattttctcctggtaaaattcaaatcatagagtgaaactttaaaattatatttttgcaacaaaccaagcattgtgtggtattaaaatgaatgatctaaacattttaaaaagtaattcataagaattataattttcaaactttaagaatatgcttaaaactgaaatagaaattctcttaggaaagtatagcaaataattatcaaagcatctcaaggaaaaatgaaaccatgcaattgtctgattgctgaatagacaatcagccagattttctcacttaaaattttctcattttctttcacattaacgaaagcacttaattttatcttccaaaaggcattttgttttttacttcactatgtgcaataaaacagaataactgcatttttaatttcactgtgtactatgtatttatgcttcacttgttcaatcattgtaagtatacacttatttaaaatatacgatcctacaacatgatattgtagattttattggctggtttatctactaaagtttccattttatttactaaaaaaagtttatagagttcagtagaacctcctgggccatgggagctatatccttaatctttgcattcttcattattggcagtgcctgatacactatttaatataaatattcagtataaacagtgttacattaatgcctaaataactgaatgactaagaacataattcattaattgagtaaaagattgccacttatcgtctttttgacttttcatttcaaattataggtacgctaaaaatatatgttgaatgactctatcaagcaattctgataggaagttttaaataatttaggtacttacttgcttgcctgtttatttaaagggttggaaccagataaagtcttaacattctgacttgcttaacaactttgaaaaccacttctgttgttcaagtcacatatctttgtctctagattttcaaaggattctcgtgatactcaaataaattatgtctaacacataagtgttatttgtgtcattaacatattcacatttgcagagaaaattaattcattatttatcatttgacagatattgaatcaaattggattctgattagagaaatgtctaagcagtcatttttacactgcttttctcttttaccttctgcagtatttctcagtgatctgcaaacttaagaatgctgctgaccaaggcacccaagtggaggtttgatgctagtgctaggaacacgctaacctcaggcattttctgaaatgatagtctcagtaacagcattctcacaagacaacatttttggcacatgattccatttttaaaacattcagactcttgccatgtccctgcctcaacattatcaacaggaaatacattcacctcattataatcattataataacaatatttatttatgctctttttaaaaaaattttaattgttgctgttgtgtttgttgtttctgttttgtcaattatatcccaataactttattgggataacacatttcttttactatagaaggtgtctcactatgctgcctaggctgatctcaaactcttggtctcaagcaatcctcctaccttggcctttcaaagtgctatgattataggcgtgagccactgtgcccagcagatttttatttttatttcaaaaaaaattaagataagtgtacagttttatgttttataaatttcaacatatgtattaactcataaaactatcaccaatataaaaaaaaaatctatcaccactccaattttccctttgtaatctcttcctcccatttcttcctaaccctcctcccacagaaaccactgacctgcttcctgcaactataattagtttatattttctagaatcttagataaatggaatcataccatatatactctttatgtctggctttttcactcagcattattttcagattcactcatattgttgtgtatatcaatagttcattccttcttattactgaatagtacatcattgtatgaacgtatcacattcgtttattcattcaccttttgatagacatttgagttgttttcatcattggtcattacaaataaagctgatgtaaacatttatgtacatgtcttttgtattggactttcatttctcttggataaatacctagaagtgaaatggctatctaatatggtatatgtatatttatttatttaagaaactcccaaactgtttccaagcagtgtatgagagttccagtttttctacattcttgccaaaacttgatattgtcaatctttataattttatgtattctaaatgtgtgtagtggtatatcattgtagtttcaatttctgtttcccaatgacaaataatactgagcatcttctctggcatctggtaatttcctcacaatggcacatgcccaggaacttttttttttttttgaggtggagtctcactctgtcgcccaggctggagtgcagtggggcaatcttggctcactgcaacctctggcttctgggttcaagcaattctcctgcctcagcctcctgagtagctgggattacaggctcccaccaccatgcccggctaatttttgtatttttagtagagatggggtttcgccatgttgaccagcctggtttcaactccttaccctcaggtgatctgcacacctcggactcccaaagtgctgggattacaggcatgagccactgcacctggcgtccaggtactattaatggcaggttgaatgtctcagattgatgaatgaaggaagatgggcaggtgcacatgtggaatcaaaatgaggagagttagatttatccatatctaggttaggaatggttttctccaggagttaagcccctcctttaagcactgcttgaataggcactattgaaatttgtctctggctctttcctttatctttcctgaccaactaccacttttcattttctgcatccctcctctggattattattacaatgaagtcatatgcaattcttgcaggattagagcctttaggtgtaaattttagtgtatgttctggtctgtggtaacttgaccttaatgtaaagtaagctcttaattttcagaggttactttcctaggcattggcaataattaaacataatttatatgtgataataaaatataacatagaagtaggcacagattatttaacatcattggtccatcagtaatctagttactgctatgtatgtgtatatattatatatgtatatatatgtattcccactatatatatatataaaaatatatacaacctagatatggatatatatatagtgggaatacaactttcaacggaatattcttttggggttattttatcataagttattaggcaatgttgcaagaagcaaacatttttatttcaatcagaaacagaatattaataagaggctattggatttctagagttttatgaatttaatcagatatgatgttattaaatataccaatatacaataacagcagtaatcctcctttagatatacctgtgcaaatacacacttaatggtattagagatgtggatagataataggtgaactataaatatatagatacatacatctatacatttttatttaagaaaacattccagctaaagctgataattaatatattggcaaattaagttaaaataatagataacagtacatctagaatagcaacattctgatctagactagttcaatgttttgaaatcttcaagagaatcatcacgtttctctctaattcagggtaactccttgtgtttaacttgtatattttttgagaaataaggaggtacctgaagttattgctttaactcaattgatatttgcatatacgtttgtgccagtaaatggacaaccaaaaaagcagaagtgataggaggtatgtaagatatttattgcaaataactgtcttacaaaattgtggggctggctagacaaatttgaaatctgtaggacaagctatcaaaaagggcatgctgaagctcatagcccaggctgaagccgctgtccacaggtggcatttcttctttttcaagaaaccctcatctctaattttaaggttcatcagccaattgattcaggctcatccggattatttaagacagtctgccttactaaatgtcaatttttatgaacattaatacaatttataaaataactttcacagcaatacctagatttatgcttgaaagactaactagaggctataccctagccaagttcacacatctaaaagaccatcacgatgccccattatcctgttagcagacaggagacgagaaagctgagttttgttagtcctgtatgcatctgagctcagacattcataaatcattcaactctaaggtaaaatgaaataaatagaattgtaaatagtgactctcaggagtcaccgttagtaaccaaagaaaaaattatgatctaattgctaaaaggctaaaggtcattcttgatttattttccctctgtttttgtaagaacaaagcaagaatggaaatttggcttctcttaatgcaatgctattattcaaatgtcactctccagtaacttattcattaactgtgggagaaaaataagtgaacagccctcatattgtataccacatgcatcaaagatcagttcacctcatggctaccaattaggacaggcaattgtctagtagtaattgaaaaaaccttagcaggtacataaaataatagaactgtaaagtactgttctatataacaatgatgtgaattactgctacaggaatagagaaatacaaagaggtgtcttagaaacatacagaagggaaataagaactacatttacagaaaccttttcccccagtatgaatatatgaattatattaggagaaaacccttagtaatatcaccatgggacccaaaacataagactgcaattacaaaattaaatttcttgagtttgctttttcacataaactcttcagttattaaacctgattgttacagcaccccaatattccactttcagcctagatttttcattctgtggtctttagacatgtagcatatccctgaatatgtttcagaagtgtttctgaaagaatatttgaattttgtatatgtgtatatctatgtagctattctggggcgagggtttaccactttcttttgattctcaaatattccattaccccaaaatgattaagatgcactctgggcttttatacttatagctagacagttgtaattagaatccaaatacttaagttcaaaatcccttcgtcctagggtgtgttttcatatctctgaaccttgcttcctcatttacaaaattgggataaaaacattttcttgaaaaggctttattatgaataataaatgagatgatgaataaatgaggtttgtagattacaaagtgttttacgtaagttagttttactggtatctttttaagagcatggtcttctatctgataactctttctgacagcctggagttactacacagctgccttgagaagcggctaatatcaatgccccacttgtttgaacctaggctgtgcttcagttttagcagaggctacttacatcttcccttagcaaggataaagagatacctgagttaaaatgtaagcaacctctgattataatttctgaaatgtcatatgctttttaaaattctttaaaatgtttctacaattttaattttgtgatgtctctagatttcccttccttttattacctcatctttagtcaatatcataactaagtagggtaacagaaataacttaaaattgtactgtctcaccagcttcattcatggacatgaatgaggtcacattcatgaacttattttccgcaaagaatataactataatctctcagttctacctttaaaaatgacctctctgctggcatattgccaggagacccctgggagattcccacattcagaaattccatccaggaaaaccaactgttctacccttccctgctgagccacaccctgagccacgactgccattattatactgctgcttttcagtctccctgctgtaatgctgcaatttgggccttgcctggacaatccacaggacctaggtgccagtaactctgccactgccgtggttgatctttatttgctctgttctcggatggacctccgtcaaaccttggggacctgtgcttccaatctgctggtgccatcacacttcgcacttttctgtgaagtaaaatgggaaacaacacacttccttctcttatgatggtccagaagggttcctttagcctcacaatgctgcaaaatttaatgaagcaactccttgcattttacctacagcctattgttccccagggtacaaatgtatccaccagtacagattcaggaaataagacactgtgttgtaacctcaaatatcacttttcagtgccaatttcttaggcttggatagtgagatagttggattcagttagatttaaataaattaggtatagacataaatatgtatttggatatagctacatagttaagctatacatatacatttgtgtgtatatatatacacacaaatgaatatatatacatacatatatatacaaagctatatatacaaagatatatatatatataaaactggatatatatatatagctgggtagttacagtttggggaatatcaaggaatgtgtgacacctgactccacccaccacacatacccatatttgcctccatcatagctgggacttgctgtagcacaaatgtagatagatgatagatagatagatacatagatagatagacagatgatatattaggtagacagagatagatgattgaaagatagataatagattagaaagatagataatagattagaaagatagatagataaaaattttaaaaaatcaaggcctagattttttttcaaagctcaaaaagagagggatgtgagaagaacctgaatgcagagccaaaaaaaaaaaaaaatgttccaaaacatttccatagcacatggatcctgagaatagcacagctctattgtggttctgaaaaatcagtcaaactcaagaaacaagaaaatattctaaagttccactttttttcatcagttttttactgacccagtatcactgttctatattactggctggaaacatctctctataacttctcccttcagaatattagggagaatgcatgcacttgcccatcacaaacacactcagactatgtctattacactcctactggcccatatgaattcccacattcattagtaaataactatgaactttaaatcaaattgagatgaaaatgtgaaattgttatattttttcaccataattttataggttctgaattaatgctcttttctgattactgatttatgaactagatgaaaataatataatggaaggataagcactgtgtgggtagaggctatgataatatcataaagtttgatcactcaaaataccctaaaaacaatgtaagtataacctctcaccaacaaaaaacaagcaaaaacaaaagacttcccttacaattgtttaaaacttccaccactttgctcctctgaaggtagcccatattttctaaacagtctacttggtacatgtttttcctcaatgtcctcaatcctgcatcgctttaattttcccttctgaagccacacacattgagtctactcctttgtccatatgatagactttcaattccttgaagacaagtatcctgggcctccagaatgttatcttctctctcaggtgttccaaagagcctcaacagtatcatcacatttatgaagacacactcaagtttgtccataagcctcttacagagagtgatttagatttttatatctactattgttagtccttgagggcacacactgtgtatattcatctctgtgggctcaacacatctgaccactaatgagcaatgaacatgtttgttggatgaacacatgaattaaaaaaaagccactttcaaaataccattctgatataaattatgtttagccatttactttcctacacattaacattttgccatccaagtttagttaccaaagaagtgcttaagcaaacaacaagtagaaacgcaagcgacgttagtttctggggaataaaacttatgaagtttagtatatgagttacaatctttctcttcacctgtctgtagcactggatggtgtttgtgctagttgtgaaatagcttattttctaatgaatgttttttatggatttttttttaagcattgcagggattttaccaagtgagacctacattacacattagcatgagaatttataaaagatactgaaattaagactatggaacaaaaaagagaaagaaagagccactgcctctcttcagtcccagtctctcaacaaggactccaggtgggtgggaaatttgccctagatagagacacacaaaccatctgggatttatcctagcaaacatgttgattctcagcatgggaagatgatttgggtgaatacttgatagagacactccaattttcccaggcctcggggggacttgttacaaataccttgagagaggcagctgtaagaaactgagggagtgggcctaacagatccctctagtatgtgccaggaagcaatacacaaaactgagcaaatgggaaagctcagcaggaaccccaataacttttaacacaagtgagccaaagcttctctcctttccttgcaaaagcagcctgtgctatgatgtgcataactttaagagacatttgtgctaatgatcttggtgggaatagcaataattatgtcaccatctggtggccaggtaaataacggggcacaaggtagaacatcagaaggcagcaaagataagctaaagaaggcgaaagtggagaatgtgttcatggtctcctaaggactcatgcatgcatttcaggggactagaaaaacttggagtatcccccaaagattcaccaggatagaaactcagaggtaaagtcctgttctagtttacactggtgtttcaggtcatggattgtgctagggttgcctatgtgtaaaagattgcacaaatagcaatagattatagagagagggctcagcgaaatagaaagcacaatagtgggccctatttgtttaggaattatatctctgataaaggatgttaaacaaatattgaggaaagaaagcatggttctgaagagtattgaagtaatttgttaataagttacaatgaaaaatatttgatttctacgttaaatttgctatatctcacaacagaaagcaagaagagcatcatgcaataaatatttattgagccattgctaaatgccaaagtgttcagaaagctcaagggaaagcaataaatagagctcataaaatcctgcccttgaggtgtttacattctagtgggcagaaacaaccaatatggaagtaaacaagaaaaatctataatatgtaagggatgaataagtgattagaataatgataatgcaattaaggagaaccagatgttgtatatgtatagggtggtcaggagatacctttgataagaaagtatttgagatatgaagaaaatgtaaaagtgaactttggtatatctgatgtattagtttattttcatgctgcttttaaaagcatacctgagactgggaggaaaaagaggtttaatggacatacagtttcatgtggctggggtggcctcaaaagcatggcagaaggcaaggaggagcaagtcacgtcttacatgcatggcagcagacaaatagagagcttgtgcagagaaactccttcttataaaaccatcaggtcttgtgggacttattcactgtcataagtacagcacgagaaagaccggccgccatgattcaattacctcccaccggggccctcccacaacatgtgggaattaaagacgagatttaggttgggacacagccaaaccatgtcatctgggttggagcatttcaggaagaaagaacagagaacgccaaagactcacactggagcatgtttgtattgttttatgaacagcaaaaatgtcacttcagctggaatagacggatacaggagcagaccggtaagaaatgcagtcagtgatgtatgagtgggtggggtaaaaagcatgtagcccttgcaagccctttaaggattttggggatcactctgattgggaagagtaaacacttttgttgtgcagaagctctttagtttaattaggtcccatttgtcagtttttgtttttgttgcaattgcttttggtgccttcatcatgaaatctttgtcagggcctatgtcccaaatggtatttcccaggttaacttccagaatttttatacttttaagttttacatttatgtctttaatacatcttgagttgattttcatatatgatgtacggaaggggtccagtttcactcttcggcatgtggctaaacacttataccaccagcagcaccatttattgaatatggagccatttctccattgcttgcttttgtcgactttgtcaaagatcagatggttgtaggtgcgcagctttatttctggggtctctattctgttgcattggtctatgtgtctgattttgtaccagtaccatgctgttttgattactctagcattgcagtattatttcaagttgggtaacgtgatgcctccagatttgttccttttgcttaagattgccatgggtattcaaggtcttttttgggtttcatataaactttaaaatcattttttctaattctgtgaagaatgttgttggtaccttgataagaatagcattgaatctgtaaacaggttttggcagtatggtctttctatcaatattggttccatgagtatggaatgtttttccatttgtttgtgttatctctgatttctttgagcagggctttgtaattctcattgtgtagatcttacatttccctggttagctgtagtcctaggtgttttattctttttgtggctattgtaagagggttgcatttttcgtttggatctcagcttagacattgttggtgtatagaaattctactgatttctgtacattgattttgtatcctgaaactgttgaagttgtttgtcagacgtaggagcttgttggcaaagactatagggtttactaagtagagaatcatcatctgcaaactgagatagtttgagtttctctatttctctgatgcacttcacatttttcttttgcctgattgccctggctaggacttccagtactatgctgtataggagtggttagagtgggcctccttatcttatttcatttcttaaggggaatgttccagcttttgcccattcagaatgatattggctatgggtttgtcatagatggttcttattattttgaggcatgttcttttaatgcctagtttgttgagggttcttaacacaaagggacgttgaattttattgaaagccttttatccatctattaaggtgatcatgtggtttttgttttaaattctatttatgagatgaatcacatttatggatttgtgtatgtttaatcttgtatcctagggttaaagtctacctgatcatggtagatttgcttttagatgtgctgtttgattcagtttgctggtatttttgttgagaaattttgcatctatgttcataaaaaatacttccctgtagttttctttttgtgttgcatctctgccaggttttggtatcaggatgatgctggccttgtaaaataagttagggaggaatccctatacctcaatttcttggaatagttttagtaggaatggtagcagctcttctttatacatctagtggaattcagctatgattccatctgattctcgtgtttttctgattggtaggctttttattactgattcaattttggaactcattattggtcagttcatggattcaatttcttcctgattcaatcttgggagattgtatgtttccttaaatttatctgttgcttctaggttttctagttgtgtgcatagaggtgttcacagtagtctctgatgatttttttttttatttctctaggttcagtagtaatgttccctttgtaatttctccttgcatttatttcgatcttctttttttttcttcattagtctagttagtggtctatcaatcttatttattctttcaaaaaacaaactcctagattcgttgatgtcttgtatttttttttatacaaaagatcaacctccttcagttcagctctgattttggttttttcttgtcttctgctacctttggggtgggtttgctcttgtttctctagttcctctaggtgtgatgttaggtcgttaatttgaggtctttctaacttttttatgtgggcatttaatgccataaactccccctcttaataccagtttagcagtgtctcagagattctggtatgttgtatctttggtctcattagtttcaaataatttcttgatttctgccttaattttattccttaccccaaagtcattcgggtatatgttgtttaatttccctgtaattgcatgagtttgagtggttttcttagtattgatttctgtttttattgtgttgaggtcaaaaagtgttttggtgtgattttgtttttttttaatttactgaggactgttttatggctgaatgcatggttgattttagaatatatgctatgtgcagatgagaagactgtatattttgttgtttttaggtagagtctgtagatgtctgttaagcctatttggtcaagtgtcaagttcaggttctgaatatctttgttagttttttaacttcatgatctgtctaacatggtcagtaagatgtttaaatttcccactgttatgctatagttatcttagtctcttcatagatctctaagaacttgctttatgaatctgggtgctgtgtgtatatatgtgcacatatatttaggatagccaactcttcttgttgaattgaaccccttacaattatgcaatgcccttctttgccttttctgattattgttggtttaaagactattctgaggttagaatagcaacccatgttctttgttttgtttaatttttttaattagctttgtagatttttctccaccctttatttgaggctgtgagtatcatcacatgagagatgtgtctcttgaagacagcagaccattgggtcttgcttctttttacaactagcctttctatgtctttcaattggaacatttagcctgtttgcattcaaggttaatattcatatgtgcagatttgatcctgacattatgtttttaactggttattatgcagacatgattgtatgattgctttatagtatcaatagttaatctatttacatgtgatttttgtcacagtcagtaatggtctttcctttccatattaaatactcccttaaggacctcctgcaaggcaggtcaggtgttaatgaagtcccttagcatttgcttgtctgaaaaggattttatttcttcttcgcttataaagcttagtttggcctgatacaaaattcttcttcggattttttttttctttaagaatgctgtatataggcccccagtctcttcttgcttgtagggtttctgttgaaagttccactgttagcctgatggggttccctttgtaggtgacctgccccttctatctagctgcctttaacattttttctttcatttggatcttggagaatctggtgattatgtgccttagagatggttgtcttctataacacctcacaagggttctctgcattttctaaatttgaatgttagctactctattgaggtcgaggacattttcatggacaatattatcatatgctttctaagttgcttgctttctttccctttttttcagggatgccaatgaatcattgatttggtctcgttacatagttccatatttcttggaggtttggttcattcttcttcgtttgatttttctttatttttgtctaactgagttattttagagaaccagtttttgagctctgagattctttcgtcagtttggttgattctgctgttaatacttgtgatcgtattctgaaattattgatgtgagtttttcagctctatcagactagtttgtttctttctcaaaattcccatttcatcttttttctcttttttttttttttttttttttttttttgagatggagtctcactctgtcacccaggctggagtgcagtggcgtgatctcagctcactgcaagctccgcctcccgggttcatgccattctcctgcctcagcctcccaagtagctgggactacaggtgcccgccacaatgcctggctaattttttgtatttttagtagagatgggtttcatcgtgttagccgggatggtctcaatctcctgacctcgtgatctgcccacctcagcctcccagagtgctgggattacaggtgtgagccaccatgcccggcctcttgtattgttttattgcattctttagattccttggattgggttttgactttcccttgaatgttgatgatctttgtttctatccatattatgagttctatttctgtcatttcagccatattaagaaccattgctggtgaactagtgtggtcatttggagataacaagacacgctggatttttgagttaccagagttattatgctggttctttgtcatctgtgtgggttgatgttctttcagtctctggagttgctattctttccatgttttttgttttgttttgttttgctttgctttgcttttatcttctgtcatgccgttagggatttcactgtggtataaggtggattcagttgactgggtttgtttctcttcccacagtgtcaccagggtttaggaatgagtcccagtgttcaatagccctgtgcagggttcccagcttcctcccccttcagcccagtgtctatgtcctccctctatccaccctcaatgcctttcctccgaagatctgctcatagtgtgcctgtcttcccaatgtcgtggtctattggtaggagctatttctcctggctgcatccagtcattcattttatgtaatacttttctcagtctaaatccacttttaaaatgcttactcctgggtctcactataatcttactgaattagaatatctgaagatgaacccaccaatttcaatttaaacatgattccagaaagttcttgggaacactaaagtttaaaaaccactgcaactagtcaattagtcaatacagagaatatagtatttccacaaaagaaaaaataaagccttacagtatagcagggggaaaaaatcacactctacactttttatcttcatcttaagtaaaataatccagagccatgcatattttgccatgagattctccaacttatttaatacattcatgccctataataaacaattatttcattattgtaggtcacctttagttgatcatgtgagaacaagatgagtgtgtcccgggtgatgtgctgccctgttgcctttttgtcaaagataaattgccataagtattttgattccatttatctggctacccacaaagctacagaaagattcttgtgcctgtaagatggaaaattcaggttaccccagtggattgccagttattattaggagatgatattgatgagctccccacagctatattggtgacacaagtcaaaacacctgtggattctggaaagcatgaggagccttctatcttctcccacttcccattaataatcaggcatctgctcagtatagctatgggcaccctattctcattttctgtgtaaacactaacttggactttgctgtatattctctttgtgattgctcatgcagtaatacatgaaccattattgcatccacagtggaggcaaagggaggaagacaatgacaaaggcacttactgagagtcacttactataagatcaattctagcaattcctcagcagctataccatgggatagcagtgccttcaaatggcaggggaaagtgtcaccagcatttatttcccaccctctacaagagcaatgggaaagcagggaggaatgagaaagtacaagatagatttctcccctttgagaggattaatttatatgaatgtcctaagtaatgagaaaaaaacaattttttggccttatgcatttgtacaaaagaatagtgccttgacataggataaaaatatgagtttggtgaggtcatgagagcttattattgaactacagagacagtttattttacttccattgagatggcttggaaacaaaaactctttgaaagtaacctgaaactagaagacttcttaaatatttccacatactattcaaaagcctgctttgcataacagttatatgagtgagtatatgtcaccattaattttaaaaataattgctaggcaaaatatcaatttctttaaaatgctctgagatattgaggtatgcacattcccattgatgtaaatgattcctttaggtcccattattttgataatccttttcaaagctaacacagaattgattgcctcatgtaaaaatgctggagccctggctcctggctcagccacttagtaactgtccaccctgggtaaaattattcaaatgttcttagctttcaatttctcatctgcaaaggaaagatcataacggcagctcctctacaagagattctggatctcccttgagtagtagtgactacacttttctttaaagccctgctataatctgcatatccattttatcatagcacctaccatacttttgctacccaactatactatacactgtacagctatagaaccaggcaaacagttaacaatcagtacatacttcttcatgaattaataaacatataatgagaaaatcttgtaaaaaacacttatgaagtgcattttattcaaaagaagctaaagctccaaaagtttaatttcctaggacccaaaattagaaggtggaaaaaccatatttaaacctcagttttatattttctcactctaccatgcagacttcaacatgatttagtttcctttcaaaaaaactcacagagtattttgtgctttgcctatggccactattatattcttccttgcactgtaagatgccagtacttgccttatctaataactaaactgtagattacttaaggataggacagcacattactgacctctatatttgaattcataatgcctagtttaataaatatttgtggaattgaaaaatttagctcctgaagagatttcagcagtccctctgggttggtttaagtgaagctcaatctgtaacaaaggaaaggattaaacggtttccagcagtaagtttattatgcctcttctaaagcaaattcaaggtcccttttcattctctttcatctatcatataatttatgtggtttctgcacaaatactacccttttcctctatagtctatattctatattggaccataatttttatagaattttagaaattataaaataatttatgtaagtttattatatgctacaagtcttttctacatgtactttaaaatgtgtaagcaatctttaaatcagatcttaaaacatttagaactaatcaagcaagaaaacattactgggattatttattttgcaaaagacttggaaaaattctattctctctgactttaataatttttagatatttcaaataaatttaatttattttgtgtggcagaaagtttgaactggactattatgacctctaaatgtagtattctaaatttgattttatagggccctaaatgctttcctaagttatttttaattcatgtgaattacctgaattggaggtccattaactttcattatgctgtctcaggagctaattgggtggcaaagtgccaaactcctggagcccgagagatagagatagatgaggatctgccagagtggggagaaaggaaataaaggtatacttccaccaagagctgagtccacttactcttctgcattcaagtgtacaagactgtaattcaactagcacttttggcattaaataatcaagatccaagaaagcttagtatgacacaagaagtgggtttcccaaaatacctctgcatttggcctatacttttggaaggacttagcagtattctaatgcttcctgattttactcatccaaatgtagcaaagaaacaaaaagatgattacactgagagcacttatgacattttacagtgccagaatgattgaatatctgcttagttaagaagttttacctgtgcaattgctgctgctagaaatccatcactaatgagttcagtcccatttatcatagctagaaagcatgtgacagtttgagtgcaatccaagttctggcatttcagggttgtactctaattttcatcagaatttcccaggctatgcatgctctttacatagaaggggcagctctcaagtgaagccgtaagaacaatggattataggaaagttgcaaaacaaaacagccacagcatcaaacatccttagatccagacctaccagaattgagtctcaggcaagtcattttaatacaagcctcttttgagtacatttaatatctctgagcctcagtttcaccctctaaaaatgaatataaaaatgcctaacttaaaaggtttttagaaaaactacattagaaagtgtatgtagtgccaaacacatagtaggtcttcaggacatagtagttgctgctgcatctatagttgttgtagacatatctaaggaaaatattaccccttatcacacccttagaatctctgtgaaggaagaaactttattttgttcaccaggaatgagtgaaattctaagacttaatgagttttctcaagttctctgttagaaagtggaaaagtgcttatgaatgaaagtaaaaggaaatatgaattctgtgctagtgttactgggtagactgccagtaaaacactctcttagtaaaagaagacacaagtagataagaaggagtcaggatctatttctctcattttgtagatcttgccaaattcaaaatgtgttaagtcatgcacaataaacctctataatcctacaaaaagagccattctagcaaacataatgaacacactttttgtttgtttgtttctcgctgaatgactatatttccaaagacttgcacctgaaagtatttccaaggcatgtattcccacggcagtggtcaaagatgtattatcctagtctaacaatgcaaatgttcccatatgaagaaagatttcatgtggtctctaaagacagcttgtaaattagttgcggcagcttctttaatgttttgattcattcattcaaaaaatatttattaagtgccttctgtgaggcaggcactgtgaaatacaatcctcaacaagacagaaacagagcctatcttaatggggtttataccttctctttgacatatcattctcttcatatgttcatctactaattttgttaggaaatatttcctaattaccaaagatatttatgtttttatcaaaaattcaagagatatagcatagaaagaaaacttcctgtaccatatattctctgtgaatctaccaccaccaatagtctggtatgtgtttttccactttttcttatatatagaaaaaatatttataatatttttagaatattatattaaaactttaaatatttaaaataaatataataaaagtgaaaaattgtataattatacatatatatatacttgcttttgcaaaaacagtatattattaaaatgttaatatttagcataatgactaagtgatagtagttaatatatttcattaacttggctttaaagtaaggaggtttgggaacaagaccttaggctttagaaaagccaaacagtcctttcagactcaagaaagaaaattttccatagtgctgctagctttaacctgattatcttcttaccagataatcattattcttcaaatcttaagagattgactgactttatgagacaaggcttcttaaagaaaatttcgagtgatgtgacaagtcttcctccatattgccaagaaatgtttgaatggattatttttttaagaatgataaaaaatctatattctagattaataggaagctagttcttttctgtttcattcaaaatattcgaaagacaagtcagaatcattttagaaaaaaatgacattttatatcaaaccatttcaagcagtttttacttcttttctcaatcccctctaggcctttacagcatagggttatagaagacagtcattttcagtctcttctatttttataaaagatggaagtagtcatatgtaaaaaataaaagtgactcttccttagaaataaggctaaataattctaaaaagatttcaagctaagcatggctctcaaatgcttttcagttctagaagcgctgcatcattcattcatttatggataggaaaaagcgattgtattattcttccaattctttttttattgctgttgtttcccagaaggtaatgctagtagtaagggacttcttttttagaaatgcattaaaaatagtaagccttttaaaaatccagtgttagaaaactttgttcagtttcaccttttaaatgttctgccatatttgagagacaattgtctaccctattgtgaagtgtaaacaactagttttataattcatcgtaatagaatcatacactcatgatgacatcagaaatgactgccactaaacctcctactttagtaagtgaagaaactcagggaggtgaccagggaggagcctaaaaattccactatgccagttattgtactagagactttgtatactttacttcacttatatctgctaaaatttgaaaccagaagcattagctccaggctctgataacttgtccaaagtcacaagacagtttaattgcaagatggagacttttcctaaagacttctgtcttaaaacagggttcttcttgctccaccaggctgccctgttccattgatctatcaaaggcttgcgtgaatataatggcagcctagataagtagaaatggcttggatactgaatcatactgtcaaagttaagacaagatagtgtaaatatgattttgcctgtgatatagactacagtattagatatagattcaatatcatcatccccatagtaccatctctgttgccgtagaaagaaagaagataagctatatgacaaaatagtttaatgtggttgaatacggcttacttggcttaagcctatagttagaaaattctaatattttaatgatctagttaaattaacctaaggcttcaaacactggactatttataatgaacaaagcatagcatattcattacatatacttcagaataatctctcagggttaaattcatactttgtcactttccttgattatcccatctcacttctctgcatccttgacactcatgtcagagttctcatcttaaaaatgtgattaatatattcaccaaatatttactaagaatccaccatgggctaagccaagtgctaggtaatgagcatataactgagaataaggtatgtcaacgtcctacagaagcctgcagtttagtatagactacagatataggccaggcacagtgacccatgcctgtaatcttagcactttgtggggctgagacaggaggatgccttgaaccgaggagtttgagaccagcctgggcactcatacagaaaccccttctctaccaaaaaaaaaaaagaattaattaattagccgggagtggtaacacgttcctgtagtcctagctactcaagaggctgaagcaggagaatttcttgagcccaggagctcaaagttacagtgagctgtgatgatgccactgccctccagcctgggtgacagagcaagatcctgtctgtaagaataaattaattaaataaaaaattaaaatagactacagacacacacacacacacactcacatacacaattacaaaactatgatgagtactatggtagaactaagtacagcatactatgaaatctgggaatacataagaaggcatctaatttagaagtgcagagtatgatactgcttcttaaagacagtgatatttcattaaaaaaaacgccaatgtaatatagatcaatgtctttccatttcctacaaggaaaatacaaatattatagaaaaaaaaaagacaaatatttaggcccttcccagtctgactgccttccatctatctaacattatctcccactattccctctctggcaccctgtgaccatatacaactattctattctccttcccaagcaggccatgttttatgaaaacccataacctggtcttattctctgtctcttcctcctccttattcatgagaaatgcatctactcattaatttaaacataaattgaatgttttgtattttatttcatgtctcttaacctctttccagccctagattttattcattcccctgtgatccacaacactctgtgcacatccacactatagtccttcttacaaattgccttcaacattcttgggtagcttattcatctatgaattttcagcttcttactacattgtttgacctatctcaagaactaaataaacattcattgaattttgaataattttctcctgttactgaagagctttgatctgattggagatactgcatttccagaactgtagtgtttaagtaaataaataaaagaatttaaaattaaccattatgggaattaaattgagagacccaagaagcagccagttaggtgtgacttggaggatgcaagtggaaatatttcactaggcttattgggaatgacagtgttgcatagaattgtcagaaagacaaatgagaattaatgaagaaagcaaacatcctttgtaaaaatatacaatattatatcatgcaagtgggatctaatacaatgggttaattttccagaattcaaactttagtagtgataggttgaacacacattactctgcttagatttattttcaactctatttcacttttgcttcatttcatcctttgttagttcagattcaatgtcgaaacaaaagtaatatacttgaattcttagaatcaagaataaaaataaaatccataagaactgtgaatttcactctggttttgatagtaagcttattggcttccatgcaaacgtactgaaaaggccacagtggcactctgtatccactattgtgcaaataattcactataaaagtgttcataatcagtgcaaaattgatagaatcgtgtcaattgatgtttaaatttaacgaagctggttcattttctaagcaaaatatgcacaatgaaagcattttcactgaagactgtggagagaaagttaatgtggtttacctctgttttttcttagctaatgggaataattttcagttctcaacaatggtttactgcacttaaagcaatattcaggcctcaaatgtggatcagaaattttaatcctcaatacattaacctcaactattatttttttcaaagtttctgttatcacagttatatttctaagtggagaaaatacaaaagtaaattagagacttttaaaaaatatgtatggaagaaatgatatagaatattttagaaaaaaacacagtcccaacctattgaagggaaaccactgtaactgtaactgtctaagttctgcacatatgtacataaactgaattagaaaattgaagaaactgtcaagagaattataagttgagaagataaaaataagtaaagaagttttagagacttagattttctgataactcaatttttcttgtcaccttttaagaataagtaaaaaaaaaatccatatacattttatttgttagaatttagtaagactttaccccaaagctttgctaattacattaaactttaaacagattttacccgtgctttaattactccactagcaagatgaagctaagaatataacttgagacatccctattttcaggttgctcagaattcagaaatgctgaagtgttttagattcccctgtagaatttagtgcaaaaatgtaagttaaaaacaagtaattggattgaaattataaatacacagatttaaaaggacaaggccacaggagaagcttaaaatatttataaattctaccatatcttatattatattcgggagcaaatattcaaaagcaaaggaatagtcacaccggaaggaatatatccttgtgtaaattttaaaatttacatgcattggggcaatcaggttaaaatcagtcactctacagagatatgcctatgaaataaagggcattgtctgctggataagaccacctggcatccagaaaatgtctgaacagaattttctgaggttcatggttaagccatagggccctgtagtcagactgcctggataacactcagatgctatgactttgcttgtttgagctaaaactgagtcactcttttatctttatattgggagaaattatagcaactgctttatagagcttccatagaattaaatgaattattggatgtcagctgcttagtacagtactcccctcatcataaactctaaatatgttagcaattacttccatttaatttcacaagatattcttcacattttcacagctattgatttaaaaggcaagtttacatattcataggcacattgtgatacctctgagggaaaatattctggttaacaacacatttttaggtgttccaggttacaacacattttagggtagagtgggagagtttttattataattttaatcattcttacttcagagaacacaaatacaagagatttctgacgggtattcataggaataattggttctaaatggcttaatccataggaaggatgaagaaatgaggaggcaaagtcaaacagaggaacatccttatgaaagaaacatctgacctgtcagcttgggcctcaattagccctgcttagctagaatcagggagatgctatttttgaaggtcaactgcatcccattcctctccagtccttataataatgagatcagctgtatgtatgggcctgtatgtacggtgttcaaagcacaggttggagtcagatgagtcttggttatactcctaactctgctgcataataaattaagagccaatatttattaagcacttactaaactaaagcgctttacatgtattaactaatttagtaataataagaaccatataaatagctataattgttagtattaaagatgaagaaagaaagcacaaaagcactaagtaactttcccaaggcacacaactcacaagaaatggagttggtttcacataaggcaatctgtctgtggagaccacaccctctcttgtgtcttgtggtacaattttaggcaggttcccttttttttttgagatggagtctcgctctattacccaggctggagtgcagtgtcactatctctgctcactgcaacctccatctcccgggttcaagccattcttctgcctcagcctcccgagtagctgggactacaggcacccgccaccatgcccggctaattttttgtatttttggtagtggtggggtttcatcatgttggccaggttggtcttgaactcctgactttaagtgatctgcccaccttggcctcccaaagtgctgggattacaggcgtgagccactgcacccagcctggcaggtttcttaaactttctgaatttcagttttctcatcagttcatacagagttgtagagataaatcagatagcacctttaatgcatttattatgctcaaaaaattttgttgtaaacaaacaaaaaaaatttcttaggtaaaagatttacccctctgtagttgaggatagaactctaagacttactgactcactggtcccaaatggaaatgagcccaagtgccttttactcaagccaagcttctccaaggattctagcaccactcctcctctcaaggagcctacaccagctttaactatacctcccgactgaagttcctctctttctagcccagaagagctttatgttgggaggaggtgaaaatacttgcagcagcctctgtttttcaaaatatgtttcttttgcggctgaactttagattttatatctcagagacaaggatttgactcttttactcttgttctgctgtaagaaccttgcttgaatcaagggatcattataatcaccagccttataagaggttggaaagaaaggaatatttgtgtgtgtgtgtgtgtgtgtgtgtgtgtgtgtataaacttaaatagattgtcaactatctaataatttaattgttatatatctaattaagagattaccagacattttattgtaattattattaactattacattttccactcaccattgagcatctttaaaatactgagtgaaataggaaaagtagtcaagacatttatatttgggcttatggagaaggtgggcagcagaaggtgaatgatgcaaacaacctaatagaatattgtacttataacagtagaagtaataaaaacacaaagaaaaaacttttgagaaaaattcaaagacaaattgtaatagctttcagatgtttgagaaagtcaatacacatataaaacaaacaaacgaaaagcaggacctgcctggttgctgttagcagcagccagactgacagtgaataaagcagtgggaatgggtctctattgtttactaaagcaccagagacaactctgaggacagctgatacaagagctctggcagaagcagaaatttatttaaccccaatacctctatcacttgtcaatccttaatttgaaaaatacaggcaagtcactggttacatactgttgttcagcctataaattcctttggaatcaggtactaaacacaaacaggaaaaataaaccctctgcatttttgctgtcatcagattttctaagaggaaaagtagtgaacatattttacttcacatttagttttagacaaaatatgttcacctatttaacaaacattcactgagtgccttcactgtgccagcatctatttctgaaactgaaaatataaaggagacaaataccctgccttcatgggagagaagaacattccagaaggagatagagcatgtgaaaacctgtgagttgagctcaggtaggtaacagaaaaccagagaatgcaggagtttataggccactatcctgactttggattttactcagactgagtcaggaaaattgtataaggttgtgcacaggtaaattatttgacttagatttttaaagaatcactctgcatattgtatttgaaaatgtaatgtagggaagcaacacaaacagagagaccaattaggaaatcagggaaataatctaagtgagagataaatggtggtaatgaatgtggtgagaaggttcatattctggaactaggtttacaatcggcaggatttgctgacaggttggttatgaaatataagagacagaaaagagtcaaggtaaattacaatgctttaggcctgaacatctgccagaatagagttgccatttactgagatagagaacattacttgtgcaattttgttttgttcctgtaagagaagggggcagaaataataaattcagtttaggatatgctgagtttatgagtctcctggagatccaactggacatattaaatagggagtttaggtaaatgactgtggagctccaggaagagatacagactgaaaataaaattttaggaataaataccatgcaaataatagtaaaatccccaagactagataatctcacttaggatgagtagaagaaacacagaaaagtaaaaatccgaaggctgatccctggggcaccccatcatcgcgggttaaggggttaaagaagagaggtaaatgtggctgaggactgaatggtgaaatagtatgaaaatcaagagagttgaggttctgaatgtcaaattaagaaagaagttcaaaaagagaataatcatctgctttgaatgctactgagaggtccagtaaaataaggactgggatttgatctttgatttagcagtgtggtgatcactggtgactttcactaaaattacgtttccgtataacgggagcaaaatatgactaaaataggttaaacgtagaatgagaaaaaaaattggaaatagaaagttcaaaaaaatttttcaagtcattttgttttaagaaggaacagagaaatgggataatagagggatatgtgaaataaaaagattttataaagtatttaaagatttttatgaaataatttaataattatttttttcaaaactagtatttcattgttttacaagtcagcgcaagaaatttctgtagaaccaaattaagttctactgtccagttgtttttgctttctgatagtaagatttttcaaataaaattaaagtacagttaggtggttgatatgtaacagtgaactaaaaatacaaatgtaaatttattcactaagacttaatctatgcattatcaatagatttgcttatttcttttgaaacctgaaatgggaaatttttcttgcttacttaattgcatatgataaacttttggccttatcatcttccctgttaatatttaaatgttttaatatgaataggttaaaacaacttaaatattggatttttgagtatgtcagtgtttacatctaaaatgtaaggtatttatggcttcaccatagtttagacaagtgtgataggcagaagaatgccacctctaataaaagatatttacacattcaaatccccagaacccgtgaatatgttattttacatggacaaaaaaactttgcagctgtgactaagttaaggattttgagatggagaggttatcctgcattatttgagtgggattaatgtaatggaaaagcaccttataagttaaaaaaaaaaaaaggaggaaggagagtcagagtgagagacatatggtggaaacagagattggagtgatgcaattgctggttttgaagatggaagggagccacaaaccaagaaatgaaggcagcctctagaagctgaaaagacaaggaagtgaattctttcctggagcttccagaaggaactcatgcatcaatagcttgatttcagccccacgatacctatttcagccttctgaccaaaacaacttaagatattaatttgtgttctttttagtcactaaatttgtggtaatttgttacaggagcgatagagaactaacacactatatattagggcaattgctgaatttgttctagattcctcaggaaatttaactccttgaagacaagttgtgatgtccttcatctctttattttttacagatctccacagcaccttgcctatagtggttgttcaataaatgatcgttgaatttctttggacgacttaattagtattgaagtattatgtcaaaaccagaacagtaattataaagatgtctgtggaaagaaactcccaaagggaagaacgataaaatgtggttttttttaatcaatgttctttccagaataaatacatttatcaacataaataaaagaaaacctcaataattataaattacgtgctcttttctgctcaggagaataccactgtaatggctgaacattagaagaaaagtacattatttgatttctccaagtttgtactatgattgcattctaggatttgtatatttttaattatgggaaaagtaataagataattcaatattttaaaaaacttcaacaataatgattgtgatttataaaatatagtgtttatgggctggacgttgtggctcatgcccataatcccagcattttgggaggctgagatgcgtggatcacttgaggtcaggagtttgaaaccagcctggccaacatggtgaaaccctgtctctactaaaaatataaagattagttgggtgtggtggcacatgcctgttatctcagctactcaggaggctgagggagaagaatgacttgaacctgagaggcagaggttgcagtgagcagggatgccaccactgcacttccgcctgggcaacagagcaagactcagtctcaaaatatatatatatatggccatatatttatggcttttatttttatttttggtgcagtgtttacaaaaagaaacactaacaacaatttgtctatttaaaatagtgttttctgaaaacagtttgcttattacacaaaacaaaatctgtgcttatttacataaactatgcagtattttatttcaacctttcattgcaatattgttactacaacagatgatactgcaatttaggaacagtattaataatcactgtgatcttaactcttgacttaactctaaaatattctgaccttcttcttggcacacataacagaatattgtactcttaaatcataaataacataaatagcctcaaataaaaatatccagatgattattttatatttaacaaataatgtaaatctgttgtactgctttcctgtttgtggtttctttatgctatgattaaatattaaattgcttatagcttagtgcagcatttttcctcatactaagcctaaaatatattaaatatctaattttatcctgttcagaactctgatgctctcagtattgtaaaatctaattcatgtgcttaattcgctcatacgtctatcccctttgctatagcttagtatctggctcacagtaggggtataataatacaccaattacccagatctcacaatcacaaaaactctttgacattaatgatttatgtttaaaaagaatattcagtcatatatgacaatcagtacagattcaagcccatctgctgctttcaatatttacacaaatgttttgcaaagtgagattaaaatactgtccttagcagttgaaaggctaccatcttcaacaaaaactacagttgctctaattgtattcttcctagtaaggcaggaaatttaattatatatttttaaaaattgtcaacaatcacaaaaattgaaaattcagccagccagaatgctgattcttcaaccagtcttttcttgtaacattaactgtcttagatcatttccaggtctgtttaaaaaataaaaattaaaaaaaaaggagagacattatacctacttcaaagtgataatgtaagatttaaatgaagtaatatctcagagggaagaccttgaacttggaagtcagacagacctgaatttaaaatttattatgccaccactgggctactacattctcacctgaaagaggggaatgataatatctgtctttgaaagtttgaacttttaaagatagggtttgttaaattatctggcacaaagaaaacacacaattcacaataactattattaggagatgaaagtgactgcccataacaaatgtttaataaatatttccactactttttaaattacaaagattcctgatctgtaagtcacagtttcccattgtgtaacttgtagcgtcaattcggtctttttgtgtcaatttcccatatatacaatggggataataatactagtcctttttacctcgcagagttgctgaaataactaaatgaggcagtacaaatgaaagctctttgaaaaccacagggtagtattattaatagctgtgctaatacgggtaataattttaacagcacagataaatctggcattaattcaacaatgggccttcttactaaggatattacaatgatctattttcagaatagaaacttcccagtgatttggcaagtatatggaaataacttctgaaaggatgccaaggttggaatatcctcagctgtgtgtggtttccagcgataggacgtgaaaccattctaccttgcaaagatgattattactttattttaacattcatcaatttcttcgtgttttgaatatttgccaacttattttctagaaattttgaactatttctactaagagaggagagatattgtattttagctgtatcaaatgattatcattatgtttaatttcatcaagagcagagaatctagctattaaaaataaggaattttaagataaagtgcttcattgtttcaatagcacgatacttcatttagcttaaaataatgcaactttatttattggtgccctttacttgttttaaacatgcttttttttttaacagattaaatcccaagaggattaaatgtacaattatttatagcaagtttttaaaaagcagaagtgtatattatttaaataataattcccactggttaaataaagcactccaaaaaatttcaggtattttctgtatcttaagagcataatggcccaattatacatgaaatttgatattagcgtaatatcttgcagcttaaaaatcaaattgactttctttttctgcaatgttgtattgcgtacactgaatgtgtgcaatgtagcattagtatgaacctactttatgtagtgttggtaccgatataatttttggagctcttgaaattgttaatgtttgctgactttacttgaaatatacatactttagtagggcaagtgaggaatgaaatcaagataaaaagtgaagtatcttcatcaagtactaagtgatgaataatgcaaacattagccaaactgtcaagcatttaaattaccattctacaaagaaatttcccaacctcttctttctgtcaaatatgtttttatagatggactccatgagtatgcatgtatttaacttcaatgattttccttcagaccactgaaaactcttttattgttttgaccattacaacagattaaaggctggaaagagccgcatgcaggctttgccacctttggctatacctacacagcattaatttctggcacttatccccacttcatcatgttctcactcttgaacaatttccagcattatagcactattagaagtaacatctatgttggcacaggtcacagcaatatcactccaaagcaatgagctaatttaataatattgaaatagtattctaaaaactgagaaatttaggtgggaaataagtcaggttaagctctgaatttgggactcagacttgtttaagaactactgttgtatacagccatctaaaaagcaatgctgaggcaacagagtattagcaagttgtagaaaacatggttaccaccctcagttatgctcccagttactggcggagactgatatttaagtagacaatttcaaaaacaatgtggtaagccctaagaaattgggtgtgggcagtacacagtaggagcaaagagatgggaacccaattcagtttatccagaaggatccagaatgccttcatgatgatgggtcgtcagggcagacttgcaggatgactaagaactgttagatattagttcactacaacatataataaacattttaaggtttatataattaattatgcatgtccccatacctgaaaagggaaggatatgcttagaaaatattaacaaaaataattaaaattctttatgaaagtctccttgtaaatatttagttttacatgtctaatttgtagttttgtgcctcaagtgtagcattaattagctcaatatacaggtaatatatttggagttttacaatgggttctctgagcaaggtctagatttagtaacatattgatcttccctagtcccttttatttcatattaatttacctaatctatttcttcttctgaagcatttaaatcattgtatttctgttgataaatttttagatgatttccagtcttaatgatgatgggggttattgcttactattgccacttaatggcctcagggatatcagtctttttgacagttgaatagtgagtgttgattttttttttttttctgtagggcttttaggattaaggtttgaactcagcctctggatggcaatagttactaaatgatcattctgacattatcttctttacttaaatacctcaaatgttaacatcaatgtcaataaaaatgatgtcagttctaaagtggaagtaggctttgagtagtagtctatatcacaatcagcaaatccaataatggcagaacgttcccactcataagctaaggttatttgaagttcatgtcttttatttcagtccaagctttaaatattttctgttaactggtaatagtaatactccttttccaagaagtgcaatgtttcttataacattcttagcctcttgtctgttgagggcgttcaagtcccaaattatttaatgcagaattagtaacctcaaactttgctgatccagtttcatcttaacctttcaattaaaatgtctgatgtggaaaatcaatagctgcagttacataatctgtagcctttcatgagagggaagatggtgcaattatgactaagtcagatgtataattatttctttatatcctaactaaacttagaaagctaaacatggagcactgctttagaaattgctttgctccttacacactttcaagactttttaaataaaaagggtttcctactaattaatctttttttgctttgaaatttcatattccttatagttactagtaggacaaaccttaaagaaaataaataaaagtgaaatttgactttgtagctcctttacctcttttaatttcacttccttccctgtgttttttatatcctaggactggattatactctttcaaagctattgctctcaaacagctgacaactagccctttttaccattaaatttatagcaatttttccaaaaggtattttcatttgaacagatcttgaagacctaacaaatatctaatggaggaaatttagataatatcataagagattgtaggtagaaggcatcatctagatattctccaaatcattccaaattggaagacgtcgtatttgaagtacctcaatcgtatgattctctttctctccctgtaggcgtctctgcagctttctcaacctctgtcttatatccccttagcatttctgctgtgaataagtgtagttcaaacctcatgttcttcattaaaaaattgcgtgacttttggaattttgctctacatctctaaacttcagttttgtcattttaaaaacagagatacggaatttatctcatagggttgttgtaaagattccatggatggcaaatggagttattgctgatgaccttcagagaagccatgttgaatgcacctcagactgcttacataaaatgattaaaaggggagtatttatcctctggcccagatctcctattagttgagatttaaagtgttaaactccttgcactttcagctttgcacatacgtgaattcaaatgtctgcttgggttcccacaggtattccaaaagatagcagtagagaaggcctaagcacagaaacccgaaaaggcatgtgattgatagagccaagaaaaagtgctgtcaggttataccagcacagctcattgccgagaataagcatgtgggccaagggcatgtcagacagagctcagagatgctcgataaacccccttcttctcctggctgaggacctgtcatgcctcactgccaaagcttcactacttgtgatatttttaatattaataacttacgtactccatatgaaaataacaaagcaacttgaactattaaataaactcctttcacaattacctacttaaataaggttggagattcaagatatgggagaaagttcaaagaagtaatttgcaatcttgtaagtttaaggtagtgtgaagactcatataaatgcctgtattcaaattaataatcttccttcttcaatttacaaactggtggtttggtggtagcttcttagtctggtttagcctggatttcctcctctctgagaattgggaaattacatttttgttgtgcatgtattagccccttaaaacattaactgtatgtgtaaagctcattgctgtctcaactggtatttgttgtctttctgactatcttggggactgttgcgaggttaaacttgggtaacttgtgaaagtagagacccagagtatgttaatttcacttattttcctccactgtattagagtattattattataataggtagccatgtcatcacaatctttaaagtaagtccctttcttactttctaaaatcaagtaaggggcccatgaggtttcagtcatttatctattttacctcaccactgaatttgcaatggggcctcaactcagagtctaaatttgaatgttgcttttctggtattgactctccattttaaattctcattactttttctgtgtaagttaaaaatctcattttaatattctgctacccttccttcctattttctattgtccttttccaaatataaccatatttatcttaagttatggaagattatgcctttgccctaccagatatttgcttccattttgttcaaagggtaccactgagctccttagtaattcaatgactagatttatgatggctttactcacagagtagctatgcatgaaataataacgaaattcataaaatattaccattgagtcactatgccattgtgccgttttcctttcaaatattttaacattacaatgctaaataactctaataactctattgagtgaatatcctctctggattgtgactaaaaaaaaatgcagtttcccaaaagaattactgaatcttagttcttaccaatggctctatttcagaagctttaaatatagctgttatgtaatctggaaatagtagtgatttctatcagggatttaggcatagcttcactccctcatcaaaaagaattttaaagtactaattcttcattgtgctattttaggatctgtacaaagagaattatttaaataggatcccaacccctcaggacgttataatctaagcaagtactgccaaggaaaaacataaaaagacatgcaaaatatcaactggagaagaaagccaggaaattgacacagctaatcatgattttaagtatattttatgtataccgcatatatttttcagttcatgttgataagcttttgaggacagaagtctgaatttatactctttagtctatttagaatgtactttttttcttctttcttttttttttttttcagttgagacggagtctcgctctgtcgcccaggctggagtgcagtggcgtgatctcggctcactgcaagctccgcctcccgggttcacgccattctctggcctcagcctcctgagcagctgggattacaggcgcccgctaccacgcccggctaattttttgtatttttagtggagacggggtttcagcgtgttagccagaatggtctcgatctcctgaccttgtgatccgcccgcctcggcctcccaaagtgctgggattacaggcgtgagcgaccgcgcccggtcgagaatgtgctttttaacatgatagatactcgataaacatcttgtgatgatgaagaggattatttaactgtaaagctgaagcttctctgagacaagggatatgaagaagcagaaggaggaaagcaggaggaggagaatggaggggaaaggtgaggaggaggaaaaataaccttaatattataaagcaagatgagatgtgttctggctatgcttatgtggtaccttgaagattattggatgagtctatagtttacctggacaccaagtctgccttgaaagatagcgttttagctcaggaaatcttaatattcttcaaaccagtatacacccttttaattacaaacatttttaatgtccccaaaagcaattatttcagaaaataaataaataaacctgccagcctacactcaaaataacataacttaccagcatcaaaatttaaaaactcagtataactatctaactgtaatataattgagacatatgacaagtaattataatggaataataagcacttcaatatttaaaagatataattaagtaattagatgctcacacttatatgcagaatgaccataaatgtgagagtttcaaatgaagattaatcaagtgtgtggtatgggtaatttgcatattgttgctaacaaaacacactaaatttgttcatagacggtttttaaaatagtgaactggtcttagttaagttccagcccaaacagaatataatctatcttcccccaatttacatgatgaatatattcatggaaaactcagtgtctattataagcctgcccaaatacttttcatttgtacaaaaaatgttatttatagaatcaaataattacaaatagagtttttgctcatgtgaatgtctcctaaagcatttgaatgtcttgaggaattcaggagattttttgttttttctatctgaggcagtccttagatctgcaatacctgtggcctctgtgtgtgttagccactcaaggccatcagaatgactgagctgagtggtttctcagagatgtccaagtggcagcagagaagccccagggcagagtgagaaatgtattgtataactgagtggagacaggaaattcatagcaacagctaaagaaagaaggtaagcaaagtgaaggggggacacaaaaatatgaaggtgggatatacctgtatgttcacttcctgtgactactgtaacaaattatcacaagcttagtgggttaaaataacagaaatttattcttttatagttctggaaccaaaagtctgcaatccaggggacagtatggcctctaaaccctgtaggggaaactttattttttggctcttccagctttctggtggctccaggcattcctcggcttgtggcagaatcactctaatctctgctttgggtcacactggctcctcctcttctctgtgtggctgcctccttctatatatctcttatatgaacatttatcactggatttagggcccatctggataatccaggatcatttcatttcaagatctttcacttaattacatctccacagatcctttttccaaataaggttccagggtctaggacatgtacatatcttttagggggtcaccacttaacccacttctattccaggctgtggttttgttatgcctcattgtgacaaccagaaacactcctacaaatattcaaaatgcatctatgtgcgcagaattgctccattgagaaccacctggtctgcctagtttttccgtctacacctttccaataaaaggtgtgaaatttcaagagcttttagcacatataatttactctccctcactgtttactaatttggtttggactgttcctcataatgctttgcctttgttcttttagatatagacattttttctgctattgacatatggcataatcaagaacaatatggctgttgagaaaggatttaattcctcttactaagatgttatcccattttactggtcaaatcacttaaattgcctatgactcatttctcacatctgtaaaataaggataaaaagttttttcctcaggcatgtgctatcattaaacgaaattatggaggcagatccattagtaacacataaaacacaatgtaaaaataaagtgtatttgttacaatttgaattgtatctacatatttagtgaggaaaaaatgctaaatagattcacaaatattaactattatatctccatttaacatttttcacaattaacatattttggggatgcatatagataataatacgtgagtagaggctaataggtatgtagacaatttaatttgaactggaaaaaattatacgttttttactattacttccaagtgtctgagtgattattttaagggaaatagagctttctaaataatccaagtacctttcgccttttgcaaaaaagaatcttctgaactcaaagtaggtaaccacgaaatatcccagactgattagcgacttttgtctcttcattacaagttagccttagagcagacagtattcaaaagagctttggcattgcagtaatgctaatgacatgtaatgttgaaaactttaaaatgaatatttacaaatgtacaatttggaacatactctgacatcatctccgtcccctctttgctatccctacctggtgtcctgggtcgcttctgcaattctgctaattagcatcacagaaacagctatcaaagtcagagtgtcctggttatttttctctatagcctgcacagataagatcaagtaaggtcaagctgtcagcaggagtgaggcagagttttgaaaccagtatcccattgtctgcatttaataccacctggctcttccagagcagagaatggcattgtcatcaaaatggttttgtatataaatagtcccaataattgatgagtgattgatgtttgtatatgtgggttgtgtattttaaacatattctctacagagatgaaaacttaaaattccttttactgcatgtaaatgattatccaaatatctcattaagtttatgattttatttgaatcccatggcaaaaaaatgctaaaatctttcattgctattgtaatggaaacctggtctaagagcacatgtcatatagtcacatttatcttgtagctcaattttaatctttttttattgtcacagagaacagttagaaaattaaacattttaatttcaaaattaagtgcttatgaaaaatacaaaatgtaaatacgacaaataatggtttattatcctaatcaaagacttctcctagcttagtttgagagtaacatatacatatgtatgcatgcatgtttgtgtatgtgtgcatatatgtattcatgtgtgtcatatttgaaatgcttgtatgtgaatgattcatacatgtatgtataaaatctggtcactgatgatgatagtccactgaatgagtctagctgtcagatttccaaatgattgtagtagttttccatttcattttagcttttgtcaagactgtgtaatcttcatctacagactgccgttgcttaggataaaagagtgatacttgctctacatttgtgggcactggaaaatcttaggttcttccatggttttattgttttgttttcaaatatgacagaacttacttataattatgaaaagattactaagctaaaatcaaaggaacttaagtccttgaccatttatctttctaatcatggaaatcagtttaacttcattgggccatagttttcttacatgtacaatgagggcattaaaataaattatttctaagataatctctttggtaacataaaagatatgaaataaaatatgagaatacttaagaggcaatgcacagctgaaaatattgagacataccatttttattcagatatttgaattttctcactgtgtctaggcataaaattaaacttaggtctgtgtcatttgtaaacagatgtttgttccaattcaataatttagtgatgatataagaaatcagagtaaagtatcatcaaacattaaaaaaaaaactggagctataaaaggcatttctccaagactctagactctggtttctatggaattgatttattagtcaaggaaacatcttcagtttgtggagaaaaggatagctatttctctcctggctcctcaaaaagaaatcattcgaaattcagccctattacagcttttcttaaaaaagggaagagatgtgagaaaatgagttttccctcatcttcactgattgctagtgatttaaccagatagtaaagagaaaagaagcccatacaaagttaatacaataagagtagatcatttcctggttgcattgctgagaattgtggttctctgcttcaagtcagaggcagattcttttgggttttgagttattctttcaactttaaaggtaaatttgggccaatcggtgtgtgttttcatagatccttgctgctgccagtaactctgccttgaaaacactgactgcagctgtgatttcaggcattaatgaccaatcacaattctgaaagccagtgttcacaatgtttaaagcgccttccccttgtgatgtcatctcaatttcagaggctttatttattccctggaaactggctgttagcttgatgagcactccccactgagaaatttactttacaacttccttaaatttacagtggaacccttacagagcaaattgcaggctttctccaagaagtaaatagatctaaagtagaacaactcttttggcaatatagcaccaggatgagttaacagtttctcacacccagtctggatacagagtattaaattacatttggcctgactccatcattgagtgtatcttaagtgatatttttattcaatagctgcttttaatgagattttgatgtttcaggaagtttcattgagtcaattgcaatccaatgaatgtttccgtgtcttcacattactctcactgcttcaaaactgggggaggtgttttcttgcacagttacattagagttttgcaatatggaaagaggcatggtattgactgtccaagaatgtacacagaagtaagagtagctgattgaagacttactaatgaaaaacaaaaactaaaaaatatacaaaatatatgttctgatgagtacacatctatcaaatcctttgttgccacaacctcactaccaaaaccttcttttagaaattttggaaaggttcgttttatcttaccctagagcaataatttttgacaaataactcctcaggccttaccactttctaccttctattgtgcccaaagattaccagttttgtctgtctaccacatgctgaaagggagttatctgagacattagctgggcattggttttgctgtgactgtggggagtagaggtaaacaggtgggaggagaattcatctcagcattttatgttttctggatggctgtttttcataattgtaagagttattctcagtgatagggagaaagttattgccttgatttgtttgccatcagttttcaccttccaggaagaaaatctctttggaaaacagtcatttgtcatcattgaattgtattgctggccaccagctttttgcaattctgttcacagctttgtgtattgcagttttcatgtatttatcaaccacttattcatgtgttgaaacagatttagcttccctccacatattaaaggataaacaatatactccaagttacttaaaagttaggtattgacaaactcattctcatccactctttctgtagaattatggaccatgcgtcaggctagcactagcagctgcatcttcagaaatgaaaaatggaacttctctctcttcctccaccctactaaatgttacaaataacttctgactcgttcctaaaataaagtcaagatattttttcctcctgcctgacatgattagttttggagttctgttccaatttaccctgaccatatcctctcccatcttcaatcattcaagaacattttcttttaacttcttccatttattttttgatgatcttaaacagtttcttcaagaaagtgcgttattgtgggctattcaatataaagaactataacttggcaaactataaggatgactgagtcaacaaaaaattccctacaattgcccatattctctagtaaataatagttgttatggaaaaggcaaggtttgaaaaagtttggttttgttgaaataaagggatactttgttcctgtatccaaagcactctgaataaaaaagtaataaaaattactttgttaataaatttagaggtgtccagtatcatattaataaatcaaacacaatcatatttccttattgtaatcagtcatttaaaaataataactaaaaataatgtattgccatgtataagtattataatggtaaaaaaatctttgtttctgcttaaaatatcacaatgttttgtttcagtttttcagataccaaatttccttaagaaggacgtgcattgaaatatataaagctgtatttttacaaaatggtttcaaggattgtttttctttgataggacatgcaggaaacatagattttagcagaatctgtaaacaagcagttcttaagtgtcactaatcataaacaaagtataaaatagcaaaagcaataaaaactatatagcatacaaccttactaaagtcaatattataagccttacaaactcaacagttaacatcatgcacggactaaaatttctgcctatctgtggcttcagttccttagctccatgactgcagcaaccccaatttccactcattttccttggtattaaatctttctctcaggcagaactatgtctaattaacctttgaatatcctaagcttatcctagtgtcatcagtttgacatataaatacttttgaaagaattaaactcctctctaatacagttctttattctcttctacctaacaattgtctttgttcttgtgttgcccaggcccttgcttatgccctgtgctttcaattagccactctctttgggcttcccttctgttccattcagactggactccagtgtcagtcatttaaaacatatgacaactctcaccttgaaattttcttttccctgcccttctataatgcttgtttccaagtcatgaaattatctactatctttgttatcacattctggaagtactcacaaaaccacactaaatacaacacattagaaagccaagctgtcaagtggatttccactgctgctggaaaaatcccttttatccttcatacagtggtgattcttcatatttcaatccactcacccagcaaggtggtcaagagtatgggcttgggagccagtcttagtttgattcacagatataactctcacagacagccttgaataagttacattctctaatgatacaatttcctacatttaaaatgggggtatttatagtacatactccatggagctgttggaaagattaaatgagatagtatacgtacgctgttaagcacagttcctggaaaatagtaacccctaaacaaatagtagctatttttaaattgattactgcagttagaaccaaccaagtggtgtttgtttaacatatcaattatttacagaacttccacttcttttctttgtacacctgactgagaccatctttcttataaacatttctcttttaatgtgtagttttggtcccttgattattctaaatttcctagttcctcttagtttcatttccatctttaatgtctccctctctactacttagttccttcccttttgggtggcaaacatgctcaatttcttcatttcctctctgtgatgctactattccaagcttccacaccatctgtccccctgtcttgctgccaagcttatggaaatagatcatatcttgatgtcaccactttctcagaagtacttacttctcaaatttaaccattataatcaggattcagtgtggacttattctatcgaatagatcttttgaatattgttttgaaattattctctcctaactatggttgtccttcaccaaccatgccctccttcttgcactccctccctatttggcttccacgtcatacagtcatcatttacttctctttttttcatagctatttggaaatttattccttttctatatctagttctatttccccttcctcctttcacctttcaatagtaatatctctcatcagagacaagttctatttttaaccctgttgctctctaataatttcattcattctgaagtttttttatctcatctccacgcagatgattcttgaatatgaaattcttattatgacctcacttctgaatttgtagctcaaaatttaaattgaatgttttacctctccactttgatttacctgtagcatttaaatcaaatcagaaaatatcaatttattatacctattacttttccactgactctcctgtttctattgaagtaccactgttctcccagttgaaatttagtcgtcatctttaacaccatcctttgcaattgccccatagtcaattatctgtcaggtctgtaaatcaccatatatttctcatgtccacattcttccccactcatacttcctttattctagttcaggctcttattagtccttgctggactttttcgatagcctcctagttggtatttctgcatctaatctacttccttttccattttacgttttgctgacagtgtcccctgtcatcttgaaaactttcagactcatttaagtcccgactcttattcctgtagccttattctctatatcaccgttccagctctaaatctctatacccatatgtaaggacattccatgtcccatgtacagtactcattgtttctcaaatgcttgtctcatttgattgtctccactattttctcttaggtttttgtctccatctgaaattctactttgtcctatatgattgataaaattctatgtattcttcaagacccactcaaatacaatttttctgaagtcttccctggttcttccaacagtatgacagctgtttattttgcatgtcccaaacaatgtaaacttcttagaatgtaaacttcttagaaaaccagcaggggtgctggtcttagccagtagtagtcttaaccagtttgttaagtgaggaaatctcatttttctttgtaactctcataccatatagtaggctctgaggaacaataataaattatattattgaaattgacttattactaggaatatgattaaagataaatagaaaggtcatagagaatccaaaaatatcataaccaattattgcatttcactttacttttgaacaggtttaacaatttatttaaatataggcacccgcttctgaaaggaatttctaaatttgcagtaaatctgtaaagttaatattttaggatgttctcaaaatagatgccattaacctttatccccaatccactttagccacccattttcatgtcttattctggccttgccacctcaaatatcctttacatctcaatcataatatcatatcccaaattcaactctttcatatattttctttactttatttagctttccaatccactaactctaccattttttttctactttatcagctccttcctagattcacttctttcactttttagctctgaccccatgatttgtccaggccaaacactttcttgcctttacactaaattagcttgtctctctttatctccaatagccaattttcaaaccactgaatgccttctctatgccagatcatgagctgtcatatgagatcaaatatatgtacagattgatatctctattgcttcagggaagccttccctttcccttattccatctcattttagctcaaatattacttcctctgggaaaactttgttaatcaaacatgccaagggcttgcaggctcattaactacctttcttctgtgttctcatacgagtctatccatagatttcattcatttcttcagaaaaatttcagaatatttttcaagtctgtgttcatggacttgtctggatgattgaaccacagaaatgaacaaagcaaacaaacttcctgccattctagaatttgcattctagtgggaaacatcaaacatataaataaactcatgagtactattaatataatgtcaggctatgataagtgataggaaaagtaattaggcagaataagggaatatcctataatatttcaagtgaagatcttgtaatttcttgtgacaattcaacttccactaccttacctataattctagggtaataatatgacagaaaagggttccttaagaagttaaaattagaacaaagaaataacattacaagaagctaacattagaacaaagagctgacattaaaacaaagaatgaagctaaataagtaacttatgtgttaaatgttaaattaaaaaatataaattttccagtttaaattatttatttacatattaaatttttaaatgtatttattcattccatttttattgaaagttcaaacagttttgtatttttttacaattcaaattattcttacataagaatgtttagaattttttgtctttctagttatttttgcgaggaaattcctatagattgaatttatgatataaaagttatgcaattcaaatgtcaaacgtttaccagcaactaacacatgttaattgctatggtaggcaatttctacactatctcccaaattccttgtatttatgtccttgtggaatcctacctgcttgagtgtgggggtccacctagtaactcccttttatgaatagaatatgcaaaagtgataaaattatgccttaaatattagtttcaaagacacttttgctacagtcttgcccctcctctccctctttcatctgctcttattctcccttttgtttgccaggagggaaacaagctatcatgttgtgagcttccctagggagaggcctacatagccagaaactaagggcagcctctggccaatagccagtgaaaaaaatgacacctcagtccaacaatcagtggagaactgaattctagcaataaccatgtgattgagtttaaaagccgatcgtccccaatttgaaccttcagatatgatcacaactccagtcttgactgtggacttgtgagagaccttgaggtagagcctcccagctgagctgtacccagattcctggcacggaaactgtgagataatcaatgtttgttgtttaaagaaaataagttttggggtactttgttacacaacaataaatacttcatataattgctttttttctgtgtactgcatgccacctgcataatgaatgaatgaattgctgaataagtgaattaaatacatgttcaagattttgtactgctgtcattcaattctgttttttttgtttgtttgtttgtttttgagacacagtcttgctctgtcactcaggctggagtgcagtagcatgatcttggctcactgcagcctctgcctcccagactcaagtgattctcatgcctcagcctcctgagtagctgggactacaggcacatgtcacgatgcctgactaatttttgtatttttagtagagacagggtttcaccatgttggccaggctggtctcaaactcttggccccaagtaatccacccaccttggcctctcaaagtgctggaattacaggcatgagcgaccatgcccggcctcaattctattttttattttatgggaaatgcatacttgctgatataaattagttccccaaactgctcaagattaaatagaaccccttaaacatggagaagtcaggtctgaacaccatttacagttatgtttaaccacccactataatttcaaagttttgatacacttcacgataaagctgtatgcgtttggaatccatcagaaactaaatcctcaatctgccacttactagttatatgatgttgggtgagttgctcaaccttactacataaccacagtttcctgatcagtcaaaaggagattatattacccaactcagatattccactcaatattatattctatataatgattgctcaaaaataatcagttttttaaactcatccttctaaaactgaaaatatgagataacttctccaaaacactttttttcagtaagctatggataattctattgtaggtaaatattaaggaagggtgaattatttcttttaaaaatttttcttatcccaattcaaataaataaaataaatgtctagaaggagaatataataaaaattgccttcagacacatggtacctcaagctaagagtcaatcctcagtcaaaacatattaattgtttatatgacttataagaaattttggaaagttgccttagaaaaaggaagtgtttttgtttgtgatcttacaaactgtatttctaataataatcttaaaagttctgtttactctagaaatcattattttccactttgcatcacatgagttacttggattatgttaatcaatatcctcagcaatgtatcccagattaaatcaaacctagatttatttcatattttaatgtagaacaatgttatttacttttctaaaagttggtaaatcatagctgtttctaatattatatttaaacatttagtgccatgtttcataatgtatggttcattacccacatgaattcttgtggttgcaaactgatttttaaaaaatatgcactctagtaccattaatttacactgtttttcactcttatgttcacttgagggctatactagtaacttctcaagagagtaaatagagatcattataatttggcattcacaacctaaaattagggagtagcgttcacttagcattgcaatttagtgttctcctgccatgtaaaacttaaccattttacaaagctcattgtatacatactagaattgtcggaattctagtaagttttagaaagaatattttgttataagtacagtataattgctgtcttgtgttagtaatggtatctattttaaaatattttataggcatttatttatttttagcatagagatagtattaattttgaatatgtataattcctgcataaacatttgatttctttcaatatttttcttatcacagattacttttctacaggtagttggtacatatgaaacacacacacacctgcagttacaaaatgtggagaaattatctagatcaggatttccacattagcacttatggacatcctaagctctatgaatacattctggaaggttctatgacagatgttaagttttgtgttctgtatttcaaagataagcgcaaagggaattaatccactcgtgttctggatcattttgtgagcatcttttctcctaagaattttgttgtttgcaattacttgttgttttctactgcatttgttctgagtgagagtcaaatgaagccaaggaatgatataaaacaaaagttatgcatcagttcagatagaaaagagatcagagaatggaaatattgtatgggttaagagtgtataagcaggaggccgaggcgggcggatcacaaggtcaggagatcgagaccacggtgaaaccccgtctctactaaaaaaaaaaaaaaaaaaaaaaatacaaaaaatcagccgggcgtggtggccggcgcctgtagtcccagctactggggaggctgaggcaggagaatggcgtgaaccggagaggcggagtttgcagtgagccgagatcgcgccactgcacttcagcctgggtgacagagcaagactccgtctcaaaaaaaaaaaaaaaaaaaaaaaagtgtgtaagcatgctaaattgaaaaataaaaacgtcctgcacaactgcagtaaatatcatgttcaaattgtgagtgcacgaactgtgtccactcttagaacgtatcagcttactgcagtttttagtaacaagtgccatggcaaatgtgcataataactgaatgactttcacagtgattcaaggacgacacaacattcttaatattaaaagataaaatcaatagcaactgaaaattaaaaggtgctaatacagcttcatattattaaacacaacctggtcagtttaaattcaggaaagcaggtgcatgtgccatgttaatgttatttaaattgtattatttaactggaactttctggcatttttactacgtaaagtaaaatgaataataaatttattcctaatctttataaattattgttgcatatctttgtacgtgtatattttattacataaatcgatataagcaaatactatgcatacttttattattattattattattattattattattattacctatgttttaaatggattatttggtaactcttgcatgagaaatcctgctctaggctttaaaacttttcaaataaaaaccagagtaagtaataaaagtaatatatttaccacaagcatatacatacacattcatacaaacactgaaaattttgcaagtttttcatttgcagtgtaacataaaaattataaagttcaatctgatgtattttattctcttccatttcaattataaatctgttcatagcccattgaattaattgaacagcctaatagtagtgaagccacacaatttgtaaaccactgcttgggagatcttgccaaacagttcaacagtcttcacaggctatcttgacatggatcaaaggtccaaaaatgggttaaatagaagactgaagtttcaacagtagaaaaggaaattgttaaaagctctcattaatgtacaggattaatataaaattcatggaaaatgattaatgaagcatggaatttaggtgtattttaatgtaatcaaatgtgagtgagtgtgtgtgtgtgtgtgtgtgtgtgtgtgtgtgtgtattcttgagctttaccaaggtagaatagcacataagtctaaggtcaaaatcctagcttaagagtaattttgtcagagtgtgctgatacgcataacttatctctagcaacagaggtaagtggaggtttgggattctagtagagtggaacagaaaaaagacaatgaattgtaaataaataagcaaatagaggaatttagtccaaaacagtggtaaaactgatggagaaataagtcccattgtggttagaaataaaggttatacagcatgtacaagggcataattactcttagaaagggtttaaaaataaagatgttaaacctaagcccatttgtcttattcagtcactccaattccagctggcctgaaagtaagcagggtgtttacatttatgagtattgtattcattctgtttatacaaagtaaacagctcattactgggatcatgtcccctgtatcctgagtgttgtgaaccaaagaaatctctcaggtgtttccatgccacaaataacatgtttaagctccatgtagggaaaatatttccaaacatgctactggaaagcttaaagaaggaacctgtcctttccatatatataatttgtgtaaagatgcttaaagttacacagttatagaatgaattgtttaaattactgaaatacaattacaatctgtattagtgttccctttattggactttgaaacacatttaaaataaaatttaagaggaaaaattacatatgacataaagacaaatagtaaaataggcattcattatgccaaatactctatttctctttaaaactggaaatattaaatgacatggtcttaaaaagtgtaattccctctgagtttatgtaaaagaaaataaataaaataagtaaaagtcaatctactggaaaataaaattattcttagggtttaaattatctggattaaatagccccactgatttactaaatgagataatttaggtatctaccgttttatgaatctcagtatatatttaatatctcaaaagagattgttttataaaatatcagataataatcagcaataatcacttctgatatctcactaatagagcactttgtatttctggttctctgtgttataccttctattaacttactctggaaaccaaatttaaaactatttgttgccaaagtggagagaggtttgttggccatgctcatccttgtcaacttttaaaaaaattgtatttattcttcctttaatttttaaaacactactctagttgaatagtaaaaccaaaacaatagcaagtagtgagcatattaggattacagtcctttgctcattcactactgcccataaaatgccagcagcgagtattatcactggtcccattaagatgtttgacactgaacacctctgaaatgatgtttatcatcctcatgcttttccattgtaatggtcccacatttgcttctgcactgtagtggcatcagcatcatctttcctgatttgaatcaaagtccacaaattctacttgattcatctcatcagtctcttctacttctttactcttttgtaggagtttttccagcaaggagtttgtcaaaaaagggaaagccattatcaagaaagtttaccttaaattcaatgattaagtgactcttcatgtggtctacaataaattggcctgccttcatttaacacatgcttgatggctccatgcttgacagtttgacctggatgagagatgatgactatggttcagttgtcaagagtggatattggttttcagaagccatgcaatactacaaccagctgtatatccatacatatgaaaaggtcttttctttgtcaagtaaaaacagcatggtccttctgatctaatgcaatgataatatctcctggctccagtcctggtttttggtctctttcatcatgagatgttattttctggccatctttcatgcttttgtcaatatgaatttctagaatcgtcttctcccaaaactatcttctttctgttgcagcttttacatctatcttgaggactgatctgttccccatggccctgggtctccatgcacacagcttgaatttgctgagctattccgggttctatctgatgaattcttatttgcattccaataccttggcaattatgacagcactgtactgttccttttttttttccccacctctgtcttcacacctgtcacaaagcacattattttgcagagcctgttttcttgttgcagcatcatataaatcttctaaggttactgagagctggtgtacaacacttttacatttccttttactctgcatccttcctcctcttcagaaaccaaaaattggctcacaggtgcattaaaaatcctttcacctataagagacatcaaagattcaggaactgaggttgattagaatgaataaatgaatgaatgtaaatgttaccatacaatctacttgaaaaaattcaaatcttacttttcctgttacccttcaccaaaaatagtaagaggaaaaattatagcaaagtatgaataaagttagcttttgttccttgaataggtaaaggttgaatagagaggacaaacacttgtttataaacacattctcttttggaaagagcctgtttgccagcccctgtggatttctttgcccaggctacgataatgcttacagtaaagaagaaaagaagagttgggcatcagccacaatggtggctaaactttgaattcaatgcaaatttttcaccatttttaaagtaagagtaaggaaaatcatgtagtttctttaatagccttggacattaaaatgaaaaggacaaagaaaagggagggaaagggtggcaatgggagaggaggaaggaggagaaaagagaagcaaacatattgtaaatcaaattgtttaatttttaaaaatttgttaaagagtgaccatatttttctactaagatttaatttttgtaaaaggaattaggaaaagtatgtttgttagatacatgcgcaaatctcaaagactgctcttcagttgttgctgctcataagcttctatagatgaagtctttgtatagaagcttaaatttgactggctgtctgctggggtctcttatattcaccagcttgttgttagaagggtttatggagaatacaaaagctttattatctccccaggctgctctagtcattctgataccgaactgagactagaaccagtacaatacatctcttgcttggcacacctgtatagtgttaacaggaaaaataaattgcagaatcatttattaacaaaattgatagagtctcacacagggcagagtttcatctcattcttgtctagcagggccacagaaaatatgaagcttgaactaataaagaacttcaagctttatacaattaagtttacacattaaaaaatttaaaatgttgtcttcagtatgcctaattctacaatccgtagtgtacctaaagacgaatttaagatctggggagaactaagtattaggtaaatgcatatcaaattggccatgttcaacatttatattttttaaaaatggcaattccatatggttctaacaaacacatagtgaaatataactacattttatgattttcatggtaaataatgtccatgttaaacctgaaattttaaacatcagtagtgaatattaaatgtagatagctttgcatatacacattggagatttggccactaacatttattttctttaatagctaagcaccatgcttgtctacaaaaaatgaattgacattactgtagataatctaatgcatataattactagtttttaatgtttattacattatgaaacattcagtgggcttttgaacctaagggaaaaaaaaatccatcaaaaatgagaggatggtccaaattttaagaaaacaaacaaaaccatgcttcttatgagtaatagtgatcagcagctcatcaatatttttttattcctctagtgcttacgttttatttttattgcttttattttaatattcatatagtaataactagcatgttattcatatagtatctacctcccttatctggaatacttgacaaagtacgctattatttctttcaaaactactgaccattttaaatttcctcctgaatctctgcaaaatatttaaattgctatgcttaacccaagccactgtttattttttatactaagttaatgattcatgggatggattaactagtgcaaatttaaaatctctagctaaatccttccaaactctgagacctgagtggaagaaatattcttttgcaccaagaacagtctacagggtgctgacgttagttcaaccaaaataattagaaagataaatttgctaaatcactgtgaaaactaatgtattactaataatgtactggaaaagaggctgtttcattaaattgaattcccagattatctaaatatttggttaggctatattgcataaggcatgaaagactatggtctctgcggaaaagtggaaatatttgctgtctgaaggcaaatttttttccaacagtgttaattcattctgttgtcttcaatttgctgaactattacctctttttattagtactcaaatcttcccaaattatttcttgaatttcatttttataattatttaagcaatgaatcaagtagttcttttttcattgagttttagaattcaggatattcattatattcagtactacttcatggagtcgtttttgtttgtttaattttgttttatgcataatgaacttggtgaataagcatgtgaaataattaattttatgcagatatcagaaacaaagttttaccttaattagaaggataatcaactaatccctttttaaagaattcacaaaattcctgactcattgtgatattttcatgttggctctgatatattctttgggagaattagaaaaccaatgacacttataaaaatttcagaaattatagaaaagtctaaaaagtaaaatgaaactaatatcactccttgtcctggcaagatttcctcacaatagttttcttctagattgttttcctctttctgtgtgtatgtgtgtgtgtgtgtgtgtctataggcataattgtgttttaaggttgttcgtattattacttgtacacaaagattatcttccttttttcattttatactacatccaagtattttccaagattagtagctattttccaagatcattaaaagctctttgaaagacataattttaacatgaacaattatcatattttccaagatcattaaaactattttccaatatcattttccaagatcattatgttccaagatcattaaaagctattattttccaagatcattaaaaggtctttgaaagacatacttttgatgtgaacaagtgtcatatttaagacttcaacctgatttacttaatcagttccctgtggctgaattttttgggtattttcaacttagtcaatttatataatatggattacaatatttgttctccactcttttctgacttttttatcatttccttaagacgacttctgagaagtagaattataggttcaaatgatatgagaaataagatatttaaaagtagaaaaataatatatttaaatatggcaaatatatgtagaataaacgtaaccatctttaactccttttaatcttttacctcttagtcaaatactgctaagttttatgtacatttttatatatgttatctatgctagatcagtatatccaaatatacaaatttattacatgcacttttttattttatgatttttattattatactttaagttctagggtacatgtgcacaacgtgtaggtttgttacatatgtatacatgtgctatgttggtgtgctgcacccattgactcatcatttacattagatacatctcctaaggctatccctccccccttgacccactccacaacaggccctggtgtgtgatgttacccaccctgtgtccacgtgttctcattgttcaattcccacctataaatgaaaacatgcggtgtttcgctttctgtcctttcaatagtttgctcagaatgatggcttccagcttcattcatgtccctacaaaggacatgaactcatccttttttatggatgcatagtattccatggtttatatgtgccacattttcttaatccagtctgtcattgagggacatttgagttggttccaagtctttgctattgtgaatagtgctgcaataaacatacgtgtgcatgtgtctttatagcagcatgatttataatcctttgggtgtatacccagtaatgggatggctgggtcaaatggtatttctagttctagatccttgaggaatcgccacactgtcttccacaatggttgaactagtttagagtcccaccaacagtgaaaaagtgttcctatttctccacatcctctccagcacttgttgtttcctgactttttaatgatcgccattctaactggtgtgagatgatatctcattgtggttttgatttgcatttctttgatggccagtgatgatgagcattttttcatgtgtctgttggctgcataaatgtcttcttttgagaagtgtctgttcatatcctttgcccactttttgatggggttgtttgatttttttcttgcaaatttgtttaagtcctttgtagattctggatattagccctttgtcagatgggtagattgcaaaaattttctcccattctgtaggttgcctgttcactctgatggtagtttcttttgctgtgcagaagctctttagtttaattagatcccgtttgtcaattttggcttttgttgccattgcttttggtgttttagtcatgaagtccttgcccatgcctatgtcctgaatggaatggcctaggttttcttctagggtttttatggttttagatctaatatttaagtctggaatccatcttgaattaatttttgtataaggtgtaaggaagggatccagtttcagctttctacatatgcctagccagttttcccagcaccatttattaaatagggaatcctttccccacttcttgtttttgtcaagtttgtcaaagatcagatggttgtagatgtgtgatgttatttctgagggctctgttctgttccattggtctatatctctcttttggtaccagtaccatgctgttttggatactgtagccttgtagcatagtttgaagtcaggtagtgtgatgcctccagctttgttctttttgcttaggattgtcttggcaatgcaggctctcttttggttctatatgaactttaaagtagttttttccaattctgtgaagaaagtcattggaagcttgatagggatggcattgaatctgtaaattaccttgggcagtaaaaatgaatcatgccataattacttcacatttaatttttcccatttaacaatataagtatttttccaagtcaataattataaatgaaacacacatgttaatagctgcatactataatactacacaatttgaatatatgcttttttatttaacaattcttattgattggcatttatgttttttcaaacaatgcaaatgtaagcatgagatatatatccacatatactgatgcttttttttttctgtataatgtgctcagctgtgggatttgtagaattttaacagacaattttaaggttgtttatattacttatacacaaagattatcctcttttcactttatactacattgtaactattttggaaaataagtatttaccaagatgattttattttggaaagtaagtattttccaagatgattatattactacttggacacaaagtacaataatactgaatttagaaaagattttagcaatcaagttgcataacagactgcctgttccctgtatgaaactgaattaagagatgtcctagacattattgaccttaagatcttactggaaaaaattctcttaaggagaatttctttcaaattttattcttcctattaatgattttaaatatgttatatgttcatttctaattttcatttcttattccataaattgcatttccatattttattggtttgccattttattataaatatctaggagctctttaatattaaacattcttaacattttttctgtcataggtatacaattattttctttcaaatatttgttcttttattctgtttattatgctttctgccacaataaagtttttttttccattcatggagtcaactctttaaattttttgattcatggctttttgtttcttgatatttgtataacctcactcaccaggaggttatacaaatatttcacctgtatctatattttatgcattataatttatttaaaaaaacaaaattttctccagctaatttgaaaaaatggtctaaattaacttattacagagtattagctaattgttctaatagcaaatactaaaatatccattaattcccctcaagatttttcaagagaagaaattatataactgagggtagtccataggaggaaagtatgatgttttatttaccttattatacccagagcctgtcataggagatgacttttaataaatgtttaatgaataaattggaaagaatcaacaaggagaaaatatggtctcattagtaatctggtaaaggagtgtgttccaataatctattgctgtgcaacaaacccaaaatttagtgtcttcatatggtgatgttttaattgtctgtctcacacctctgtgggttggtgggcctcagctacgtggtttcatttggaggtctttcatgcaaccgcagtcagataacacctggagtcgtcttaactagtgtccccactcacgtgtctgatgttctagctggaatggctgcagtagccaggggctggttcccccaagctaacatgctatgccttggatcctgattcttccccctccagtctcatttcacttttttcctttgctttgtgactgaactatatgagaaacatcaccactttattttatgtacatacaaaattatcaccctccacctacctaccagccggcctcctcccttcccaagacttttatgtatcattgcataatgtctgagcaaaagttgtgctgcacttctacaaaatgaacaacttaaaattaagtattagttaacttaagtctttccacttttctattattttttttttccataccatgtatgttttctcctcccttgcctctgttttcttacacatttcaaatcttgggtggttgtggggagagggtgcaaccttctcatttttgcatgaactcaaaaggaaaaactcaaaatttttttaaaagacaaacacctttgtttttgtatgtactccctcttgcccatattccaaattaagctcaagcttgaatactcaaaaattcaactgaaggttttatatcacttattataagatattaattgagtgtttacacacttcttcctttgtcactaatatctatacatgtacactggacccttgaacaatgagaggcttaggggtgctgacgccctgtgcagtcaaaaatccatgtataacttttgattcccctaaacttaactactaatagcctgctgttgactggaagatgtaccaatagcataaagcattgattggcacattagcctgttgttgactggaagatgtaccaatagcataaagagttaattgacacacattttgtggttatgtgtatcatatactgtatttgtatgacaaagtaagctggagaaaagaaaatgttattaagaaaatcatagaaaagagaaaatttatttactatccattagatgaaagtgaatcgttataaaagtcttcatcctcattatcttcacattgattaggctgagaagaaggaagagaaggggctgttcttgctgtctccatgacagaggcagaagaggtgaaggagatggaaggagagaaaggagaggcaggcactctccatgtacctttatggaaatacatcataatttctttctaacttttgctttttcatttatctaaaaatatttccatatggtaccaatcctttttccatcatttgctttatttcagtgctcgtatcatagaagggaccatgtcataaaaagcaaaggaattcttgaataatcagatactttctgttttctggcactggtttggaagctcccatctccataaagtcatcttctgttaattcttgtggtgtggtgtctattagctcttgaatttctacaaaatctatatctgaaaaccctttattcgccacctttttttgccatatccacaatctctttcatagttttcttggctggctctgttgtaaatcctgtgaagacatgtgcaacatctggatagttttctccagcaggaatctgatggcttccgtggctttcatggatttttctataagaacaatgacatcttcaatggactttcctggtgttctgtctattggggttctctttcacagcattgaaaatacttcccatagagtaacatgtgtaatgagccttataggttcttatgaccttctcatctacaggctgaattagaaacgtgtgtttcagggcaagtagaacactttgaggtctttggtattgaactcatggggttgcgggtggccaggggcattgtgcaatatcaaaagaactttaaaaggcaagcccttactaacaatgtacttcctgacttcagggacaaagcatcaatggaaccattccagaaaaaggattctcattgtccaggccttcttattgtacaaccaaaagactggcagctggtatttatcttttcctttcaaggctttaatagggcagtcctgattataaattgactgcatttgcacaaaatattacagttagcctattactttctgtcttaaatcctggtgctcgcctctcttccttactaataaatgtcccttgtggcattttttgtctgtttttttttgtttgtttgtttttgtttttgtttttcagaatagggcacttatccctgcattaaaaacaggttcagaaaggtgtccttttttctcaacaattttcttaatggtgcctgggaacttatctgctgcctcttggttaacagaggttgcttctcctgttatcttgacatttttaaagtcaatctctttgggaaaacattaaaccatcctttgctggcactaaattatccagctttagattcctcaccttcgtattactttaaattctcatataatgacttttcttttttataaaacatattaaacatgaaaaaagtaaagagggaaatgccaaggggagcaggaaaatagagaggatgttgggagaggtctggggctccagaaagtccatagaaggggctggaaaacagatgatctaagaagtcaaggaaggtgcagattcttctagatcattgatggtgctgtgaacaaatgttgataaataaacctaaacattctttcttatttttaagactcttggtgatagtggcttaaaagatgagaatcaatacagaccaggattaaaaaaaaaagatagtaagttttttatttccatttgtaaggccagatggaacccgctgtcttgtcctttactcttaatgtttcttatctaaatattatgaatgtcatggatgtatttaactctgaagctgtttgtcttttacacatgtaacctgtaactctaaaagtatacgttcttgagaatacaaaaatgcaattatatgtatgtaagtagatataataattattgttaattgcgtgtcacttctttttcatattattctggcaaaaaaagagaaagacaggtaattatactaaaattgatattgttcccaggtggaaaagccaagtaactagaacatgctttaggaaggtgatgcagtgaaagacataattggacattatcaaggacattaagggtatgtcacagacacacattggtaaggaaggaacggattctgaaatatacaataggaggtactcctcctaccacttggggagcttataccacagtggaataagaaatggcttgaaatattttatgactatattattttatttggaagtagaaatctgaatttctacatttttgaattgtatatgtgtatatatgtgtgtgtgtgtgtatatatagagtatataaattgtatatatgtgtgtatatatattatatatagtatatatataactgtaaatataagcagacaaatattcaggtttgatcttaacaaggatcctccaggagtcaagctaaaaacattgatttttttaaaactgtaatactggttaccttcatcttctatttcactggaaagatgacagctacctgggacagttttgcagagtaagattggctgatagaagtaaccttaggctcacttgatcttcactggtcacgtcttagttccttcctgtcttcactcaagaaggtctttggtaaagagaccactacccaaagccttgaactaaggaactatgcccagagacattctgactagattctttggggtaagtagatatgaaagataaaattgtcaaatgggagacaattttatttttcatgtctactttaaccttactgttgttactgtaaaacaggtgatcaggctccttctcaggagaccggacttcataaaacaccagatgatttcctggacttcaccatccttggcagctgtccctgccttgttgaggttggtcaaatcttcataggtttgctcactactggcaattacatctggggcagtgtcatctggtactgcccaagagtctatctagattgtggtcttctgcaccaaaatgaagcagatgtcaaacttatagcaaccatctctcactttaccttctcatgccctgtcatgcttacatcagtgttgtcccggtagaaaaagcagttctccagattccaggagttctcagggatccagatcaatactatcttataggcagccctggctgcaggattggcaacctatactgagttgggtttgcatagacatgaaagatggcttagttaaagatttgcctggtaatttttagtcaccctaatccaatatatatggatattctatatatgattatataacaatatcagaactggcagaattcttttaatctttatatatatatatatatattatatatatatatatgcacttatattaagggtagaaataacatagtgttgttttgttgattttgacatacataaatttttggatataacatttttgaaaatttgattgttatatagtcaatacttatgtagttttccaaaacaccattaatcttcattttaatgtcgcatcttatactcaatggtattttaaaatcaaatgaatgtcgtgtgtgtgtgtgtgtatgtgtgtgtgtctgtgtatttcatgactaaattttcttttttttcttttctaataagattagatttattcaataccctagtaaaagttttgattataagcatccaacagtatgaaaagtacaaaacagatctgtagatttctaatatattaatacaaagtacatgactacatacagtacaccctacaggcaaagagaggtggaagaggaaaaagaagactgtggttgaggtctagtaataaataaataaagaaagaagtagagatgatccatattatagtatattctaccaccaatactgcagccaaaatgtaaaaaaaaaaaatcacttcaaaataactcaggaggatgacagtggctggacttttgtaattcgcctcaaagactgtgggagagccaactcaactcactgtatagtctgtgcatatggtggcttgtagcatgtaggtttttttccaaaagaaggaaatataaaatatttagattaagaactataaaactacagggtgcctataaaaggtggcttactccttattgttattatactatccaatttttaaaatgcagtttaaaaaataagcactgagtcttattattatacggcaggcaaatgtttctccctcattctgaaaagactgaactggcaatgcttttcctgaacatttagaaaagaggcagtaagagtactctggtttgggttcaagtgagaggcttttcatgaagatcttaggattgaagagctctaagttcaggatatctcaatgttcagaaagcctgactaaaataagccaaaccaaagccatttaatgtgaacacaaacctcttttcttttagtaaattttacttttaatacagagtgaaagaaaataaaaacttaataggctaaaacaagtcaaacacccattctacacagataaaaaccttcacaaaggtcaactgaagttatccagagctgaaactgaattgtgcagattttcaatgaagtcatcaaagtcatgtaacacaaacaaaagttgattatatttacacactcagcaagcccgctaagaaatgtgtcccaaaaagtattaacctttgttttgtgccatcctgaagacttgcatattttatttttcagatagcttaacatttttaatcgagtgtgttctctaccatgtggtaatgctttggtactatgcatacagggtctcgcctgtcctaaagacttgccatttccccaagaggagctttgattctgctttagaagttttatatgaattaaaatctttatcaaatattaatatgaagggaggcacaggatgcaacatatatagtcaagttacctctctgtatatttagaaattactttctcctccaaggtatttgcagcagaaagctcagtctgtcctgcttaataatcagtagtacaggtttgaatcatcagaagcttggcaagaccttaatatttcaaaattattaacaactacctctaggggcaagtccatgttactgagttatgacaaatttattatcatgagggaaaacaagagtagccagccatcttaaaaatgccccaaccacggcttctcaatacagaaagactgaaaactacatacagtttatcatacaacaaatcccatctctgtcccctgaaattcccctagtttcattcattagaaagggatttaaaaaaaagatttaaagagcactttacagcagcagtcagctttcctatgaaatactcagcatcttaaatattatgtataactctttttttagtaagctagacactggcttcagagtttgtgggactgggggaaatcaacccattcaaaactactctagaaactgtcttttggcagaatagcaggtatccaagttaaaaataggagggtcatttgagaccagcctggccaacgtggtgaaaccctgttcatgatgaaattttcattctctgtatttaaaataaaactaattaaattatgtagtgtgaattttcatggggttcatttctaaagttgtaatcagtgaagaaatagttaatctctatgtgtttttgtcacatgtctagacataattattaaaaatttaggcaaaagtacagaaaaacagatgggctttctaatagtaaaaggcctgaatgcttgttgtacagctgctctttttataatcccagattttaggagatggaggaaagaatgttgtgagctttttcatcaattatatgctatttttctttacaataagaatgcaatttaagagaaactttattttagggtgttatttggcctcttacagattcataaaggagtgactactgattcagaatatttatgaaattcagaaaatgcatttaccaagtaaaccttgcatcacttttctttaaattaaaatttactgaatacagaataaaagatatttggttatttgctattcagaattacatttaccaaaatggcattcaatcaatccatagctaaatctaggcttctatataaatccacttatattaagtgaattagtaatattccagccatgttaaaagataggaatacatgatttttgacccagacccaatgtattgcatcaaaaaagtaaaacagctcattaacagtaagacatataaaatatgaaaccaatatcaatcaaaatcttttacaaacggaaggtgaaatgatatagagcccagcatcaaataatttaagatatagcaaagcagctgaaacattgaattgagagaaaattattattgtaaggaataatttctcatttatgtgatagtggtatgatcaagaataagaagaactataaatacatttggaagttcaacattcaaactatactgtgtagtcagtagcacatataaataatgccatacagacatcaaaagaaaaaaatgtagtgtttagtaaaatcaatccatgtttcctgtgctttaagcaaaaaaatggattctcattagctcttgacaaaaggatgatgccacaatccactgagactctgtggcatcctctgaagaagtttcatagtttttctttaactttgttagaatctcaaagctgaggtgataattcagttcattccaaattatcccttctctgcttccctcccttgttgatattcctcagaactttcacaagcattggtggtcaatatgttaccaaatgtggttcagttacatatattttgcagctcatatgatttctctaaggggcagtgattactggttgtagtctgtgatgagatacacctaaaagctatttctataactgctctctgccaactgaactatagctgatctgaactgcgcaaatttgtaccaaggctaattcttcattagttttcaaggactgtggttgcttctgttttctaaagctgtctagtaagattttctgccatcatcatgagttgcttcctagaactctgttgccattgttcaaaagatggacccagaagatgcatggcaactaaggatgccaccagctcacaggtaatggcttcccgcatgagcccaggtcaatactagaatcttgtctccattatttctacccctactgcttcctataaccactaatctcaagccagtgttagagcctccgtgctacagatggcatcagtattcatcactgtagctgatgtagaatataaatttatcagcttatgaaagtcaccttccctctgatgtgaccagtttaatgggtgacccaacatatatgaatgcctatgtgttttgtggactctacatagtaagcttacatctgcttcctctggcactgatggggtccacacagagcagtttggagaagttaattcaggtgtgctgcaccatcattgtctaccactcaatatccaaaaatgaagcatatgaccattaacacaacaatggagataaaacaatctaaccaccatccctttaattaaaaaaatagtacccacacttctctgataaatgtctctaagacataaatccagctttgggtctctccaaagatttttccactttcagagtctcaaggtcttgcattaaaatgaaagtcttagtgcccaggtgtatcttctctaggacatgcgggtgagaaggcacttaaatccccattgtgcctcaagagtatgctcctgaggtcctttcactttgtgagctgtatctaaggtgatgccaccagccatacatatcctaagccagttttataagtattaaatagaaaaaaaacttatctagcaaactctaagggaatctgaacagtactaaggctttattacaatgatattaaagttacaactaagatttaataaaaaatatgttgtataaataaaatttgaaaaaaaaatgcttcattaaagaccaaatatttaaacacaatgttaacatctaagtgactttaaatacttagactaaggtcatttttaataagatcgtacatactaaaattattttttgcatttatttaaaaaaaaaacaggttgataatgaaagtaactcaaaacactaaaagcccaaagtaggttttacctgtttatcattccctctttcttctcctattccaaaattcttatgcaacattgtctcacaaaaattaaaatatacaaaagtaacttctgatgatgctgtttattttatgtaatagtgttgttttggaaatatagctcattgaaaaactggtttttaatatgtaatatcagtgtcaacaaaattggaacatatttaatcaaaatgaaattcatgttctggattttgatctcctgatctccagcttttaaaatagtagtcaaggtacaataacttgctggtatcaagaagtccttcaggaatgaggaggaagtaatggaaagagaggaatctggttatcctgatatatactgatggtgtcactcttaaagctttatcataaatgaacagctgggttaaaagtttcaacttgcgaatccagacttcttcaaatgatcagcaaattagaaataaccatggtttgtatcatttatagtcagatattgcaactatctgaatattttacagcatatttacataccactttattgtttacaaagaaactttcatatgtaagctcatttgttcttcaaaatggctcagtgaaggatccattcaccaacaagtatgtttcagatattgtgtgagtaggttggactctcttcttctagttgacaaactgaaattataacccaagtcagacacctaagagggtgacagagctagataaggaattgagatatgatgattgcaaatcttgtgtccatcccactttaggacactgtcatttacaagacaatatgaacacaattacatgacacagtgacttgttacaacctatactaaaaccctggaaaaaccatgcagtcttctaaatgattttaacatatagaattcaggtagggtgattattattaaaaaataaaaaatgaagtataaaaaagcttaataagctagataaattacaatatttaatttggaattttaatgctaaaattatctcttatttgcatactactttattgtttacaaatctattgtttatctcttattttggtcaggcttaaatttgtttttattctaaaacaaacaaatacaaacagagctagagctattaaattggctgccctaaatttctgaatgtaagagtaatttttttagacattcttcatcccagagatatagaaatgcttagtaacagtaattttgtaaaagcactttacagagtataggtatgtagtggcccaatagccatcttttctctgagtgctcgttgcctaggcacttttggacttgccgtatggaggagggagcttaagaagccagccaacacttaacaccactgtcttctggcattcaccaattccctttagtatggtttgcactctaaggctgttcagagcaggtggctcctgctgtaagaagagagttgtgggaagatatccatgaaatgaatatttataaacaatcccaatcttcattttaagtataagggaaaaataaattttaaacagagaggtccttaggaattgctgatctaaggcatcatctcttaaatatttacaacattcttatgttgtgaaattctttaatctgaagtactgtaaataaattaagagtgcaaaactgaatctgccagagaattctgataaattctcttttagcatgagcaagccagtcatttatgtaaatagtttcctcattttttgtgcaaattgttcttcaaggaaagttaaatcattttgttatttaactgaaatctactttgtgacatccacttaaatgacagtgttgaagtctttccttgtagctgttttaaaactgtcagggccattccagcaagattactggaagttaggtatgagaattgacattctccaactcaattccatgcatacatattttgagctcttgatatggctttgaaatggagacaagtggtctgatgacagacaaaatggaatattggaaatgacacttttataaagttcagcatagggactgtagataaccacttcttgtatacacattttattttctatttaactcatcttatgtcctagaatatacattttatttttttaattaacagactttattttttagagaagttttaggtttacaaaaaaagagcggaaagtagtgttcctatatcttccttctattccacagacatgcacatagtttctcctattatttacatcttgcattaagatggtacctttattaaaattgattagccaatactaattaacattatactaacccattaacactaactaaaaattaacactaactaaactccacagttcacagtagaattcatgttgtacattctatggattttggcaaatatataatgacatatatccaccatcacagtatcatataaaatagcttcactgctctaatagaaatgtattttaattgttttttcagattgctcactgccatctcagtatttttcctcccaatctagaggagattatctattttaaaattctgtttatacagaatcatttaatttttcttcattaacagtgaatttaattacttttttcataaactaatatctttcaatggattttagccaggactatgaggtcagaaataattctacttaatgaaattgttagttatgagaggattcatagtcattgtgactcagagagtctaatccacaaataagagaagctgggatttagaattctgcaatgactttcagtgtaatgtctgctcattacttaaatcaggatgggaaaattccagctggccagttggaaactacctagccagttggggaagatgagactagatccatgcccctatttcttaaagttagatttgcagataatctgccttctccttccattcaatacctcaaacagtatcacaacacagaacaacagatctaacacttgagataaaataataccagttattctgtgtgaccctgggcaagaattttaatgtttttgagcctcaaactccttacttaaaaatactgaatgtgagtaacaagttgacacttgcctcagtatctgtaatgatcaaattatttagtatatatcaaaattatatacatagtaccagacatttgacagatgctcaataaatatttgtcactgctgttactattattattattattatattattagaattcttattatactgtaaagatacagaaaagaaattgaccatagcaacagctgactgcagttcaggcaaaaaatgatcaagatacatattagatcttccattcttgacatggatagctttagctgtacagccaatgtaaattagcattttagtgatggggacaatgttcaattcaactaatactcattggaatttctcccagtttccctctgggttagtttgacatgtgtctatttactatctaatgtgaaatcatccaaaatataatcaatctttgaaaaccacatggtcaagaggcagaaaaggttttttcaaaaatcactattaatcgtaaaagtattatatattttaaaaagttccctaactatttttccaacttatagaattaggggactacaaagctacgatgattattcctgctcttaggccagtctgctgataataagccatgtaggtaagaggaagaaattaataactaaatgttgaagccatattacattttaatagtcaaaatattttctctgctagatcttgaagttggagattaattattttaataaataaaatgtaaatttttggagaataacaataaaagtcaatatttattagtgtttaattggtccggcaaaatttaaatgatgaggaagtattgcatcatttaaaccaaacagttctcagagtaccattattttcttcattctacactagagaaaactgaaaaaagatctagtaacttgactaagctagaaaatggtgtgaatagaatttgaacacaggccatatggttaacactcctctgtgctcaactattcttttatactagggaagaacaaatacattgtaaataaaaaaaaaattaaactcagatctaccacatagtactcataaccatgaaaaagttgcaatatttgcaccccccacctgggccccagccagttacattttccttaaattaaagtcctataggccttacagggttgctgtattttgtacaacttccacaaatgactaacatgatagtattataatgtatatgtttatctatttttaatataaaagcttgcattttattagcccatcattttatgagcctgaatttcatatattgaagacaatttccaccatacaaaataaattgtgatatataaaacagcaagaatacaatgttaaatcatttttgggattttcttgaggctcttctttcctgcttatgttcttataaatgaatatacatatgcagaaggaagagcaacaaaagggaagcttggaagcaatgtaaagggacacggcactcttctcatgctcatgtttttattatcacattctatgaagccattcagttcttcttcatgtttattcatattaaggtagctatattttatggtgacattttgatagacttcatcttattttagcaattcacttagtttgtgaaaatgtaagttgtatattctcaaaattttaagtattcactgaaacataaattttcagctgatgtccgcttttaaatgtcctacaatcatgtaattaaaattaggttgatttgtttttaaagattttaaaatttaatacctttttttcctaaaactaacttattttttgcattgtacccattaagatatagagtgctagacaatcttcaatagagtttctacagaagcaaaaatgatagaacaagccttttgaaatctaaaaactaccaaaatgttcatcttcattactaaaatatagtaattagatgcaaaattttaatccccatttcatgttgtcttgttcgttgatgccaagttgaggtttcattacagaataattatcattcatcatcatttaacttggaaagtctaacttctgaggaaatgagattgaaccagaacaactgagatctttccagggaagctagataaatagtttttacagacactgtttttaaaagttgaaaagtaagctataatttttattttgaaaacaaatcccctctaaggaaaagtatagcacttatttcaatcagacatgtatgtattaaagcttccactcatctcttaattttctcctatccaatcaatcctaaatacctttttaatataccattaatctttagcctttttcagacctttaaaaataaattttctgaactcttgccatagccacctaactttaccagatctattctccactcaaccacttgggttttctgactaaatcaaagaaacaaataaattttctcatgccactaccttgataaacacctttgctaactccctgttgccaatatgttgatgcacatatagcctatgaggctttccatctcttttcaacatctctgaacttatctgtaatcttcaccttcctatgcttcaaggacatgaaccttcttaccttcctctcaaacacaccaggttctctgagcttctgctttcactcctgcaaaactgccacccattctttaacgctcaactcagttaacacctctctaacatatttcataaatctttaactcaaagtgagtagctgactttgtgatcacacagtaataattcatttttctatgacaacgttcatcatattatgcactcataatgtgaccacttctctctgtggtacttaagttctatcacataagtagctaaaatacatatgttttaaataattttaatgtaaattctagtttcagtgtattttcaaagtatatcaatgcatatttatgtgcattctattttcaaagtatttaataatattataaatcatatttatatggtatcaaatatcaaaaattttaactcttttgatacaatttagattataaatatgatttgtttggtttggcttcgattttgttgtgcctgagtgacttatctatggagatgtttattgttaaattaaaatacatgaaagttctcaactgttttaggatttgtgtctattttagggtttgtgtctattgatagtctgtcaagctatcaattcttactgctgatgatgcatctttctgtggaagatgtcagctaaaccactcaatatttttacacaatttactatgagtaaattaactagtaaagtaaaactaaccttattataattttgtttacagtaaaagtgaatgatgacctgggggctttcttataaaacaaaatatttgaactttaatgtttagactgtgttttctctgttgggatctaaaaaaactttttttcaacacgcattttgttattctacttgagatttatagttaagtgacaataagtaaaatggtcttaaaacatattcattcctgtgtcagcacaaaagtacacttactgatttttgtcaagtatttagcattatactttcttgggattaaaaaaataaaattcctgctgtcaaggagtttggtaagggtgataaatataaaactaaactattaaaaaataaggtaactgcacagtgactgagtatgtacaagagttataaagtcaacatattactctgctctgtctaaatttcttactagaattagaaatacaggatcttttctttttttctttttttttctttttaaaaaaagagttataaagtcaagaatcaatgtttctgtgtagtgtcataggaaaaggaagtactggattttaaaggtagcttggaaaatttttatattatacattcttgcactcattcccacagcatgtggggaagaaaagccctcagcatatggatattttaaaaaagctctctaggtattataattctgacctttctgcctacacccccacaggaagccactgtgaaaaaaaaagacccccattatctcctaagtttgcttgaggccaggagttggagaaaccttctgagaggaaatgaattttgagtttaatttggatgtgttagtagaccattaacagtctgtaatatctaagggtacagaggcattagaaacgtagcaattgggatgtatgaggaagaagtagaacaagcagttggaaagctagacaaagattgaaaaggtgttatgaaaagttaggaatctcaaatactggtactgcaaggcaactgtgttgtctttagctaattcaaggtggatacttttatatccactagtcccagtgatagctgtggggaaaaatatgacaccagaagtcattgccatgcactgtagctaaaactgtctgggaacattatgagggagaaaggtgagcatgatgttattgatgaattatggaaaaattttaaggtaatgaacaacatcccttgagctactgatgtctcagagatttttttttcagctacaaagagatatatccacattatagggggaaggtgaagcaattattttgtaattaccaagtaaattttcacaattttccatcaactacatgctatctattgggactatttaacaaataaatatgatgggaatgttaatattgttaacagctaatatttttgaatagtgcattaatatatttctggcattacactaagcattttagctggtcaattatttcataattacctgtattagtctgttctcatgctgccataaagaactgctcgagactgggtaatttagaaagaaaagaagtttaattgactcacacttctgcaaagctggggaggcctcaggaaacttacagtcatggcagaaggggaagcaaacatgtccttcttcacacggcagcaagagagagaaaacaccagatggttacaaaaccatcagatatcgtgagaactcactcactataatgagaatagcatggggaaaactgcccccatgattcaattacctcccactgggtccctcccatgacatgtggagattatgaaagttacaattcaaggtgagatttgggtgacgacacagccataacatatcgttctgcccctgctccctcccaaatttcatgtactcacatttcataacacaatcatgccttcccaatggttcccccaaatctcaactcattccaacattaacccaaaagtccaagtctaaagtctcatctgaggcaaggtaagtcctttccacccatgagcctgtaaaatcaaaagcatattagttacttcctagataaaatggaggtacaggcattgggtaaatactctcattccaaaagggagaaattggccaaaaaggcagtcattaaaccagaaagttccaaaatgatcacctttgactgcatgtttcacatccaggggacactaatgtaagaggtgggctcccagagccttgggtagctctgctcttgtggctttgcagggtacagccccacttcagcctgttttcatgggctggcatgagtgcctgcagttttcccaggtgcacagtaaaagctgttggtggatctaccattctggggtctggaggatggtgaccatcttcttacaggtccaacaggtagtgctccagtgggaactctgtgtggggctctgaccccacattttccttccacagtgtcccagcagtgtttccccatgagggtaccgcccctgcagcaaacttctgcctggatatccaggtgtttccatacatcctctgaaatccaggtaggggttcccaaacctcagttcttgacttctgtgcacacacaggcccaataccacatgtaaaccaccaaggcttggggcttgcaccctctgaagcaacagcctgagctgcacattggccccttttagccatggttggagctgaagcagctgggatagagggaaccttgtcccaaggctgcatacagaaggggaagcctgggcccagcccatgaaacctttctctcttaggcctccaggcttgtgatgggaagagccaccataacatgccttggagacattttccccattgtcttggtgattaacatctggttcctcattacttatgtaaatttctgcagctggcttgaatttctctctagaaaatggggttttcttttttatcacattgacagtctgcaaattttccaaatttgtatgttctgcttcctcttcaatgctttgctgcttagaaattttttctaccataaattatctttctcaagttaaaaattccacagatctttagggctggggcaaaatgccaccagtctctttgcacagcaagagtgacttttactacagtatctaacaagttccttatttccatctgagaccacctcagcctggacttcattgttcatatcactatctgcatttgggtcaaagccattcaacaagtctctggaaagttccaaacttctctacgtgttcatatcttcttctgagccctccaactgttccaacttctggctgttacccaattccaaagttgcttccacattttgagtatctttacagcaacaccccactctcagtggtaccaatttattgtattagtccattctcacactgctataagacatacccgagactggattatttataaaggaaagagatttaactgactcacagttctgcagggctggggaggcctcaggaaacttacagtcgtggtggaaggggaagcaaacacatccttcttcacaaggtgtcaggagagagaagaatgagagctgggcaaattgggagccccttataaaatcatcagatcttgtgagaacttactagtatgagaatggcatagaggaactgccccatgattcaatttcctcacaccaggtccctcccacgacacatagggattatgggaattacaattcaagatgagatttggatggggacatagccaaaccatagcataaccctcatgctgactttatgaagcaaaaactattatttgttcctgttatagacataggtaaatgaaatatttataaattaaataactttctttgagtcaaacagttgttgggtagtagaggcagaattcacatctaggtatggctaatcgtggagtacaaggtcttcatcgctgagttattctgacctaatgggataaataatcatgaaattcaccctgcctcagaaaacagaaaactgtctaataggaaaacaactggtttgtggtatagtattctagtctagattgactttggaatagtattctagtctagattgactttataaacattgtgtggctgacaaggaaggtaacaatccttcaggagttctccatattaagaacattaagaacaattaagatactaagaacatgacaccactgtaatattgaaaacgcagtctataatatttatgttagtgatgaggttcttatagcaaaatgcttcagtcttagaagatcacaaaggatagaattactagtaaagattatctccagatttgataagtaaatcagaggttcaacttttcctgttacattgctgtgcaacaatggtcatgtttttagccttccttggccacaccaattactcatcattaaaataagtatagcaatgcaaattgaccaccaaagcctatttaacgtataggcaatataactgattgtaagaggttgtaaagtaatgtgcttgtttaaatgtagtatcataatgctgccccattgactgcatcataaaggtgcagaccagtaagtcactactgtccatgtcagcaatgagccaagtgtttggggtttaaataatggctgtatcctctgactccattaaaatataatatttctgctcttctctcaggcacaacatgtagtaaaaccaataaatattttaaatcacacacacataaaacttgaaattagagatgttacattccattaccgagtcatacttactatctgtattttaaaaacctgcaaatatttgaataaaggataagtgatgttacatattgcatttaaattattacctaaattgcaaaaatttttatgtagaatgcatatgtaaaaacagtaatatgagcagatgaatgcttatttaagtaatttatcgtgtttatattaagtactattaaatgttatttaattttctatgttctttcatagctattttttaaattaacattaaccagattttaaaatgcacattacattcctaatataccttgacatttaacaaactacttacgcttttatgaagcaagcatttaaattaaggtactaatcactgaagctaaaaaaagatgtggcattatgtatttttaggattttatcatctattgattcaatacataaattgcagtgtttgaacaataatattgaagatattttattttggtaaaattaaaatagaatggatatatttaaagcagttttatttgatttaataccaactcaaaaatacattttattcaaaatgattcaactaaaataaaaaagtagtgatcttctaattccaatacagcaattacattttaatgtacaaataattatatttatttatattactaaacatagtgtttccttaaatacatttgactgaagaaaacaactttctggaaattcgagacattttatttcatctggctgtattttaaatatacaaatgaatggtcattagtgctctacatactgatagattccttcagctgatgaaatatgattgctgttttctcttctgtatgcatttggaaaggcaaacagctttgttgcatataatgaaaatcactggcctaactttctccttaagaatgattctgatcaaataaaataaacactcaaccaaatagctatgctgtgtaaattcattaagatgttaatacaaattctttattttcctttttaaagcaaatctagtagagttaaatgttatataattttatagttacataattttgacctcgtagtccttgaatttgccaactctgagccggtgtgggcattaccagactttgaatgatagcactacagccagtgtctcccaggacttgtccaggctgtgactttctggggctattggatatgctaggatagatactaatgattgtagagtaggaagtggttatatggtacattggcacaaagcgctgctgaatgacctgctgctgatttgaaggaatcaatgtgtctttactttctattccaatatcctcccacatgtggagtaatgtcacatacttggagaagctaccagaatatgaaacagcatttaaaaacattataaaaggagaagtaaatgcctaggggtctgcagtgtagattgaattctactctgggtttgtgctaatagctagattgcttttgcagttataaagattgaaaaggcttagccttattggaaggtaaagtgactttgaaagtaagcccgcaggatcaaaaatgccattatattctctcatgacaatcttactaaatcaacttcattttaaggattggccagggctgttccaattaggagcactgctgagaaatcaccctggtgcagggggctccataatgctcaaaactggagcagggaagacagaataagcaagaaaccactcagaaagtccatggtacaaatggctgagggaaaccaaagtgaattctacataaggaggaggcagaaatactaatcaactttgaaggtctgagccaagaaattgaagccaaggagttaagctaaagcaaattacctttgcaccaacctaatagataaaaccaaatggaatgggctagaagtcattaagatgagggcagaaatgggagaatcctgagaaactgtttttatgggcctctgtttgtggtagtgtggcatgtcttaaaagccttgaacagggagataaaaatatcttttcagccattaacttttcacattcagtgagacatattggcactggtattgaagttgaccacaagtgtttgaggtaaaggatttacagccactgagatgagtgaagttcagaggaccccagcctcacaaaaccccctcaaccacactgtctcttgatctgttctggttgggagactcctgatcatggtgctaataaaatgcaaaatacacattcctcaagaaaacctcatgctttccaaaatcatgcattataaacaagaagggttatggcatacccctcaaacctatacaattttgttagagaattaacaaaaaacagtaattgtgttacatactaacacagctaaaataattttatattgctaataaataaaaatacttcagtaaatactgtttagggtcttaactttcaagttgaagattacttgacaaaaatggatgtaaggatagattgaggtagctgagctacagagacaagagaaaaggcacaattagggagtaacacaggcaacacatgtccaaatcaattcaagaaaataactgtaggcaaattatcattgtgtaaaggactacgtaactgcagcttgctgctttcagctatgatcatacactttgcttgttattttttgtataaaatattaaagattttggaaaaaaaaaaaggatatgaaccagaacaaattcacattatactgacatcactccccaattaaccaattgcatatgagctaattcagtaacaactgaagttgttaggagagttaggagaagggtgagtgggctaaattcgaaactaaagttcaaagccctgaagcagaagagaagaggcactggcgccctctaagctgttttccccatggggtctcagcccatttctgaagcatcaagttgctcagagatccatcctatgagacaattgtctgggagccaatagcagttagggatagtgaatctttaatgagatttaagaatatatcttaaatcattatgtgcagtgatgaggaaattttaatttgatttatcactgagatatatattatcataattgaaaaataaccatgtcttctgcaatggaacttcactttagcagacagcgtttgttggcttagaataaaaatattttctttgtgtcagttatataaccacaattcttcatgaaaaaaataatatatttaaattgtgataattttcctaattctataagggaaaatatattgatatttttacgaataagcgtccttactttcctgatctaggctcatcacacaaacctacaatgtttcagagtatatgattctgtactgagtctagtaagattaaccagcaagaatgtgtgcagatgagaataaccaggaagggggaagctctgaaagcatatcataagagaaatggtcaaaaatctgggctgtattcttctctaaaacatacaagttgaagtagcttgatatttgaagggctgttatgtagcagaaagaagtaaatcttggctggtgcagcagaaagcagaactcagacaatgaatggagtatgagtatagcaaggacttattcatgattggaaatatccaatatcaaaagcagctactggccaggcacactggcttatgcctataatcccagcactttgggaggggaaggcaggcggatccaaggcaggtggatcgcttgagtccagttcgagaccagcacggcccacatggtgaaaccctgtatctactaaaaaatacaaaagttaaccaagtgtgatggctcatgcctgtaatctcagctacttgggaggctgatacatgagaattgcttcaacatgggaggcggaggttacaatgagctgacagagcaacactccgtctcaaaaaaaaaaaaaaactaattacataggatttatttttaccaatactgaaggtattcaacttgaaaaatcaatgtatcagagattttcaaagggcattacaacactgagtgaaatctgtacaagatcatatttatgcctatttttaatgttctaaacttttacttctgatcatttgggaatagtttatgtattgaaatgcttcctcatggtcatttggttatatgagtgtttctgaaatttggttgcatatcaaaatcaggagcttttgaaaagtgcaaatacatatttctctgcaagtctgtttattgaatcacatttctggtgaggtgggatcaggaaatcagtattatcaaaggcaacaggtgattgtgctgcacctagactcctcttgaaagcatggggtatctaaggtcataagaatgaattcctccatttattggctagctaagttttcagaattgtgcttttcagtaactaaagtttagtcattttaagtcagcatcctgtcttattatggtatatttatttgtgaaagtacagctaaacaataatagtaagagtaacaattgcttataagataagcactgtgctcagtacttcatgtacattgcttcattttatttgtacaagcctatgaggtcaacctctcaatactgcttttgctactttaccaaaggatgtaacactgagacactttgttctctaaaatcacagactattagaaactctgccgtttgaaatcagatcagtaaaaatggaacaacctacacttgcctggaagatttgagtcactgacaccaagaaacagcctcaattttcaacccaggtgcaaaatttcagataagggtttttcagatacaatattcaacatgtgtcttaactttggagtttccaaggaaacagaatccagagtccacttcttaactctggcctgatgttaatctctttactttgagcattgctcatttttagcactatcacgattcttctttatttaagtatgcctaaacaccattttcccccaatcctatttttaaccctgtttcttcctttgcctgattggatgctccatgcttctgctgtgcaatctcccttcatacaacaagttaataaatctaacttcgttgaactataagtatgcctttggtgtaccttgtcaggtgggcttcatcagtagatattataatctctaatttgaagattagtaaaatgaagttcagaaaaataattaatttacacaggatcacacagtaagtgacaaacctggcattccaacccaggtctacatgactacaaagcccatgctcttaacacaatgcatagagtcagagaatgttgaagcttcaaaagaaactaaggcatgccatactgctaacttcacatggacagtaagactagaattccattatcgtgaccttccaatccactgtcatatgggaatagctttatctttgttcagctgccaatcagcaactattcaggctttcccctttccctgaaccttctatggtgtttcctggacacttgggcctcactgagacagtagtaacgtagatactacaaacactggtaatgtctaggcagcagccagtgatgcagttatcttctgaacatcttctttctgacagacaaaagtataatcaaatctccgggcacggtggctcatgcctgtaatcccagcactttgggaggccggggcggccaaatcacttgaggtcaggagttccataccagcctggctaacatagtgaaaccctgtctctactaaaaatacaaaaattgtccaggtgctgtggtgggtgcctgtagtcccagctactcgggtggccaaggcaggagaatcgcttgaacccgggaagcagaggttgcagtgagccgagatcgcaccactgcacaccagcctgggcaacacagcaagaatttgtctcaaaaaaaaatataatcaaatcaaactatttcatttcagatttctgtagctgctgagaacacaatgcattaactcttctgcatgtagttagtaggatccgtccctaaaatgagtgaattatgtgaaagcatgatccttctctgtcttttctacctatatcaaaaagtcagagcatatgggtgactggctattatgtttaagcctcttgacaaccctgagttaaagttatcaaaagtatgtgttttccaagccacttatttaatgaattacctctcaatcccactaaagtatcccttattgcctaacagtggaatccttcttgagccactgatttttggatattaagactacctaatgctatttattgtaaatatgatggaagttaatatcatgtaaaagacacatacatgatttcatgaagttgatggaagtgttatgagagaactggtctgaccaaatacaaagggattactaaacagtagctggaaggtatacattctttaacgattgaagagaaaatttatggggcggactcctcaaaagacaatgatatggatatcaaaagaataaaagagggtctgaaaaaattatggaattccttgaagagttttgcaaaaacatatctcttcatgattgtggaatgaaactaaataatgagattgttaaaataattgcataaacacacacatatatgaattaagactgttattcatgctgagttaacacgcagttgcaaatacatcctcacaacaaggataagattatttttatttttttagttcaagataaatttttaaatacagcttttctttacttctaagaaatattggtacctatttaaagtggattacttttaaatgttttctgttaacaattaactctggatgacaagaactctggaccccctttcttgataagaagcatgtgtgcctctgggcaatcctcactcacacttctcttacatagctggcctttcccgcaaccccactttggttgtgcctccttattgtctacacacattagcacttcacttaattccacagtctctgagctggcttccatggctccttctactcaaaaagtgttttgtttaccagctccttctgcatcttctgggagcttgttaaaaatataaaatctcagactgtatccccaatttcttgggcaggggccacactaaccttccctgtatcatttccatgttagtatatgtgctgttcaagcgagcactctattcccaacttctgaatcaaaatctacattttcacaagatcctcaagtgattcatttgcaccttaacatttaagaagcactggcctagacaattcttaaacactttctgttatataggttgaattttcctaatctgaaaatctacatctgaaatgctccaaaatccaaaacattttgaataccaacatgacactcaaaggaaatgatcactggagcattttggattttggatttttggattagaaatgctcaatcagtaagtataatgcaaatatttcaaaatccaaaacacttctgtccccaagcatttcaaataagagacatttaacttgtattgtattttgtgaaatctagaggctgcttttgtcttgtttctctctcttgtctttgcatctaattattcacaaaatcctgtgtaatgtgcctagcccatgtcttattcttccccagtctttctgttatttcttatgctgacgctgaaatggccgcctaactactctctcagctggcattctcactcctcgcccactccctaatatttattgcatcttttctgaatgatattcctctaaataacaaactggtttggtatcatcagtttcttcctgaaactccataaagacatagtggtagcaatgtttaatcttctctttggagagctacatgtttctgctacctctttttcctgctacctttccaactctatttcctctcttccttccccctatcatgcatttttcacttcccccactgcaagctactcagatctcctaaataacatgggatctttcacacttcagaaatgagttttcacatgctgtcaccagtgttgaaatggcctttccttcctgattttcttgggaaatttattgaagccatggaaatccactatccctctgaagcctcctctatcccacccaaatggaattaatcactaacagttaatgactgtattagtctgttccacattgctataaagaactacctgagactgggtaatttataaagaaaagaggtttaattgactcacagttcttcaggctgtacaggaagcatggctggggaggcctcagagaacttacaattatagtagaaggcagagggaaagcaggcacatcttacatggctggcacaggaggaagagagtgaagagggaggtgctacatgcttttaaacaaccatatctcgtgagaactaactcacaatcacaagaacagcaagggggaaattcacctcatgattcaatcacctcccaccaggcccctcctccaacattgagaattacaatttgatacgagatttgggtggggacacaaatccaaaccatatcaatgacccattgcacattgtacacattatgggtcccattatattgaaattatacttacagctatatttctttcttgttcctgtcagtatcccactagaatgggagatcttgagtcagagttaattgcattagttcctgatctctagcatttagtgtctagcatatagaggatgatcaataaatccttcctgaatgcataaatgcaggtttcatgtttcactgtgaaacagaccttgctcctcaaataattctacatatatttttggtagaaaaatattaactcacttatatggatactttaatagatattagtacacatattattgaaagggaaaatatatgagagaaaatttattttttatcattgacatatttattaaccagtcctgtaagaaaaagctattaatgaggttcacatgaataatatactatgattatgaaataccagttatgaggagtttccagttttaagatcaataacttctttaaaaccttatggattgcaataaaatgtaaattgtgacctacacatgcattttcaatgttcagataagaaaaaagttgttttgttttgttttaaaacagtgttgaatgagtggagaggtaaatcaaatgttccaaatatgaagtgcaaaatattacaatgatctgtgcttaaattgcagccatacggcctaggcaatggttaaaaatgagagcacatcaaaattacctggggaattcttggaaaccatacttaaatcctacttcagtgcagaacacctagaaaggactcaataaagtttggtgaaagtgaaagagaagaaaggagaaaatatggaaggaagaaaaggagacaaagaggtagaaaagaaggaaagacagatgaaagtaagaatgtaagagaaggaaggcaggaagagagaaggggaaaggagaggggggaaaggagagcatggggagcgggtggaatgctttgcaaagctgatccattttcagtatggtaaatatattaacactcctcacgttacaatgtttatataatgtatatatgtctctttgcagagacctgataagaagcctctacactagatttacagttttagctctgtacattatgactcattatgtgtaaatttataatccaaattacttgttgaataatgtttgtttgtaattttgaatctattttcttgataatgcaaggttctccaagaactcagatatttctatgtgtctgttatacttcccaaggaaaatactgttttcctgacaacagttacttccttttcacagtctctttacattcagtagccctatattatgttctaggtaaatatcactactttattttattaatgaaaagagagatgaaaatgtaaagtactggggaaacagatgtacattgacaaagaaagagctaacatacataaatgtcttttggagtataggaccaagatccctatgacttacattttatcttgtgttcagggcccatagtaaattttactgtcagtttctctgagtgaactagaaatttagatctgaatttataaaactaactcaagcattatcttttccactgtggtctttcctgaccattacactatgtggtactaattccctcttctttttctcctccattatatccctataggtacttacaagtgtggaactatttgaatccaatatacataatcacttgtattctgttacaatcccagtttgatgaaatactcagaaggctgtatcatattaatcttaaattttcagaatagtacagttcctgccccaaagaatgcacttgataaatgtttaatagaccagtgcctttaaaggtcagtgagagagacataacatacttctgtttatgtttttctgacaacagaaaataatacataattaagctggaaaatgtggagagaacaaaaaaatattaagtagcagaaaaaaatcagctatttgatttcaataacaagagacaacctttatcaacatttttttcctttacttatctattgctatgttcagacgtaagtcactggtctcttttcagatgagtatttgcaaagggagttgtttttcaattgagttacttatgtcctcctgaaacagtttttataaggttaaaagtgtttaattgcattgaagccaaaaagcgcaatttaatgaagtaaagggtttatatggcttcatctatgtggtggttattttaatgaaccagacttaactgtttccgtcaacctctcataaaactgtataactcttaggatgctttcagtgataaatagtgcctgacttatttcaacaccagatctttagaggtttatatttaaccgtatttgtctgcctagagctttcaaaacacaaaataacctttactacacatattgatgagaggacaatgatgacaaacagtgtaactatgctgctacataaaaccctactctgcagatctcctatttgcatgaatttgttaaaaagcagactacagatgtaatcttctttcatactttgatgtttggggttgtttactaccaccagatttttggtacctgttaaacatacattttatatgccatgagggagataagctttatgaaacaactcataacaacttttcagaaaattgcacatttgaagatccaattttgttctttcacacaaccactgaaacagtctcctttctgatcaccaggcaatttcccaatctccttaaaatttatctttctaaacaatttcttccagaaaagcttttggcaataatttaacacttcagtctgccctagtgagttgggtgaattagaaaagtctgaaaatagattgcagtgaaaataaagcagggggaccaagcccttacctgagtgtcaatgcctccctggtgagagctttgctccatcacattcaaagataaactcaataagtgaagacatgttgcttttaatttttgtgcttagcttttagcactcactgataaagcatgcaaataactaacctataatgcttcacccacataattctaattgttttaaaaagactaaatttgaaatcaatattggctatttttttgcatacctatgaggtgagtgtgtgtatgagacacagtgagatagcataactaacaacacactatctgggatctgactatgggggttcatatactggccctgtcatttattagctgtgtgacttcagcgaacatatttcacctctcagtgtctctgttccttaactataaactggttacgatagcaatactacctcatcgggtttgtctgaggattaaacgacttcatacatgtaaagttcttagaatagtgcctggctgacaggcttaaataaggaagcttctcaataaaacataggacaggcacattttatatactttctagaatgtttgaagtcaatccatatgaacaaaccatattagaaagatgaatatttaaactctaaagataaattttatattgttaatttactccaaagtttgatgaacttcgcttgtcactaacatttgtgcttatgctttcttccatgaagatgggtagaagatgcatacatttcttttgcatagtgatggcaaacattgattgagcactgatcatgttccaggccctataacagggctttctatgtagcagtttattttatcctcacaaataccaaagagtatctcttatcatccccaatttacacatgagaacaccacagctctgggaggtcacatggctagtcatctactagtgccagaacagggagtgaaagggtacacgtgagactgcagggataaagactgagctcttaagagtggcactatatcatgaaaggggctagataggaaattttgtttaatatctttatttcctatttgaagaacctaagacccaaagcaaggtagtgactaagctgaaggtttctgtcacaccactctgcattcttcgtttttatttctggactaatcctggatttatattttcccacttcttcaattttgagtagaaagagaaaaaaaaatgtttgccctgaatatatttctctcccacacatccattttttctcctttgaagtagcaacaacagctgccaacggaggatcccccgggcttatagagcatcagtcagcttcacagatgaaggcaaagatgagaagacagaaatccttcctttaaagaactttgcaaatgtttttcattctaaattcattctttcattagtgagtacttttaagacaatattgaaacctcaaggcaaaaatggcaaagcactgattctaggacctacaaatggtccctaattggttgccaagggccaaattgaaggagatttgggtgaaaggagactcagatctctatcttctctaaaccatttttttttaaatctgtcttttctttttaaattttatcatatttattgagggtgtacaacatgatacttgatatacatatagatagtgaaatggttttttaaaaatattctctacataccatacgtcccttctgccacccctatgctattagagaaaaatttggctagccaaaggcaagaagaagaaaagattgcttccatatttatgtagggttccagtgacccgtgaagcttatcaatagaagacagaatcaaagttggagttagtacttcttggcttagaccaaaagtgcttgcattctacatgtgaaaaatggaaggaaaaaatacatgtaactataagcataatgtttcaatacttttcactatccattacccacgtataggtccatcatgcacacataaaaacatacatgcaaaacacaatactggaatacattgtactggtttgttttgcaagaataagctgtactgtatattcacactaaaaatggtttcctttttaatctgagagcaggccagaaattaaatagtaacatattcatttatccatttatctcataaatatttattgtgaaactactgtgtgctaaacactcttctaggctaagaataccccagtaaagaaaccaggaatcatttctccctcatggagcttgatttctagtggagaaaacataataagcaagatgtataaatataatatatagcatgctacctagttctaaggagaaaaaaagtaaagcagcaaaagacaatataaagcaaccaggtgacaagagtagacattttagatagtgtggccagaaaagatcttatgagagatgatcttgggaggaaggagaaaaagaagtgagaagatattgagagattgtaatttccacaagagaagggcaagtgcaaagtccctaaggtgaaagattgccttgcatctctgagaaacagccagggggccagagtgcctccagaggagttaacaaaggggagagctgaaagaaatgaaatcagagtgataagaggaggccagattatgtagaactttatagtgcaagctaaatattttgaccttcaccatgagaaagatgggaatctaggcactggaataacataatttgatttatattttaagaagataatgttggtgtgcagcagtaacaaatggtacaaagtaacaagtgatacaaagtcaataactcgtgacttttgtaacaatccagataaaagacaatggaggcttgaagcagcacagtggcagctgggatggtacaaaatacttgaatgttgatatattttgagagtagacactagctgactgaattgataagagatgtggaggaaaagacattaagattgaaacttgactttttggcctgagcaacttaactagagtgttgccagttaactgaaatgggaagattgcaggaatggctgcatgtgtatttttgttgttgtttatttgtttggtgtatttttgttttgctttcttttctggggttggggagccataacaggatctcactttttcaatgtgctcaatttaagatgtctgttaaacactgaagtggagatgtcaagtagataattggatatgcagttctgaattgataggagaggtctgctgggaaaaaatgaatttgggaatcattagcatatagatgaggaagaatcagcaaatgacactaagaaagagaggtcataaaattggaggaagactagtgagtgtggcatcctggaagccaagtgaaaaaactatttcaaaaaggagaaagtaaattcacatgaatgctgcccataggttaagaaagttggggactgagaattgactgctagattagcaatctaggggtaactggtagcctgatgaaagcagtgtcagcagagtggagaagtgtaaacaaaaatgcaattaggaagagagaaattgaagatggtaagtataaacaattctttcagagggtatgctgtaaagggagagtgagaaatggtggaattcctggagagaaaataagatcaagaaagtttgtttgtttgcatttaaagtaggaaaagtatggtggtatttatgatgctgggaatgatctgctaaagagggaaaatttatcgacgttggaaaaagaggaaataagagttgtctttgagtaggtgagagagatataacctagggctgtctactcaaagggtgggccaagaattgcagcatcagcatcatctgggagcttgttagaaaagcaaactattttgtcctgtcctaaagctaaatcagactcaggtgagacctggaaatttgggtcttaacaggcttgcaagtaattcttatgcatgattgtccaaaacaactgatttattgcacagaggagagctctgccttatctaggaacacaatcaatttatccatggcaaccaaaaggaaggtacactatgtgggcacaggtgaggaagtaagcagatatggtaatgggaccttatggaagttttctagtagttacctcgacttttcaatgaagagggaagcaaaaatagcaatcagtccctttcctctactttgaattggactattagccccagagccacagactgatggtgtcatccagcaaagttgtattattctcttcacccaaggtgactgaattgcaagacagcatatactccaagctgcactcagctacccctttgcaaagctgcaaaactttccaccttctctaggcctgattgttccttcagctggtctgttccttttggctggctcaaatcgtggtatttcttgtcaaaaatagggttgccatttattttgcatttgacatactatagacactttcaaaatatgtcatctcattcagtctctcaaataaccatttcacattggtgcttctatcttcattttacagataataaaatggagactgagagacttacttagtcaatggtatctttctagtaagtggaagaatctggaggactatccactaaactgcttttaaggtgccacagagggtggagagcggtttatgtacctggtcactctcaaaccacaccccatccagggtatccagcattccccaagtgatttcaacacaagtactctgtcttccaccttcttctattttatgttactcttcctatttttcctacttaacttgctaacaagagcccactgtttttttctagaggtcactctggtttaatcagtcaatacagttcatttttcgatgttctacccaattgctgtcctccttcttatctctttttttcttctcctcctccttcttcaataatttcttcagccctgtatttgtacctttacaactatatctaataagccactttcccctctgcctgaagccatttacaaatttaaattttgttttaaataataaaaataaagtatgagtacactatttcttcttaaagcttctactgtttagcaagcaatctaagtctcttctcattttacctaaagtcaaacttttaggtcacaattacctcattaactgtttattttctaccatattttatgtggtcatcaggtttttttcatgtatttgatttttcatatctacctaggttgtgtcttctagaaaccttcccacatctaccatacatacagtcccaaactaggaaatatatatgattatatgtctgtgtagggtcattaaaacaacatttaacttttgttctacaaataaaagaaaaaaataaaattctaatgacagaacatgctaatattatataaattacctatgagtcattctcactcaatatttatttgcttatttattatttactatataagtctatcatgaaatatactctctgggtaataaaaaggacaggctactataaaaaatctaatgaataaatatattaatcaatagctttcagcattccatgagcaataatgcacaattgtaggttatatagttattgatccactatgaaattccacaaagaaaataagtgtgtagtcaggtcacattttttgtgagattattagatttagtaatatttcactatttactagtgatagattttggtttgttattttgaaggactgtataagtaattaagtttatagtttaccatgaattgaataaatgaaaattgtggtagttttaaaactgcatttttacgttgaccatttttttcatacatgtaggacacattattctcactagtccattaagttgttgcagcctagggaaattaattcttttctgaactctaagtgtggggcacattatcatccagtgaccctctgtactacaggtaatgcatatcagctgacaataaattctatcttcttcataaagttatgcttctacctgtgtatcttattctgatgattgacgctcatcatccaaacccccaaactaaacgttctcccaggtaatttccactgcgtcacatttattcagtcactaaggactgccaattgttgtgcagacctttatggaattcatccttttgaacctcactgacagtttattatttcaggacctcatcatctcttgcccaaaccgtgagaatatacctctaagtgaccttcttgtctctgatatgctttgcactctctgcagcccctgcctgcctatcctgcatcataaaaatgactaagcaatgattcacaacataaaactaatgatcttactgctttgctttaaactcttgaattacatagaagataaagtccaaacacttttgggtgaccctgaagccctgagctggtcacagccagcatttccagcttcatctcattgccagtggtaatatcattaccattcacactatgcttgtggaacttctgcaactactgggttgcttgccctaaacacagtccgctacttctcaatagactaatcctttctcccacttacaaactaggactcaacttttcaaatggatatcacttcagtagactatgagagtactgcaaactatttagctctttgcaaattgcagctgttttaatttcccacaactaataattattgtaatttgagcttttctacttcaatgtgtatcatttaaacctgttctaaaaacaacacagtttagcttctatgttgttcataaacatcgccgaatcataaacttttaccattgttctacttcaattctttagtgtagtaatttgcatctctggaaaattacaagaagcattccatttgtattgtttttctctatttcttcctttctttataatttgcaaatcagagcactgttttcccctgacattcaatcttatattcttctaaaaatgctactattttgtaggctgatagctcaataataagtataattaccatctgccacctcatttcttaaattatctagtaattatatgtatattttctttcaattttggaaattaagctcttgaaaagacaccccccttctttattaaagtaagatagagttccaggtgtatttttcaacattagatttgtaaatccactttgctttttgtcattaacacattgtaatactaatgtaaaatttcacagggctttctgctaagtttaatacataaaatattgtgcctttattggtttttcatatggcatgatttttgaaagaatagaaaagtaataatatttggttttgtgggcactgtggttaaaaaataagagttgattaaagtcatttggatatattttgaaaaaaaaaaatggcctggattctaagctaatagttgcaaggaagatttgaggagtcttttagcatccaccccagtttaaagctgtttttgaaagtaaaatatacacacactataaatatgtatctctttcagttttattaaggacattttatttatttctcctgccaaaactatttaagaaaaatatatatctttggctgaagattccaaatacaaacaagtccagaattctcctaagaaatcaaaacaatacttttcctttttgtaaccaatttcttttcatttaattttcattcatccatattttgttttgtgtcttctctttatatttttactttaaaacacatatattggataagacaaagacctctgatttctttcatttggaacctgagatttggatgtggaaaatttatagtatttatgaaaacaatataataaagttacccataaaccctggattctatataccacacttgctaatgtaatctaataaacagatcattgaatttgagagctggaagggaccttggagagcatattttccaacatccttatattgtagaaaaaactgaagccaaggaatcttgtcaccggccagtcatatggctaactagaggagaacaaatactagatcccagacttcctgagtccaagtcctgtgccctttatactaaatcacatgttctctcaagatacagactttccatatcagtccgtcattcctcacaaactgaaaatagagttaactgagtttcctgtgtgactgaacacctacgaagcaaagccttcattctcaaaagcaaaactggaaacacatataaaatttctgtaacagaagtttttctgcaaggctgtcttttctcttttctgtctgttcaggtgtaagatgcctaaaggtaatgtttgccacaagcagtagctattaatctttgactatatttttaaagcaatgatgctaattttaggttactttctaaaaaaaaaaattatctcctactctcaatatgatcatctggaaaattatttgcagactttattttcatgttcttcctaaaagcactctgtccttgcccagagaaatctgtagatattaagtttggtgtttgaaatgtgcactttggcagacctccatttaaaggtgtattttttttttttaatgaaagataaagagtagctgattatacttacacaaaccccagaggaaatggattctgttgatggtaactaactaaagtggagctgggaaagctcaagtttccgcctccctccaacctctgctctctgataattaccaaccaagcctatcaagaatattttgtttgatgatccagcaaaatgtctggtaagggaggaaaaagaagggcagggcacttcccacgaggatgggggaaggaggttccgaagctttcctgggtgattagagctggggaagttgatctcttttcatgctgtagatgtggcgcgctgcagtcacgcctcccgctgccagcccggcaccgggatcttaatcagtcactatgaaaactcattagctccacagcaatgagtcctccactgctgaagcttggcgctgtgcttagtaccatggcaatgatctcaaactggatgtcccaaactctcccatccttggtgggactgaacaccacgaggctgtcgactccggataccttagtaagttactgcggtgggtttggccatcttgagaagtaagtgcatttagtgggctttgttttgtaaattgcaaaggctaagattttgcttctgcctttacaggtcagcttcaaaaatgtagtaactatgtggtaactttcatcatatttatttataaacactttatagttataccccaaaaatggactgcttgagaaatgagctatgaaagagaataccagagtcattaaattcttaagggtgaaaagctttaactatattacttggaagcttgggcaattcttaaaaatatatatatatatatgttttgtttcttattcttttacttattttaatatctgtaaaaatcttcataatttttcccacaaagtaagctacaaagtatattctgtcaaatctagttctgctacagcagattcttccttggaatgcaatgcctgtgactatttgcaatgaattcactcaaagaaactaacatcttttaagcataaatgaatgaaaaaactcgccaatttaaggcctgcccaaaattcctttaagaaagctaagaaacatgagcaatagaaaacttacttgataaaaacatcttcctgtatttttaatattttatgaagacttcctatcacaagactgtcttgtataatcttcattcatctaaaattaatggctttttaatcctccctactttctaacaaagtatttcctgatagtttgaagcaaggttcagtgagcaacatgtttgatatttcaaagaaaaatgaaaactattgttttttgaaatagaaatttacaaattcaaataaaaggaatttcttagaaaataattcctctgccctgaaataaaaggtacagaagcaaaactaggggttttcactttcatgtgggttactccagtggatcagaaaaagtcagatatggaaagaaaagtagccctccatttccaagtgttatttgctgttactaataataatctatcaaccaatgttaatcaactgagtatagtctgaccaaaaagttaaataattttccagattctcccagtgcttaaggcaccagcagagcacatacaagccacactttgacctgcttttacattttcatttcccttaggttacttatggaaccccagagcctccattgctgagatcctcttccctacctgcatgaagtggcctggcaggaaggatgtaaaagagatttggagttataaagaaagcaagagatagacatcaataaacaattacaaaacataaacttatattatctaatatttactgagccaatttttttttcaatgtccaagtaccagatttcaacaacatcattgttgaattaactcttgcaggataatgaatgtaaactgaggtactaatgaatgagttatatttcaaactttgcaccttgattctgacatgtatattttttgtgtatatagacattggcttggtttttttttattgttgactgatgagaatgaaatttccaaaattatacatgattctcttaggatttctagttatcttacaagtaaattaaatatctttacttactgattgaaaaattgttagttgaaaaatataaagcattgctgtatgtctgtatatgttttgacacagacaattcttacttttgattcccccctttgcaaaaaaaataataataataagaaaataataagaagaagaaaataataataagaagaagaacaaaagcagaaaatgtagaaaaggtttcactatggctactgaaaataaaccagtaaatggtattcactggaatggagaaaaccttttttggatgtttcttttttttattttaggtatgctttccagaagagcaatgtctatgacatttccctaattatccaaatgagtgctcatactttaagattcccggggtgaagaatgaatgcatcagtatctcttagactaggaacataaaatgttaatgctagaaaggtggaaaggatcttagaaaccatcaagccagttatgttcatactatttttagcagcagattttttttttgcaaattaaatcttatatgtgctaaataaatatttttgaataaaacaaaatgaaaattcaaaacataaaagaggtcttaagtcagataataaatgattgggagaggcatttactgggcctccaccatgtgttatctccccacacaatcaactgcttgtctcagtcaagatatctccttagaaatcttagggctctcaagactttagctggaaatatgactgatctaattcagcctcattattctacaaatggggagactaactggaaatatttaagccaccaatcagatttcccccatttggttaatggcagaggcaagtgtggaaccaagttacatgactacctccctactcaacaaagctatttcaccattgctttgccagtcattggccctcttggtccctggtgccccactaggttctcactaccctgctcagattgtttccatgtccctggattcttcttctttccctcctacacaccaacaccttcatcctttaaagtatgttttctcatctccctggcctcatagaattggagaaaagctatactctcaattatgtcataaccattcccaaaggttttgcatttataaagaagaaaaaaatcctcctttcttggcattttaggcatgtgacaaagcagtgaaagaggttcttttgcttaggggattcttcctgctgcctctcaaataattccaagggacccttactgctgcttccatgtggagggccagcaaaactcttcccttagatggaagggttgacagctccctggctcactaggtattgctgtaaagtagtaaaccagctcttctcatcaatgttctcactccatgttctcactttaaacagtatgaatgggatgagtttgcaatataccacacgcacacgcacacgcaggtcttgaaatctgaatgttcatggaatacgcagaggttaaaaaaacagattaacataaatacgatggtttaagaaaagcagatttacacaaatatgatcatagtccttttttagaatgatagtttcaaatgacctggaaaaagaaaaccaggaaaaatagagtttaaatcattaaatggcaattaaatcaatttatggcaggtgcctctgaaacaggacacatttgattatctcaaaagctgaaaggggttttaaaatttccaggatgtttttattagtaagtagttaaatacagctccttattaggggaataagctccttcttgtttttctcagaatcttgaaacattcctttatccttcttgttggccctgttttctttcttttttattccccttccaatctatccactgggcccatcagcctttggaggcattggtttctgagcagaggaagcctcagctctcagaaggctcaggctccctctggcgcgtctcttgaatgcagagtaacttcccctagaggctgagcttctgagaaatccctcacgctgtgggcttcacaccaggaagaccctgggaaagagcaattaaaaaagttgaggacattcagcagacacccgctgttctcaaatagccctactgctgtggtgggaagaggcctcgaaggaacctgtgggcatgtcatttgttttggtacattttcaaaggtctagctggcttctcctcatgaataactactttgatgagttagtcaatttaaagttctataaaatgagtagaatcccctgaaatgaactgtcaatatcttctaagcttcttaacctcaattaaccaatgtgttttagtcctggatgaagatatctgatttaactgatttgtatatgactgtttttccccccaaattctgttttccttccctaaactcttaggtaatgctcatttcgtgatagggcaactgaacaaattaaggagggaagccaggtgagagaacagaatggcaaatcttgatggtgacagagaatatgatcattgctttcttatagaagaatcctcacatgaataagagagtagatttattctagcttgagtgcctgaagcaaaagtagggccaaagaaggaaaactgcagagagaggagttcggctcatgccccctgcttttcttcagtggagggggctgcctgtaaagcagtgaaatccctttcatgcagaggtctaatggaaacacaaggagaatttgtagacgttccattgtgtggaaagacatgggactaaatatgacttctaaggacctccccaagtctaagtcattgtgatttccaaagggcataagcagaggtgaccaacctaaatttattattattattattttcagacagtctcactctgtcacctaggctgtagtgccatggcactatctcggctcactgtagcctcgacttcccaggctcaagccatcttcccacttcagcggccccccatctcaccccactgagtagctgggactataggctaccaggtccagctaatttttgtatttttcctagagatgagggggtctcattatgctgcccaggctggtctcaaactcctgggctcaagccatccacctgccccagcctcccaaagtgttgggattatagacctgagccactgcaccctaacctaaatttgataatgtttttggtttttattcattattattattattatttttgcttttatagttgttttttcttaaagcctggaggtttccttcagtgaagaatacgcgtttcttattcagtcctaagaattattataagtaatagcaagaaaacagctatgcagtgacatctttattaacatcctccagaacacagcttcttttggcgtggtctgtcgacatctgtctaattcctgtcctcacattttcttgtctccacaactgaagccattagcatgctaaaccacatgtcactctctgggaccaagcctatcttcagacagaaaatttatcagggatttttcatcactcaggtatctccactctaaatcaagtaagttttaataaacagatttatttaggctttatttcctccatttgtacaacactttcagtagctatatccctttttgtcctttttatgaaatacccagaaaatcaggataatacaaaaaatctagcaatattcgatcagttgattttcttctgttcaaaggatcagaattctcttactttgcctgtccctccatctagaccctgataaatgattgccgtgccttccacaggaatatctgactatatattgcagagcctgtactgctatctgttcctctgaggcaccaatggctacttgtttccatgctgtttggataatgccctctacctgcctgggtgcatctcttctcatcaactacagtggggcctgtcttctctatagcagtgtttatggttactggtgaatggacatagatgatctatctacatttatccaaagagtatgagcataaaaagctctgggctaaaaactggggaaagctggtataagtcctatatatggcattaacaaaatggatgacttataaaacatgtttaagttctttgagtattggtttccagtttcctcataagtaaatttaaatactgtctatttctaaggatagttcgttcaagaaaagtgagactaaaacaatagcagggattttataagcaaaaaatctattgaaatgcaaggtagtttgattattttttacttttacttgtcaagcctcaagatccttctttcctattacaaagcccctgaagccttagaactatcatatactagctttatatttataaagcacagctttgtaattaagttataagcaaataatccagatttgtaatacaattgttaaaactataattttaattctcctatttagagcattcttaaatattttatgagttttacaatattaaaaactgctcaatacttcatttagttcttccaattaacacgaaaggttcaaagagaactgcatcagtaatcactgtgattattaatgctttgggtaccactaaactatatgtaccctccaggtctaagcactgagcttcacagtagttcagaaaatgctaccaaggttataatcattatgtatgaaagggtattaaaataattgatggtgtagtgtggtggttaaatttcactctctgttgggaggccgaggcgggcagattgcctgagtccaggagtgcgaggtaggcctgagcaacatggtaaaaccccatcaccaaaaaagatacaaaaattaactgggcgtgattgtgtgtgcctacagtctcagctactcaggaaactgtggtgggagaatcacttgaactcaggaggcagtggttgcagtgagctgagatcaccccactacacttcagcttggacaacagagcgagaacctgtctcaaaaaaaaaaaaaaatctctgaaataagactctctcagtacaaatcccaggtctgcctaaaaggcagatttacacaaatctccctactcactggctgatactccctgcatgactttgaacaagttccttcctgtctctgagtctgtttcctcatctgtataatgggcagaataccaccacctagtccataggtgtattataatattcgaaagcaatagcacatatgaactgccaggtaatgaatagaactccattaatgattgctattcctgttgcatgttttattgacacctaaataattgttcttatatgttaaaattggagcaagtcttttccaaaaaacttctaaatacgtccttccatccgagatcttagttggtttgattttgattctcttttcaatgccagcatggattctctaaaagagaacactagaaacactcataaagcttctatttatcactgaccccaacacagaggtctctatcaaaacccacaggactgtcaagcactcatcttttctattaggttttttcctcttttgagttacctttttcttgtcaaaaagctggctttttatagtttaaatcattcaaagtaactctgtagtagagaaggtcatggctcttttcactgattcttacaataagacaattggaagtacaaacaagtctggagtctttagttttattgaactgacacttcaggggaaatgctaaatgaacattaaaccctcttcacctttcccacttccctggttccagagagcaactgacatggagttctgtcatgatgagctccacactagttagccaaacacttggcaagtgcacgtcaatattaatgctgccaggtttaataatcagtgtttggactgctgttaaaatattttaatattataattgggtggcctctcatcctttgtccaatagattaatttatcctagtgacaagcctcaattttctggcatattttagatttgcgtccaatgttaggagatgcccagctaaaactgcagggcttatgtccagatacatcaatcgcatactgttactcaacttgaacctaattatatcattgaaattactctggtaagctgtttctatttccattctgtgggtagtctgcattttaaaaaataatactaaaagactaacccagtaatctctaagatcttatctaatttgaataatgtataattctaagtacatctttccatcctaactggatattcaagcataagagctagaaagaagggatggggagaatgttaacgagtctgacccccaaaaataaaaggcagcattggaaacatctatgaattaatttttttaaaggagttagaaaataagacattcaaaagatatgtctggtaccatttcctttacgtaatagatcaaggatgatgacttggtatcatcatgagtttcttgagtttataatttttagcatccccaatatttgctcatgattgttgttggaaggcctatcggcacctagaagtagttatcattaaagctttcagaagaaaaagacctttgtggtggtttatggtatgtgatgagctagaacctaggacaaagtatacgggagattgtgtctcttctgctgtgaattctagagacagaagactccacctactatggtaaatctgtggagaaagaagtcaacctggttcatgctttagttactttaagaatttgctcctggcccagcgcggtggcttagagctttagtcgcagcactttgggaggctgaggcaggcggatcacctgagatcaggagtctgagaccagcctggccagcatggcgagatccaactctactaaaatagcttctatctgtataatgaaaagaactttttaatggaatatcaggagaagctagaaaaataaaaccatcaagtttattaatacagacacttctagtttacagaatttcaagtctacatgtggtaactttcttccactgaaatttatttatgaaaataaatttggtgtacattatttggaagtctattgatgttcttgctgaaaaatgatttcataaaaaataataatgcttatctttgtgcttgatagagtctacttgataggtcaaataggaaatatttacatttctaatagctgggctggttgcagtggttcatgcctgttatcccggcactttgggaggccgaggcggttggatcacatgagcctaggaattcaagaccaggctggccaacatagtgaaaccccatctctactgaaaatacaaaaattagccagacatggtgacacatgcctgtaatcccagctactcaagaggctgaggcaggtgaatcgcttgaacgtgagaagcagaggttgcagtgagctgagatatcggctgaggtgggaggattgcttgagcccaggaggctgcagtggctgtgatctcacccctgcactccagcctgggtgacagagtgaggttttgtctatatataaaaaaaaatagctggatataagctaattgttgaaatgagatatgtgaaaggcaaatgacaattctagaaaatatacattaaatacctaatgaatagtacagacagtttcttcacaacaggtagaaatcacaagggctgaataaattcatggtttataaaggaggcattccaagcaggaaaaatgaaatgagcgacataaaaagacatgaatcaacatggcatgcttgcacgacgcacacagaccgatttggttaaaggtttctgttggatggtacagaagataaatctagaagcataaattgcagaaaaactacagtagaactggaataccaccccttcacacttgagttctaagaaggtagagtgataagtgtacagaagtttttgggaaaatcaatttggcagactctgccaaaaactctaagtcctctaagagtctgcatttcgtgcaaaatagtgctggtctaattatttttaacctatgtcgtcaatgatctcttttccactttattaataattaaggcttcaatatatgggaaacctccttgaaacaggactttgtttcagaatatcacacatgaattataattagaaaataatatattaatattagtaattgtcatttactgttaagaagatcttatgtagaaagacgagtcatatgtgattaagtagttactagatgcttctaaagttgcattaaaatgtcacaaaatagaaaaagcattgggaaatagtatgagatcaaaatcagttactaatatggcacctgaagacaagaaaggatcttgttttggacattgataaggagggtatactgaatgaagctatactgcctatataaattgtttaatatctctctgctaactttaaagattgaaaacacaaagttaaattatcaaaaaagtgttttacttgaaatgctacaaaccaacactctttttatcctataacaggagtctgtgttttatgtttccctttggtttcctcagactcagattagtcctaaagaagggtggcaggtgtacagctcagctcaggatcctgatgggcggtgcatttgcacagttgttgctccagaacaaaacctgtgttcccgggatgccaaaagcaggcaacttcgccaactactggaaaaggtaggtgtcctgtgtcccctatgcatatttttagtaaaatcgaccattctttcaaaaggaaatatggtagagccgataataatgaagaggattcttttgatttttgtcccccttctcagataagcttttttttctgatccttgaaagggttacctcaagcttcctgctattgtctttgtcctatttctatgactttttactttttctaaccttgccaccttaagactggctctctaccatatatcttaatctctagttgatatctcattaaggaaaaaaaaaaagcatcttattctgatgccaaaaattcagctccactctcaggatcacactagactcttggagctcaaacttttgaatcccataacaaccttgcaataaagttaaaataattgcatgtgatatgcaagctatctggacagataatgaataattccaagtgtttatcatcattctctaagtgattccttttaacattaagctcttcaatttcattcaataccattctctccataatttacttaatatggattcataacaatcaaatgcagaatgtctttgatttattctcttttacacataaatgtgagctcatgaaaggttatttatgtttagttgggagggaggaaaaccaatgaatcgttctgtcaaatattctcactcagactttcactgtgctgggctctaaatgtagtaagacagctggagtggccagattatggaaagatgacgtgtttggattctaaatgtcattaggaataataagataaattaggtagtatgtgttctagaggacatcatgcttaacaattgactctgtgtgatgtcattttcatgatcacccacacatttatggcattgaatagaaactttttaacaaaaaatgaagagaagctagaaaaatgaaatcaagttttttaatagagacactcattatttacacaatttcaggctgccatggtgactttcttccactgctacatagtgaaaataagtttcctctgtatatattatttgcaagtatattgatgctctaagattttaggattttttcatgtgcttatataaagcttagtctgtttctccttcccctctgcttgaagttatcatcacctattggccctttcttcttaagcctccttttatggcaagatcccatcctttcggatccctcaatatctgtcatccaacaagagcatatgtcattttcattcagaataatgacttcagctaacatgcatctaactattagaaaccatgacaaggccaggtgtgctggctcacgcctgtaatcccaacactttgggaggccaaggcaggtggatcacctgagatcaggagttggcaacacagcctggccaacatggcaaaacaccatctctactaaaaatccaaaattaactgggcattgtggtgtgcacctgtaataccagctactcaggaggctgaagcaggagaatctcttgaacctgggaggcggaggttgcaatgagctgagaactcaccactgcactccagcctgggtgacagagcaagaattatgattattcttgagtttattttccaaagttgatttttttatttatataaaaattcaaatatatattttgtttgtttaccagggaaattatttacattagtaaaaagatctaatcttttacatccaattttgctttcctgttaaattgtatttcccttcagataatcaatgttcttcaccaaatcttcttttctacccagaaatatctttttttctatataaactaaggtgagagattttcttagacaccatactttatcttctgtgttgctatttttcagtacagcattacatattcacacctacacatacactcaaacatttcttcaaaaatcagttgaaaaaattaaaataaagtataaatgtcagaaagtggataattccctttacaggttcaaagtaaaatgtatttcatagctatgataaaactgggaagtagtgaaagatgaagaaagcaaaaatgtatgaaagcattatattggttggttgaaaataataatagaaattaatatgaccactccatccatccaacatgtaatttgtctgaatgttttcaagaaattctagaacataatacctttaaaaatttattaatacataaatgacaaaaaacaaaatttattcacaaaattggagtcaccacaaggcagatgtattaaacttaccatatggtagttttagagcaacagaggaatcgtaaattgtgtgcactcttttacagtggcctgaaggaggttaagtagcactggtttgctgcactgatccaaagaaaagatgtctgagatatcacagtatttcagactgagccagtcccttgcttatctctctatagtttcacatatatccaaggcaccaaagggcaaacaagagcatgacctttaagcacctccttcacttttaaccaaaaagattgatttagtcacatataagggaatattgttaataaagacaatatttacaacaatagttcccattattagtatattttgtattatattttgtatctacttcattaaatccttatagaagggatagttatctttctaagtttatgtaaaagaaaactggtggtttttaggttgaaaactttccattgtcactcaatcagtaagttgtggctctaacagatccgtttgcattttctcaatgctgtaccagtgtcatacaaaatcccactggtatatccatacttatttaagtgatgctctgtttgccatttaacaggtatttatattattgaatattagaaaaaatataattggtttcacagtatttcaggtcttagtatgccaaaactaaaattgctcacctaaaaaattatttgtttgttaactatgtagcttccctgtacagttaaagatgtcttgtattatctaagtcaatatttcctaaagtgtgattttttttaataggacactgccatcatcctcaccaatgacataagtttaagaaacattgtacatgatacttcattcttgaagatttctaatacacagtttactactaaagtttttgttaagtcctacagtcaagaaatcggtttatatgtgttaaattcaaggctatccaaatgtatttaattaatagaccttttttttcaagtgaccacctcactaattatgagtgagagtgaaaatcaaagttaatttgtgtttaagtccagaaaagccccagatatcttatttatacaaagaaccagaataaataaaaattccaaaagaattatccaggaagggcgacaatgagcttgccaaactatgctgagagatcctaatcacagaaacacctctggaaagctgaatcatagaacaaccgcagagataagccaacaaaaagagggaacatagcagacagttctccttccttactcatgtcgtcatgggtattcagtctcccgtgtcatcaggaaactgatgctctgtaggcctctatagccagtgggaaactaaacaatcctagttataaccagcaagagatgcttaagaccacctgaagccaaatcctggccaattagacagctctagctctagccattaccccaaatgtagctcctctaattacacatgattctgcaatataggtcaccatcaagccttagcaaaaattatctcagtgcattttcctgtaacacaaatgaagttgaaaattaaccttatagggtgagtcaaaggcagaaataaagacaggctattttaactttatccagaataccttatcttgcccatcattttctaattgtatagacttggcccaggtacatagaattattaccaggatatcagccatgctaatgataggtgtcctcacagacaaatgccatatttaaatacgtagacagttttttttaatgcaaatggcttttccttatacatgtttaaccacaaatgaagttagaaagttatgttgaaagcattgcatttatccacaatggcgttaccatgcttccaatgttgtcttagtaattttgtgctagattaaatattttgaaaattaaaaataaagctttcggaatattaaacttttagtaaattaagaaatacttacattcctataatgctgttgcctaaccagagacaggagtaggaagactctccttaaaattctaaatacttattattactattacaaacccaagataattttactcaataaatattcactgaacacttactctgtgcctggttccgtgtaaggtcttggaaatggaagatatgagtaagacacagcttctaacctcatggagctcacaaagggaaggctacttccctgcccctactccacacccacataacacaattagttttaagataagccagactgtaatatgtcctaaaaggacaggatccaaaaagggcaagatgatggatcaagacagcagagggaacagaaaagggtgaaaaaaaggcaaagaactgaggcaggccaagacagtattcattgcctttttccaatattatagttctaaggaatgtatcaactatgggaactttacagctggctgatccatttagcattgccactttatctgatgacaaaaatttgtgtctgaacaagtcatccctttgtaaatcacatgttttcaatgaaaataactttttactgattatatgtgtgtgcatgtatttgtatttgatttagaataaacagattggctggacgcagtggctcacacctgtaatcccagcactttgggaggtcaaggtgggtggattacttgaggtgatagtcatcaatgtgatgaaactccgactctaataaaaatacgaaaattagccaggcgtagtggcgtgcacctgtaatcccagctactcaggagactgagacaggagaattttttgaacccaggaggcggaggttgtggtgagctgagatcatgccactgcactccagcctgggtgacagagcgagactccgtctcacaaaaaacagcaacaacaacaaaagcaacaaaaaagatcaaattttatgaagatctttacatttgcttttctcattgaaatctttctatattgagcagtacttctcaaactttaatagacataggaatcacttgggaatcttgataaatgtatattttgattcagtagttctggatgagcatttctgagattttgcatttctgacaaactcctaggtgataccaaaattgttgctttgagtactaacagcatagagatctatcttaatctttataacgggtcattcatattctatttctctatttaacacatcccctgttattagatgctttctctttgttttcagatttttgttgctacaaaaattagaccagtcattttttcctctcatttctgcatgcgttataggttacctcttttttacttccaaatagcccagggttcagcgaacctgggatggtgccattggcttaaaatgtgtttaagtcctgtctaccaagcacttgatgcagttacccttttccaggtccctcaaacactatgctgtccaatttagggagtgttctagtactgctaccacttgtcttagtcaattcagtctcacccctgggagtactttagacccattaagaacttactgagctagaatgaatgcattctaggcctcttcgacacttcactaccatccacaattgctaaacatcctaaatatttaagaagtcagaattagtacttacagaaacaacttattttgacatttaacaggttgggatgttattagcttacaaagccttaaaatgaaaattctatttttaaagcttatttttctaatgtattaagcccatttatattcagtcagttctaatgctagaatgcccgtttttaaatttcctgtctaggtataattttctcttgctgaattctttaaatgtttataatgaagaattgttcttctgaaaatgtgtcatatgggaacccagttatgaatttggcacttctagtttttatgttaacggcatttttgctatttcttagtgattgcacaaacctgcaaacagataataatgtacagacaatattcttgttcaacaggttcagaacatgtcccagtctattgaagtcttaaacttgagaactcagagagatttccaatatgttttaaaaatggaaacccaaatgaaagggctgaaggcaaaatttcggcagattgaagatgatcgaaagacacttatgaccaagcattttcaggtaggtttgacttctgcaatcttgtcaatccaaatcagacatggagtgggatggacagcagtggggcactcagctagaaatgaatgtgcattggcccatatgtgcaaggtaaaagactcatgggggatttcagtcatctctccactgaaactgaccattagctggtaggaagacatggaagtcttgctatagaaaaagcttcattcttgtagagtttggtggagtttctgaaacaagggaaatttccccaaggaaaattaataattaaattataaatgtttctctaatggttttatgccctgctaatatgaagaaagatgtagatgatataaattatttaaagagaaaactatgccattaatatgagcatgtggagagagttgtttcataaatttatccaaataaagtatttttctagattttaagtgttgtattggcaattatttacaaatactgaaaatggagaaaaaaatcatgctatgtcaacttttgttaactatatatgaaagagttatgaattttaagaaaaaactcggccgggcgtggtggctcacgcctgtaatcctagcactttgggaggccgaggtgggcagatcacaaggtcaggagattgagaccatcctggctaaacaggtgaaaccccgtctctactaaaaatacaaaaaaaaaattagccgggtgtggtggtgggcgcctgtagtcccagctactcgggaggctgaggcaggaggatggcgtgaacctgggaggcggagcttgcagtgagccgagacagcgccactgcactccagcctgggcaacagagagagactccgtctcaaaaaaaaaaagaaaagaaaaaactcttggtctgctaatgcaatctcagctcccattaaaagtaaaccacttgccttacctaggcatagcacatagttcataaaacactgtggttgcccacttaatagcctctggttttcttgtcagttaggaagtgagattcactgctgatgttgagggagtggatctgaactcaagcccttgggcaaggaaaggagtgcttcctacacatagtggtggctggtggggagctagtgaggaacatgtaaccgagtctctgcataacacatttgaatgtggcagaaagtttcatggttttgtaattttcttcagtggtactccagagactgagtagagaggtatagaagaacattacaccctgaattggttttaaagttttacccagacggtcacaaaggaagaaaaagagggcaagaaagttgagggtattgaaaagagaggggactgaagtgattaatcatgaggtttaaattgaagagagaagtacacaaaaccagcaggttaagtaattaggacaaattagagcaagatttagaatatacttaaatttaaagattattgaaaatgagagtgtgagtgaactggataaataggaaacttatggataaatggtaaacagagaagaatatgaggatgaagagcaaaagaattaattttagccagtatttatcgagcacataccatatacaaggtgcggttggcccctctgctggatgtattatacgtaatctgtcttctatgaaagacaactaacaggcaggtgaattgatggtgaatagaggcataaacattacttatgagcacaaagggaggagaaattaattttgatttaaaaagaccaggagaagagctggtttcgtactagtgaccctacccctccactattaaattatagggggatcaagaaaaccaaaagatttactatgtcaattttcaattctcagggttagagtgtagatggtaaaataataatgggaacccaatgctgaggtcatcggcaaagtagaaaatagtaagctggcaccttaggtgtgggaagagcattcccagaaggaactagtcaggaggagaggagttcagactgtttggcgtagatggacaatgcaatgagaattctgcaaagccaaaggacagcttgagagtgtcagggttgacagggctggggaatgcatgatgaagcatgttcatctttgggaacttttgcgagaagacaggaaactaagaaacaaaaaggatacaaaattgagataaaccccaaagaaataatgtacctagtcctataaattgcctagcagcaaatcagccaggctactaataagaaaacaattttcaggcagcagcaccatgtgacataatggcttggattttcctagttcatgtaatccaagtatacgctgaagttatatgtcaaaatccaaataacagtaatgataataacaataatgatttttcagaatattatacatattcaaggtatagttctgagcactttcagtatattaactgtataatgctcgcaacagtcttgtaactcaggcactattttcatttccattttaaagataaggaaactggagcacaaagagtgtattggtctattctcacactgctataaagatctgtgctgagactgcgtaatgtgtgaaagaaagaggtttaattgacttacagttctgcatggctggggaggcctcaggaaacttacaatcatgatggaaggggaagcagtcaccttcttcacaaggcaggaggagagagagagagacagagagagagagagacagacagacagacagacagagagagagagagagagagagagcatgaatgcagaagtaccacactttaaaaccatcagctctcatgagaactcactcagtatcagaacagcatgggggaaaccacccccatgatacaatcacctttcacctggtccctcccagacatatgggaattacaatttgggataagatttaggtggggacacagagccaaaccatatcaaagaggttgagtaatttatccagagtcgtatatctaatatgcatgagaaccaagattcaaattcagaaagtccaattccaaacttgtaccttctaatactaatgctgcattgcttctccaagtagactttaggtctctgaattacaaataataataattaggtgctcaacatatatttgtggagtttatttatttcttgagtcctaccatgagttggattttgttctaggtgctagtactatacttgaaaagaggaaatggaacgttccaaagtaaattcaatattgaagaatactttttaaaaaatcttcctaccctgtctctactaaaaatacaaaaacttagctgcgtgtggtggcaggcgcttgtagtcccagccactcgagaggctgaggcaggagaatggcgtgaacccgggaggtggagtttgcagtgagccgagatcgcgccactgactgcactccagcctgggtgacagagtgagactccgtctcaaaaaaaaaaaaaattcttcctctgttacacaatttccatcgtatcaagaatgttaagtaggttttgtcttctacactttttcagatagaaagcttatgccaactactatacttgagattgacattcttatatgaagagattgatgttggctctactctagctaagaacttggatgtaaaagcagcatagtagaaagtgagattctagaagagattagcaaacacaggtctatgctattctactgtaatcttttaagtatttgatatgagcattgggtggactttccaatgctctcatataagttttcagagtttcacaattgatcgctaataatcaaattatgaattgttgaaaagattaaaaaatataaatatctagttttgaattgagggagaagaaaagctaccaacattttgacattgaattgctctcttttaaatatgcccatagtagaatgtaaaacctttgattgtaacagttgttataatgtgcagaaaatgataaccacagaaatattttcattaaaatcctaatgaaacaattgtgtattcctttagggataccacaagatactttaataagtctatttccaaatgagctgacaaaatgagcaaagcactgcaattctgcctttgactgtgatatttatgaatctttctcattattaagtctctccttagcctcccactcaatatgtacatgtgaacaaattcaaagattctgaacttacagagcaagtggaaatttccccacaagaaactcaaacccataaatcagggcagcaatgggagctcctgctattttaatgcatttatagtaataacatctcctgaatgtaatttaaaaatgcaattttcagctccttaaatcagttagtgtacagtataatttctgacagcatctatgtattattctcaaataatcataagagggactgctctttccacaaatgacattatttccaataaattcacaattgaatcaaactcctgaaataaataaagaaatatttatttattttcactactattttcactactatgaagttagagagaaagaagtaacggtgacatgtctagaaacccaaggtgaaactgtaggcgtgcttcagtcctgttacggctaggggtgagggatactgcttgacaacatacactgtgtgtgtgtgtgtgtgtgtgtgtgtgtgtgtgtgtgtgtgtgtgtttgacgaaagtcaatgcttcagtttcaaacaactctgtgtaactggctcatctattacataaactacacaccttggtttcttaaagagttaattcgccacatgggcaagcaattctgccatacataacgacctttaaattatctatggtaagataaatggagtcgaagtacaggtaataattcaaaatagtaaacagtaacatacctttatttgagccttgggacacttcatctgatttataacacttactgaacttaccttcataatgaagttgtgctaaaattgatatttaaaagttcaaggaatacctgagcacaaaggaaaaacaaagttggttgatggccatgatggaaaaattctaagtgtcagaaaaaagctgatccagagtccacaattttctgtatgtgccccataacatggatacttagtaggtggatgattagactcaactgaacaatcatagggtattgacctattttcaatcactttattcaaacttaattcataattagaagatggattctgcttatatttcctaactagataatacattgttcactatataaaatgttaccagaaaatgaaatagtatatagtcctagtttctaccataggaagtttttctaattatgataaggatatatttgttatagaaaactaagcattaaagaaagattctcatatggaaaagctgaaataaatggacttactagtaataatcacatgaccgcttaaattttcacaaaatacctaatttcaaccaaaaatcaataagaaatgttgaagctgttttaataatttcctttaagtatcataataaaaagaacagagcagcatgatctgttttaaatgactctcaggaacaataggctgcttttcacaggagttgaaagagaaaatggacgagctcctgcctttgatccccgtgctggaacagtacaaaacagatgctaagttaatcacccagttcaaggaggaaataaggaatctgtctgctgtcctcactggtattcaggaggaaattggtgcctatgactacgaggaactacaccaaagagtgctgagcttggaaacaagacttcgtgactgcatgaaaaagctaagtgagtatgacaatttaatttgtctaagttacgtttttatatagtttcaaagaaaattgtgctcttacgttttataaagagtcataaaatatctaattgtaaagaaatcagagcccattttctaagtgtgaagtgtcccctaatgacttaagcatgtctgggtactctgtgctagactaatggtttcttgatttttagagccctgtgttaccatttggtggcttcaaataagtaatctggcaaatacagtcaactctatggactacactagtggatatacattttattttccaatatgtgatatcagtcattgcttggctagtggaaaaagaaactgttttttgttgttgttgttgttgttgttgttgttgttgttgttgtttggttagtggggaaatttggagactagagaaaggaaagttaccctgggaccaaatgtcaaacagcaattattaaagcaaatggaaataattcctccaatttacagaattgccatcaactgctctgatctactcaagaaatgaaaaggtggcagctacttaaataggtactcaccactgtgtaaagagtcaagcatgtgacatgcatgggtcatggactctacttcttacctcctaaaatgtgtggtccaatctggtctgagttacaaactctttcgtgatatccatgagctaattatttaactgaagtcaacatgggactagtctgcaacttgaatttaaaataaataagtggctatgaattgaataaggaggagctacaagttaatttaggatcagtattttagttgttgacatgatgcgatatgacagggagggcaagtcaatacccatagaaagtgttctctcaagataaataaattcttttgtggatcaggaaaattgggaagagaagtaaagcacacacacacacacacacacaaaagattaatttctagtaaagaaaacttcagtgaataaatgtaaacatttaaaataaaatttgagtggcttacaagaacattgtaaagactattttacaaatatgcttcaagtgataaaaaggaatccaaaatgcaaaatgttgcattcagttatcacagcctcaaaatagtgtgggaaattgctacatcggaggctccactgtcatcataccaggatttctaagagaatccaacaaaatgaatcaggaggaaataaggtaaacctgaaggccgaaacacatgttcaagaatcctcagttctttattcctcctcaaacacagtctacattttctcatttacagttggtcttctaacaatcaactatatataatagattctgtgactccagttttcattcctctctaactcattgtacacattattgccaaagggattttctgaagtatcaatctgaaattattttgctctgttgaaaatctcctatggattccttatgttgtaggatacagtccatggcttatgtgacccttcatgtgtggccccttctgcttctccaggcttagcttttgccacttctctcctcacacactaagtcccagtcatgtgtgccttacaatgtcttaccatggagttgttataagatgctgtttgttcctgctcctgaaacactccttcccctatgtaccctgcctccatcaacgcactttcacctgccacatgtgataaactattcatttgtcaggtctcagtttaaatgttgtgtcttgctagaatcattcattgccctcccagactaagctggtgtcctcgctaggcacttccaaatcctgatatttcactaatgattggacttctcttgtttcattatcattgcatgtgtagcataatgtgtcttgctagactttttttccgaggacaagaacaatgtctatcatgttcactctacatgttgtatcttccaatgcctagaaaactacctggcaaagaaaagtcactcaataaatatctggtgaataaatttactctataaggagtcataggaataatttctacacttttcaaccatattacctatttcaagtagcagagaatgatctattttactcataacaagaaatgcatctttttagccacatcctatttgagtcaaaatggcagggcatgataagactaagcaagggaaaagttatttatttaacatagcacttaaataattattttacatgctctgcttttataattcaagttgtggagtttatggttaatatacaataggtaaacattgcttacataaggaaattctgctgttatatttgattctttttatattaagaaatatctttagtttaatgcccatattagtgacagggcttgccagatggtgtctccataaaataagataacaagtaaatctcaaatgaagaattacccagtgtcctcaacaatatgaagtttacaaagaaatatccagatgcattttctattagctcataaaatatctggttaaagattttctgcaagtgacaatctgtaggatttgtctgtgtagggctttgacttgcttttgaggaggaggtccatttgttatagagaaaccaaccgttccagaccctgagaatcaattcactcttcctagcatgtcacaataaacccaagcacataggcattgcatgtagtgagccggcatctgctaagtacaaatgcactctactgaagcaaggacaggcaataggatgattctagttagtaaaccccctgaaacctaacgtatgtcagttatgtttttgaatgaacaacacaaaaaacaacttctgggatttgctcaattttataaatgagctttccttctacaggtattctgtctggtttacctagatggaaataatttgtactgcagttgggtagttctatattctcctcagctcttttttaaccccatttgtttgttttttctaacccacatgtaaccccccaaatatagcctcttccgatattttggacaaagatagttaatctaagtaggcacgcattcatcctttttattcttcctattgaactttgcataatatttctatagcatccttatgcttaggacttgatccttaatatctgtaacatcacagatctttttaattaattttatccagtgggccacaatgttagaaagaatttgattgtcaaataaactgcattagttaatcaatatttatttttattttagctaatctaaaacaaaacttggcaactagtataatacaaatatcaaatagcaataaaatcggtattcaactttcttatttaatgagatggttgctatataagttaatcgagatgactttataaaatactgaaaatagttcccacatttcataaatgctttcatagattattagcagccttcagtttcttatttacttagtagaggggccattgtcacaaacaatgaatgtaactctttcatgctttttatctcaataactggttagtttttactatcccaacatgtttaggtcaattaaccacttattgagcatctcctgagcaaagaggatattttatccgctggaccacaacccttaattacaatgtagaaaacgtccaggcagagccatacagtcattatacagtgaagtataaagccacatggttactgaaaaaataaataaatgaaacttcatatttttatttttaaaagagccactctacttgaaagaagatgtgtggtagtatatattatatatgttgttatattatatatagtgcataaatatatgtatgtatatagacaattgcagaagaaatcaaatatataacttttagtatagcagtaggttatagtttgattaacactcaatttagtatttacatttcctggcaattggtacagtttggatcaattcatctctgagaacccttgaactccaaggctaatattatcacataaacaaatacccaattatccatatatcagaatgcatagacttggggaagaaaactgatgttaacatcaggaccattaacagaaagggtagagaaagaaaagcatatcaggggttcagttgttccaaaagggcctataatccagttgctatgctgctcagatctagagtgggacattggataattacagaatcagcaatatagtaacaacagcaagaaggcttattcatcaaagacatcttcactctacacaaatgcttctcaacccacacagccaattagtagagggtagaaatggattagagagaaacaataaaattacaacaatgatgaatgtgttttccctcactttttcagtggatttgcttttaaataaatgtcacagcatacatcacatgaattttaagatgctaaaaaccaagctagtcttattgcctgcaaaatctaggttacccccaaatagtaaataagatcccgaaggaatcataagtcatcaagaccactggggcaccatgggcaccattttgcttatttctactagaaaattaaaggtttggagaaattaggaaaatctctcaacagcgatggacctctggcctgaatgaggtacagtaatgtccttttctaagttcttaatgtactccaatgaaagatggaataggataaagtcccctgttcttaattgaatcatgtcacatttctagatatgcagaatgtaattgtatggatgtgagaatttgactgaaaaaacatgattgaagtttgtacacacccctaagaacaccaaatagatatttaatgtagattataataaggctttccagctttccagtcctctgccccaactccctcctgttagtgctgttttagggcaatggtttggtgccatctagtgaagcattaggttctattacacagctttgggacttcatgtttaacagaaggaagattagaaacttaaggtcacaagtagagacttgagttactgtctttaccgtttatgccaaattagtttttaaacaagaaccaaagtatctatgggctaatattttaatttaacaattatttattgactctctaatgtgtgctggcactttgctaggtatttgtggatacaaggatgggaaggagaccatcttcctcttcctgtcaaggttatattttagtggggacaactgacacataagtcaataactccagcaatattggatgcctactgcttgacaagcgctaggccagctgctttgcatgtgctatttcaaatctatgcaagaactctgggttaggcattagtatcaacttcactaaaacagatactcagaaagtttaaattaacttgccaaagattcatgttagaggcaatcactttacatggaagtccttctgagttcaaagactgagatttctttccccatacataatgtcttttgtggagtacaaaataataaagacccccccagatacctcaataactttaatttaatgactagaaccaccatccacccaattgttgtagaaaaaaaagaggctagattcattcttaattcttctctgaacttcacaccgccatgcaatcgccacatcttttatctccccctcaccaatttctcaaaaccagctcttctgcatcctcacttccaccagccgaattcagagtgtcattcatgatttttcaactgaattactcaaatggcctcctgatcatttgttttggctctccatcactaaaaaatatttagtgtgatctttccccaatacaaatcttgttatattacacctgtattcaagtggtttacctttaaaatggaatccaaacacctttgcatgctttgtcttcatgaaatgggctctgcctgattctccaggccttgagttctcaggttctcatcatgcacttactctaagctttaaccattctaatcttccagtttctcaattgcgcatgctttctttaccttcttgacattgaacttgctctcccttgtcatgggacacccttccttcccactttaactattccatgatttttccttaatgtggttggagtcccctggcatggtctcccacaaccacctcccctactctcccatgacacttagtacattaacatattttacagaaaatgcccatttgtttttctgttttaaatctttacacccttatagataaattctccctgcactgagagatcagaatcaatgtcttgttctagttgaatttctggagaccattgcaatatacctgaaacacagtggacaaaaattagtatctgcagaatggtcaagagcaaatttgatttgtaaaatcaaaagctttaagttgctttcaagaaataaatcaatgtgtgtcaaatataaaacacatcgatatcttttacaaagccaaaaagcttttggggggaaggaaaataaaagcacagccttttttcatgtttgttgtcattgccaactgttctctcttcaatggcaatgcagtatttcattccaaaacatctgatactttgttttattagcacttaaagcaagagacacgaaagatctcagtgaaagcaggaattaacaaaaaagtcaagctgtgtgcctgaggtagagatgtgggagatttgactcagaaatgcaatggaggaaatttataagactattcctttaaattaaattgaatcttcaaataagtcatttaccaaaaacagtcttgctcttcccaaaattctaggttgtaaaatagaatggcaatgtctccattgctatgcattttattctttcttctggaactctggaaccttagttatattttagccatatttttggtaattggtaaattttatcatatatttatttatcattaatcctcctcttatctcctacatttttctagattataactaagttatgagcctcttaataatataaaacctgtatttccaaagtcaagtaggaattgtaaaattagttgggatttcataacacaagttgtcattcagtttgaatgctgaacaggcttctccttaaagatatgttcataattaggcttaatcccagaaaaggtaaaaggaagagtcaagggagtttcaaaaataatttaaaaggtgaaactgtgttaactttgaaaaatgttggttatttagaatgttcatattattcttgatcccattagccagataaccattagaaactcattccggtgctctatccaatacaacattttaaatatccattcttatccctacctttacctcacaaatataactcataaggctagacatgcaaataaaagtttaaataatataaatttattttactaccaaatgtatggtacagacaaacttattttaagtacctaaataggtagactttaaagatcaaatcagaagtatttcttaatgcatgagttctctaatggccttaagtaaaaagaaataacattctgtccataaacatattcaataatccatttaatttgtttataagggcatagccttaggattcaaatccagagctattagtgcaggatattacagagtacaattatataagaaataattatatatatgtaaacaaataaaagagaggacagatggtttttacacttcgttagtccaaacaactgatcttcctgctgaatcccaaatgatatcttttcctgagctactgattgataaatatggattgtaactgactataagaaatttaaagtccaaaagtcatgatagaaataaaatggtcacggtcactttcttcaattactgcatttggtaagatgtatatttcagtacattttctgaatatatgcaatgtgcacatacaatattttataaatgctaatgttttcatatcttactgcagacagaagagcatagcaggagaaaatcaatgaagcaagactcctaacttccttctttgccatccacctttgcaggaacatttgtcttccaggcatttgggaaaattatcctctctgtctggctccctttgtcctcataaaaagtgagagtaaagtgagaaagataatgatttatttgaacaaaggctagtgtgaggaagctgagaagtaaaaaatgactcttattgtttattttattttaccacattttacagtatctatgctccattagaatctggagatacctatgttacttaacactaaggtacacaaaattataaacaaagacactgccagttttatacattcctgtaactttaattttgttaatttcatttggcaagatgaattctagcttaggaaatcaataaccatttgtaagggaagcatctactaagaagaaatcaacatcgagagctctgtcagctttttgcttcctgagaataagggtagatgatggtgatcataaacataacgctgatggtgtttatttgaccacaaccacaaataccaccttctgtccaccagcatatacatgctattgatccactatctattcaatgttcccttagttaaaatgaaaaaatgtcaagcttcagaattttcattttatagatgaggaaattccactccagagaataaggcattgtccaacttcatacaatgattgaatgctgtggcctagatttgaaaccaggcttcctaactcatgcctcagtgttcaaacctggatggaatataccactctaagaacatttcctgtgaaattgatgggagtaaaaacagacagacactcacacacaaaaattataaaaggaaagataggcacatgattactcatggttactaaacagattaaactaccatctgctcatgggattcatttatttaattattgtctttcacaacatcagcgtattgctccctactagattatttttataaacaaacctttcttaaccatcatcagcacaacaataaaaacttcctgtaatctcatattttcctactcctgtctccctgcttcttttcccttgaaagaatcttttatagctgctactttggttacgttcttttcaaaccaacttcgattcattttctgggatcaccacactttttctgagttttgtaatcagcagtgactcttgctgccaaattttatggttatttctttgatcttatgctgctagacatcttagtggtgtttttcacaggtcagtactatatccttcttaaaacactttcttcttttggatttcttaataccacgttattttttctatccaacttatagcttattcttgggcttctttgatgagtcttataaatattgtgatttacagagttctgtgctagatacctttctcttttctgtgtatgccttccctctgaggcaatatgtagcccctggctttcactgtcatcattatgctaaaaaccatcaaaactgttttgtcaaaactcaaaggagtatctgttccctagatttatatgctgtttctactgatacgtgtaatagtcatgaacaacttagaattatccctgttggattctttatttttgctcccaaacccattcctccctcagtcatttcatccgagtaaatgacactacaatctgtctagctggacaagccaaaaatctagatgttatctttgattatttttttttgagtttttaaattccctttcctcacatctaatccaaagcctagtcctatccactttattctaaaaacataccccaagtccatctacttttctccatctccacaactgcttccatcatctttcacctaaatcagcctgataacctttttttttttttttctttttttgagacggagtcttgttctgtcacccaggctggaatgcagtggcgcgatctcggctcactgcaagttccacctcccgggttcatgccattgtcctgccttagtttcctgagtagctgggactacaggtgcccgccactacgcccggctattttttttgtatttttaataaagacggggtttcaccgtgttagccaggatggtctcgatctcctgaccttgtgatccgcccacctcagcctcccaaaactgataaccttttaatgagactgtttacactctatccactctacaattaatattctatacagtagctagagagatctttctaaggtgcagcttacattctgtcattcccctccccctttaaaataatccaatgactttcgatcattcgtagaataaaatccaaatcttgtcttcacaaagtttacaaacaatgtggactactggactactcatctctccaatctcgtcttcttctgttccaagtgtattctaaatacattgatcttctttctgtttatttgctcctcttaattcatcaagcgtattaaggcctttgcaataacaataataatagctattatttcttaagtacttaactatgtaccaagcactattttaaacatgtagccatattttttatttaatcttctcaataacactttgatacgatattatttctattgttacccatgaaacactgagaggttagaaaattgttcaaggtctccagcgaataagggataaaatcaggattcaaatccaggccgactctttaacccatgtccccaaccactttaagatgctgccttcccctagctattctctaaatggctaaatccactaaacaactgctccagtaaataaactaaatgcctaaatgtccttctcttgtcaataagatctcaaattaaatgtcacacactgagaggtcttccttaccctcccaatatcaagtagctccccagtcactctttataaaattgccctacttaaatcttggcattaaatttatttctgtatgatatgtttagtttgtttgtttatttgttttttaatttattctttctgtcttctcaccaaaatgtaagcttcaccagaacagaggtgtcatgctttctcattattgttaactctagtatctggaacagtgctttctgctaaaaaaaaaaaaaaaccttagctgggtgaatgaataaataaatgaatgaagcacataggtcacatacaaaagctgttcttttaaccacctaaaagtttgctttctacggtaagactgactggagtaagaatctattttccccacaaaaccaggtaaaaataagagtcaactagccaaaagaccactttacatggtcatcaaatgtggagaaactttatgcaaagcactttgtcccctactcagtgaaaagtaaaggacattttcatacataattatcatatacctaccttgggttttaagcaagtgtattgctttggagtgtaatatttttaatgtattcactatttcagaataagaaaccgaagatgcagttattatttttaaattgttaatgctttgggacattaactcttcgtttaaagtatgtttcttagattaacactacaaatattagtttacccaaaggatttgactccaggaataaaagttgtgatggactgaggtcaaataaagagtaatagcaggaagacaaagcctgcaattgggcattttgagtcactggtcagagagaagatagctaatggatgacagacatgaagcaacctgacagagagaagattacacagaggagaatcaaataatgcaaaacactaaattcataagtgttcataagaccttccctggccaacactagatatatattgatttcctgattatagggataagtttccatcgtacagacagaacaactacctttaagacacgtgtgcaggaacaaatcggtgagctatggtgaaatataactatatttgatttttttactagacacacatattcattttttataaacactaaacatggaacagtagtttaatttgcttgtttctatgttgacagcttatgagtatgttttgtggaagaagagtagaggcaaatatggctaaacataagatatatttcaggttatctaagaagactgtcttaacggaatgctgttatggtacagtactcatgactgaatttcaataatttttatttaatattgacaaatatttagtgcactcattgctatgtccttttcttctcaatacagatttggtccaatataacttctttctttaaatttcctttccagttgatttaaaaaagagaaaagaagaagaaaaaaggcaacagaaaggagaagcataagcaatagtattttgggaagctataacacgcgacttgcctccctgttcacctttgtattctcagcacctagaatagttctggtacaaaataagttcacagtaaatggttgtcaaatgaataaattaattattatatctttaaatagtaactattgtttttaccctctaacatatttcagagaaatgcttagtgctacaagaaagtaaagtttgctttctaaggtatgattgactggagtaagaatcaattttcctcacaaaaccaggtacaaaataaaagagtcaactagccaaaagaccactttaccatggtcacccaatgtttagtttaagagccagaagcttttaacctccggtacaaattctgtcctaagttttggccgaaacaacctaagactcagcagtatccctttgccatagagatgcaaggctggattagattcaagcaccatcgaagccaaagacaccccaagccagtgatgtgctgtgggttgtttggaaatgtcgattagataaggctcatggtatgattcagagctccaaggacagttcttgttcaggtttcaactaatcaacatcggattatgcacacctcaacatctgaaatatgcagacatttgagacaaataccagaattgtgtcttcttgctttgtacaaatcatgcttcagtctggcaataaggtacctataccataggaggcagtttcgctggtaaatcaaacttcactttgaagtttaattttatatatttttaaaattacactttaagttctaaggtacatgtgcacaatgtgcaggtttgttacatatgtatacctgtgccatgttggtatgctgcacccattaactcgtcatttacattaggtatatctcctaataatatccctccccactccccccaccccatgaaaggccccggtgtgtgatgttccccttcctgtgtccaagtgttctcattgttcaactcccacctatgagtgagaacatgtggtgtttggttttttgtccttgtgatagtttgctgagaatgatggtttccagcttcatccatgtccctacaaaggacacgaactcatccttttttatggctgcatatattccatggtgtatatgtgccacatttgcttaatccagtctatcattgttggacatttgggttggttccaagtttttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgtcttccacaatggttgaactagtttacagtcccaccaacagtgtaaaatgttcctatttctccacatcccctccagcagctgttgtttcctgactttttaatgattgccattctaactgctgtgagatagtatctcattgtggttttgatttgcatttctctgatggccagtgatgatgagcattttttcatatgtctgttggctgcataaatgtcttcttttgagaagtgtctgttcatatccttcgtccactttttgatcgggttgtttgttttttcttgtaaatttgtttgagttcctttaggctctggatattagcttttttcagatgagtagattgcaaaaattttctctcattctgtaggttgcctgttcactctgatggtagtttcttttgctgtgcagaagctctttagtttaattagatcccatttgtcattagtttggccatctaaaatgttaagtcaaactccataactacaaaatctgtattcacttggacaatagaaagaacttgaagttgccataaatttttacagattgtgtttccgcttggtaatttcctctgagtataaagttttgtgggaatgcacattacattatgtttgtttcatattcgagacattgtattaatctgtattcagaacaaaattggactcaactgacttctgagatcctgtgtatgtatattttttcaaataataataaaaatcattcacatttttaaaatatttttaagttttagactaacattttctcctttaactagtggatcttcaacaggagtatatttttccaagattgtaatcatttaactactttgaaaatgcatatcattcatacttgaatcatatgtacagtatcttttattacagctcctgcacatttactaaccactgtaaatttattagctttgatatatatattaagtgataaatattataattcataatataaattctaattttttaaggttgaaagaattaaagagcaagagattgctatgtcaatagtaagagttaaaagtttaaagaacagagtttcaatctattccttacaggataaaggccaaattaaaatgcagaatattcacagtttccacttctgcaaactattcacatcttccattttcatctacttcctggtcccaaggaagcatggcatgtaaaacctggaaatgatttttcaaaagggaatatataaatgtgatttttgctttataaaattaaaggctactaaatttttgcagctatttcaactttttacattataacctaaatattgtatgcgtgtagctggaaaattgtatgcttagaataaaaagcagtagtctccttctttagctctgctccgcagtttcaaccacatttaacagtttaattttagggctattagtgattatgtctatatttatattaacatgctttttttcttcaattattttggtttacagttttagacattgtttattgacttcctgctctgcaagatgaggatttagataacttctccaactctgctttctttcatgtttcctcctaatatgatttcatgactattcacagttcaaccctatcaatgttgtaatttcaagtcttagatttgaatcttcattatttttcaacaataggaaaaatctcttacctccatatttttaaaatacgaagacagttacacccccatctttctttccatttcctctcccaatgtttaattctctaacaacgtggactttacctattcttccatgttgtcatggttggaaacattttggctttcctgtaatcacagagcagatgagatctgtaagaagttttatgtaattagtttatgggctgattctacaagttagacatgagtgtttacattattatagcaatgtttatattgttccttgggagctaagtggtggacttagacacatttccttcctctttaagcccaatgtcatatttgttccattcaatggaggctattaccagagttaaattcaagtgaattattttgtatacatcaataaatgcctctgcattacccagtttctctagaggatctcatacagtctatctatgtatcaattccacttatttctgagacctccctcttggaactgtgtttccattctgggctgattattctcaaagcccactgcatagttgtcattctgggacaggaagtcactattttcttgtctgatgtcttcccctgtcttggtgtactcactgcaatatatccccaagtaatttctgaagaaagagttcattgtaggtaaatttttggaaagtgcacatgttaaaaaatatctttattctgttttcctctgattttcttcctaaatataaaggccctcatcattgtcttctagcatccagtattggtgatgagaagcccaattctggtctaattctacctgtttgcatgtgacaagctcatattctttctctaaaaagtttccatttcaatttactcttaatcttctaacatttcacagtagttttttagaactacttttagtagatctttttttcattcattatcatgtgttcttttaatctgaatatttaggtgttgttactggggagatttcctgtataatttctttgataattttctcccctctttttctctctcctttcattctagaaaccttgctctctggatgttggagcttctagattgatcctagatgcctccatattttttctcttattttcatttttatctcttttgctttattttggagataactctttttatcttgcaatctattttttaatataattatatttttgttttctaatagttcttttgtgttttccttttacaatactcagtatatattatacaaatctcttagaaggtactaggatcttgtctatcctctgagttatctcttctgtggggagccctggtttttctgaacatttacatcagtcattcttacaaactttttgaaaatatctggccatcctcggttatacatatatttttaaagttttgaacaataaatgtgcttggaaactcctgttattaagatagggcttggcagttctttctgtggtgagtaggcagggaaaccaccaacgtcattgtgtaggaggctttcttctggccctccaatgtctgtattaatcaccctaggtatactcagatcaccaacacagtttcatattttttttcctttgccttctgcagtcccgcatctacagatgaagatgtaatcaattgctcttaaggcatggtttaagtggtgtgcctgatttcagagtcccatctcactcctagcattctttctacttatgtttctgactcctttcttttttctcttcaaggcagatcatctccctcctcgggtctcacttgctctgcatagacacaaatgcatcttattccatcttcatctttaatgaccacttttcatcaaccctgccttctggaaattggttaaaacttcttcactaatggctcttgtacctttgctttgctttttttcttttgtttttttcccctcatgttttactcctttactattattttaatgagatcatagaaaatgaaagcagataaaatcatgtatcactccatcatcttaagtcagaattacttttccatgcttagaaaaaaaatcacatgttttatgacgtttttaggggaaaagagaggcccttctatttgttacactctacttacacttgaaattgttatgctcatatcatcagttgattaaaaaatgtatataggacattattaaaaataatactacttctacttattctgcattcagaaaatatactcaactagaaccattcagaatatgattaacattttctagttcaaaccaatactactttactcatatattgtttatgtatttgtaccaagtagagcttatatattctaaataggcttaatgcaaggtcttgcaattccatagataatgtcataaagtcttctgaattattggtccagttttactgatttgaggaaatcataaagtaacccacactatggatataatgatgccatcacatttgatttcttttacaaaaagggaaaaatatattcgattcaagttttatgaaatgctagagattattaaatttgtagttatcactaaactagtagtgcaaaatataatgttaccattcatcatcttcctaactgcaaagcttagtattctgccaattataaattattcttataagaagcacatatagagaaaactgagccaaaataagcttcaagttatagttagtttgtctttgatttgctttgggtatgtgttcttttctttccaaaaaaacaagaaccaacaggaactaatagaaattgatcaattctaaatagtcagaggaggaaagaagatatgtagaacaagtaggacccaaaagagttttaagaaaagaaatagaagaaaataacatgatataaatggacaagaaagaagacttttgtttagaccaaaacccaacattttataggcagtcatattgcctttcacaatgtgtatgattaataaatcacttctaaattttgctgttcaaaaatctcataaaactatatattgggtgctatgcttactacctgggtgcaatatacccatgtaagaaacctgcacatgtatccctaaaataaaagttgaacttaaaataaataaaaaagaaagataagcataataagtgacccaaactaatataatccaggtaaagggacaaaaacattattttaaaatacagttaaaactttatagtaatctttttttaaaatctcacaaaaatgtctagctttctgtttggttttggctttggaatttatgaagtccaagctatttctaagatcttattcacaggtgggctgggctgataaaaatattacaacttttttcattaaagtctttttgtcacgtattacatctcttcatctttcatctgtatgtgacttcagggtctgaaggtttgagttttgggggttttgttctttgtgtgttcatatctgccctgtcagacctgttagctgtataaggcatttacctttaaaatctctacctctttcttatagactgtgattgaatgttttattcttatagactgtaaagttatctttcttgggggcttcttctttgccaaacagaatgaaaatcaattggtagtgtttttctggctggtataagttatccatagtcacaaagcatggggacaggggaagggaaggagtttctggccatcaactaaacaggtctatgggcaatttgcttcatttgtctaactttttacttaaaagtagcagccactgaactggtataatgataatgatattcctcatttatttctttccggattgtacaaatcatttcccactttaaatttttatgtttaaaatttggagcattgaaaaagcaactcctcatggttcaatgtttggttaaaggcccagcacccattgtgaataatcatttattcagaaatgtgatattaattccatggattggcttagttttatgatccccttctttgctcttagtgtgagtatgcgtattggaatcattggctgcgttcacctaacacgtttgtgtttctctaatttcagcatgtggcaaactgatgaaaatcacaggcccagttacagtcaagacatctggaacccgatttggtgcttggatgacagaccctttagcatctgagaaaaacaacagagtatgtttctcccacaaacacctttgcttagaattaagttctgcttacactttttctcttctggactattcattttcttcagggatatttgtttgtacttgaaaactggtacataatttgcaaatattttctgtttgataatattaacatatctacgaaagaatgacaaatctattttagtaaaatgttccatcttccaattcatcactttagcaaatctaatttttattgattttagtcatgttttatgcttgaaaggggctaatttcctgtatactctttctaaaatatgtttagtatgaaaacatagcactaaataagtgaaaaactcaagggcaaacttccctgcctactctttctaaaatatgttctttagtatgaaaaaataggactaaataagtgaaaaactcaagggcaaaaccaatttactaaataagcttaaatatccctggagtctagaagtaattttaaaagaaatagcgctgaaacttctgggaggtattttcataagttgacaatgcctgtgctatataaatcaatatactagaaacttgccatagctctatttatgtcctattacagaactcagtaaaaattaagattctctagggttatttctaaatgaggttagttattaagttagtaaaatggtttctttaaaatgtagttgtacttacaggctagcccaataaacaagtgtttctagaagattctatggtacttatttcaattgaatacgaaaaactagactatacatttttttcagagcaagggatagaataaatgtaatttgctgaaggttgtatttgctgtagttttcactgatggcattatttatcaggtgtaatttgcattgacatatgattggttcactcagtgatatgcaccaaatggtcaggaatttaaaaaacaaagagagaaaaagcaaaaaagcaaattaatgtcaaggtagtaaattcagttatttcttttccacatggacagaccatagcaatatttttacaaaagcctgaaatacattgcggcaggtcagcagtaagatagtgtggcttccagagcctgagaattataataagtgttgactctcactgtctttcttttggggttatcagaaaagtacagaatttagtcactccatttatttttttccttcttctcaggtctggtacatggacagttatactaacaataaaattgttcgtgaatacaaatcaattgcagactttgtcagtggggctgaatcaaggacatacaaccttcctttcaagtgggcaggaactaaccatgttgtctacaatggctcactctattttaacaagtatcagagtaatatcatcatcaaatacagctttgatatggggagagtgcttgcccaacgaagcctggagtatgctggttttcataatgtttacccctacacatggggtggattctctgacatcgacctaatggctgatgaaatcgggctgtgggctgtgtatgcaactaaccagaatgcaggcaatattgtcatcagccaacttaaccaagataccttggaggtgatgaagagctggagcactggctaccccaagagaagtgcaggggaatctttcatgatctgtgggacactgtatgtcaccaactcccacttaactggagccaaggtgtattattcctattccaccaaaacctccacatatgagtacacagacattcccttccataaccaatactttcacatatccatgcttgactacaatgcaagagatcgagctctctatgcctggaacaatggccaccaggtgctgttcaatgtcacccttttccatatcatcaagacagaggatgacacataggcaaatgtgacatgttttcattgatttaaacagtgtgatttgtgataaactctataagaccccttccgtttttttcttcactattatttttcatcatttctccaaagcaaagcatttttattgtaaagttggtgtttcaaaaacatagctgagcttgtctaacttaccatgttggaaacacatcttaacttctaaatttacaaggcctatcatgtccttgtcatgaaaagcactaaaaaaaaaaagagtttaagtggctaaagtcatagttttgcaagagattaatgatctgccttatattagagtcagagactaatggtggcttaaatgcacgaatgtctttttttttaaaactgtcattttttactgtcttttgctccatatcaggaaatattttggtaggaattaggagaacaaaaagcacttttatcccatttatttctttaaaaaatgtaaggatttcatttatattgaaaaataatattaatcattttgctgttaacacaattctctgatgcggtgctgtacagtcatttttaaatctcttgctaacattttattggcagtatgtatttctaccattgtaaccaccattgtgctattgtatctcttcacttctgtgaaagtaatattttttataaaatacactgaaatttaacctcagtaattgagtccattttcaagtgtggtcaagaataatcttcttggcttacccctttacataagcattataaactaaaatgaaaaccaaaccagacacctgacatagagtctttattttaccccaagttttttgggccactgacattgaatgcaacaactgatttcatacaactgagttactctgttcactccactgaatgcaacccatatagtttcttgcacaaggtgcatctggattccaaatattggatttgagttgactctactcatttattatacactaaagaaattttgttcttcatagttaaatgtactagcatttaatttatattttacatacaacttgcaataatgaaattccttatgtcaggaccctgaaaataagcacatttgaaaactcttagaaaaaaaaaattctgtaatgtcctctagatttagattatgagccctgaggagttattggcaagatttgtgcaaaataaaatatggggagacttgggagttgtctttgtggtttcaaaagtgtaaataaccaattcagaaaacaaaatggaaaaacgaccccttgttaccttgattcactgtatgtggaaaaataatgtaaccaaaagggaagagctttaataatacttatgttaataactctatgaaacatataagctaactatatatcaaacatttcattgagtttggatgtattttccacatattaaaaaaatagttccctaaggcagctttatggaaactaatataggttggttttacaatttaaaaagtatattctataataaataataaaacaaattgttttaaatgtttagtttcacacatacatagtaccatgattttctttgaaagataaggatgtaatgatttagataaagcatcatgtaaagaaatcctaacatttaagtgtaattcatttcaaatgtcacaagtaaagcatcatcctcaaatatctcactgtcaaaattgtagaattaaataacccaatcttgaaa

SEQ ID NO: 112 - DNA, 102738 bp, Homo sapiens
agttggcggctgcctccggccggccggactttgcgagcagcctggagaggatccgcgaccgccgccgccgccgccgcggaggcttcggggctgcttccctcgagcttagcccgcagcgcgggtggagaggggcggggagggggtcgggggcacgagaagaacttgaaaccgtgtgaaggaatccggagcagatgagaagggaggaaaataaaagaaagtggagactgcagaacagactccgctgtggctgactgtgccggccgacgctccagctgaggggctgggttggatttttttttttctcccatcctctcgctctctcttttaaagcgacaccagctctctctcctcctctactatctcggtatcaccaaacccttgccggctcttatgggcatgaaacactcctcccgctgcctgctcctgaggaggaaaatggcggagaacgcggccgagagcaccgaggtaaggaggcgagcgagcaggggctctcggagaccccgccgcccacccggaccaccgcgccgccgccgccgctcagcgccgagtgccaaactttccccagtttcatcccgctcgcttctgccggcctcctcctgtgtgtgtgtgtgtgtgtgtgtgtgtgtgtgtgtgtgtgtgtgtgtgtgtgtgtgttggtggggggtgggggggaagttcatgtctcaggtcccctccctcttgaaaatgcaaaacagtcactctcaccccatcaccctctcctgccacccgctgctcccttctcccgcccccaagtcccaaaccccgggcagccgcgctcccctgccctctcctctgggctccgtgagggctcccgggtcccggctttgtgcagagctggggtgggtaatcctggggccaggtctgccccctgcagtgccttgaccgtctcctgccgctgcctcagctttacccttcaagctcgagtcggttcccgagctctccgtccccgcagccgcgcggagagcccccggccgcgggggccgagccggcaggaggactcgggcacctcctacagaccctccggcccagatctgggccagagagaagtctgcaatcctcagatatcagagccgcctctgggtagctaaacccggcagggcacacgggccgcggccaccttcagcaccagggacagcgtccgcccctgcagcagccgagcctgcgcggactgtgggggctgcgcgccgccggctgcagtgagaaatgggtctgcagccacccgtcccgcaagggcttttgaggaggtcgctctagctccgcaaattgtgttctcggcccccgccttcggcagcctttttctctactctccagctggccctgagccgcagagagccctgctgggctttgcgtcccgagactcgaggctgtgatccctcgcctccctctgaccccgctgtcattacaacaaccggactattccgtaggctctgggcacctgtagtcacgaaggggatcagcgtgggcagcccccttaccttcctggagaaacggtgcgccgagatgggggcggagtggggcatgtgtgtgaagatcatcccttactcagtggcaggaaaaagacacagagagcaaactcccaggctctattaatagctgggtgtctggtggggctgccgcacatttcacatatggttacccatatgcagcggggggcggggatgggggtgtggcgcggggattgtccctctgtcttgccggaatgcaaaaaggtagagagacccttcctggtcttcttccctcgagttcttaactctgcgctaaaacccctaccccacggcgtaggcagcaaagctttataaatcccccttctctgagagactagaagcagcatgcatctgacaattgtcaatttcaaaacaaacacgctccgggacttgaacgcagcggggcattcagtagcgaatgctgtctccttgagttagggcaaagcctgcgtgcccgccgtcccctcaccacttcctcttccccagcccccacctgagagcagacattcggaatgatgtgtagtgcgaggcggctagcctcccagcagaaagccatccttaccattcccctcaccctccgccctctgatcgcccacccgccgaaagggtttctaaaaatagcccagggcttcaaggccgcgcttctgtgaagtgtggagcgagcgggcacgtagcggtctctgccaggtggctggagccctggaagcgagaaggcgcttcctccctgcatttccacctcaccccacccccggctcatttttctaagaaaaagtttttgcggttccctttgcctcctacccccgctgccgcgcggggtctgggtgcagacccctgccaggttccgcagtgtgcagcggcggctgctgcgctctcccagcctcggcgagggttaaaggcgtccggagcaggcagagcgccgcgcgccagtctatttttacttgcttcccccgccgctccgcgctcccccttctcagcagttgcacatgccagctctgctgaaggcatcaatgaaaacagcagtaggggcggccgggctcctgcgaacaacaacaaaacaaacaaacaaaaaaccacgtcgcgtgcggggcaccaaggcggtgcggggagggacagacccagctggggctccttggaggggtgtgagccaggttggcggatcggttcttagcaacttccctggagaaggggtagaacccagacttggtcaaacgtgcctagcggaggcatccaggcagcgtgacaatcacttggtttccctccaggaactggctgtttttggaataagccaggactagagcagcacttccaaaagtggggtgttgtggacttgcctgcatttatggtagatgagagcggcaggagcacgcctccacgtgtgtcagtgggtggtggggagcgtggtagtggtcctagttctgaattccacacctctttgtcaagcaccggctctgtaccaggaaagctaggtacccaagttccaaacatgaggaccacctggtccctcctctggaggggctcacagtctcatggacaactatgatggataatcctgtagccaccttttcctgctttttgttgtttatctcattccatcctcacaacaatcctgtgagataagcaaagattagtattcatttcttatacccattttatagttgaggacaccgaggctgaggtcaagcaattgctgaaagtcttctggtgggttaagtcagccctgaaacacagactgcccccacttctgattcattgctgtttgccctgcccttgctatttctaacaagatgccatgtgtgaatgggagtagatgaggagtgggcagagaggaatactttggaagggagagatgcagtgatggaggtgggcaaggatgggagaaagtgttcgttcaaaagctaaagctacggagagatactctaaccattgggcaggaagggagcaagtgaagaataaaactacttacattttgaccaaagcctccctccacaaagcgaagtacccagctagggtacgagagcatcaacatcacgtgcttgctggacactgttggcaatgggtggccctgggggcactcttcaaccgctctgacctcagttcccttctctgttaacttgagctgattctcctcatggaatagggcaggtatgggtataaggaaatgccaggacagcccctggcacatggcaaacacgcaatagtgttagttccatgtacgctttctcctgatcactcagctatgcttctcttcctcggctaagggaatcaccattctgccagcctcttctccctctcccctgttccctaggtgtcatgagaaacctcctctgtggccttctggaacatttgcaaagcctccagtcccactctcctcttcagcccattgtcagtgcccaagacacatcatctcacctctgccctcactaaggcactttcctctgaactgtttgtcctcttctctaatcaagcctcataatcctactgtactggatcagctttctgaagcacaaatctgctcatgatcaggcatctctttaaaaacttaggatgctgtcctattgcctacaggacgctagataaagcccagtttccttagcatggtgtgcaaagcccatcaatacctgcatcatgcaattcttggaaaagacctccgactgcatatgtgaatgcttctgtgcatactcttccctctgcctgtgccggtctttcctccttcttctctctggaaaacaatctttttcaacctgcaagacccagctcaaacgttacctcctctgggcaggcttcccagatctgccatttatcctctctccccagggaggggcattaccctttcttatgtgttcctaacgcctgtctctcacttttcctattgcaagataattggctttttgtgtgtctatttatatgtctattagataatgcacttttttttgaatttgtgggcctgacacacaataagtaataaatgttaataaatgttgactgaattgatgtatgtgattgtgaacaaactcttgagcctaatgggctttagtcactcatggcttcctggaaattgggattcctatctcccaccccacctgtctgctgtacttagttgctgtgaacctttgaaactcaaaatgggtaaatattctgggaatcaaggtgctgaagccagtcaaatcatgggtacattttggttattcatgtacttattcaatattcagtaattatcgactcttactatggagtgctcatctgaatagcagataaatggattaatcacaatgcccaattatgaaccatgggggataatggaccctcctgagctactgcttgctttactgatacttggtgaaagtctgatgcatgatgcattatttatggcgatgactccctgattagggttttatcacctcaaaggagagcccccaggagttgggaaacagttttagcaaagagtcactttggaaactgatatatatatatatattttttttttttttttttttttttttgaatgttctgttgacttgctggcccagggagagggaataattacaggttggaaaaaatcctacaatgtgacaatgagattaggggttgcagtgagttatggggataactgagctgacttcttgcatggtgtatcttggtggttttggctaatagatctttctcctcaggaagttactttcagctgaagaatgtggtcccattattacaggggttagggaattgaggaagaggaggaaccaggcatagttctctgaggatggtcttcatctatgtctgtttctgcagagtgtgtacactaactagtaggctatggagacagacttcctggttttcaatccagttctggacctagtagatgtgttgctacattgagcaagttgcttaatgtctctgggccttttaagattgttgtgaagatgaaaagggttaatttatgcaaaggaattagaacattgccttatacatggtgagttctcaataagcgtttatgattattatcctgctagcttttaggagtcttgccaaaaaagtgcaaactgaaagtattctcccactttctcatttctgtagctgaaatgatccataaaaccatagtccatgtgactttttcctccctccgcaaacactgatttcagtccttaagtgagctcaggagaattaagaagatacccaatttttttttttttttttttgcctggctaatttggcttttcagagtcctaaattggcttttggctgtcaaagacagtgaaacacaacactcctgtctccaattcaggagtgggtttcatttcctcctctttgctaactgcaatgtgaagtgattatcacataccagtgtggaacatgcaaaaatctgtaaaaacagtccttacaccttggagtctactctgccagcagggggaaaatgggcagcctgaaaatatgtgaacagccaaggtaactgaaagcagcctctgtgtgtgagaagcaagcaggtggtgctgttgtgaactggcttagtaacaagatagagtgagcacaggcaagaagggacctctgaaaggtcattctgtccatgcctctgtccctgagaaccacctaaccgaagatgcattgttggccacttggtctcttgttaaaaagcttcagagaagggaatttccccaaactcctcgagtgtctcagtagtcggaagttctccctgaagtctgagctcaacctcttcgattgcaatctgagtcaccttcgtttatgttattctaaaaagagatgaaaactggctgctaccttttcatttggggttgtctcaccatttttactagtttttgttccaattgattccaatccctttttctgatattctggtattagacttctaataggaatagctaggagaggagtgtttgagatttgcctctccagtattatccagccaaaatagccactggatatttcacacatcaaatgtcttttcttacttcacttgttataagaattccctcaagcatcacagtttttcccatatttgtaatgagtggcccataagtaaagatctctttttaaagtgtaattttatattgagcaaacagcttgatgtgcgtattttcataaagtcatagaatgttaaagttgggtggaaactcaaatcacttaagtcaggagataggaactacttgtccaatatcacagagctcttccgtgttggggtcaagatcctgtggactcctgggtctgtgctctttatacctcctttaaacgtagcatctcatttattgtttttattttttgtgccaactttctggtatatcctgatctgtactgtctaagaccagtgtttctctgcataaggtctaggaattgtgcatagtgagagctctgaccttcttgtagaacttaaaatgctcgcttattacattgcattgtgtgcaatgctgtgaattacatatatccccattgtatggattaataaactgaagcacagagagttactgttatttgctcaaaatcccacagctggtaagtgatgaggctagagctcaaagtctggttttctaatcaccaaaatgctttttctagtccgctaggctgcgaaggcatgagaagaaccagagtacaaacttaaaatgtgaagagaaagggtggagaaattaacagcaggaatgtggaatggtgaatttggaagaagcctaggaagagacaccagcccagctttcctttttccaggacgtcttttcttgcttccaccgccatcttgccatcctcactttcacagtctccagtactgtgccgtgtgagtgacaggggcctgacataattgtggcagggacagccatcacctcactctccctgcgcatctaaactatccctaggcgtgggttcctagctggacccagtagacaatgtacttgtctaacaaagtatagctcttcggaagcttgaccctaggccatcaatattagatctggactctcatccagctactttattgggataaaatgaatactaaagtctccaggacaggaactttgtttcttaaaatttatctttgtagtttcatcacctgtattaccctcctaggtctgctgtaataaagtaccacaaactgggtggctttaaaacaacgagatgtcttcttccacagttctggaagccagaagtctgaaatccagatgccagcagggttggttcctcttgaagtcttcatggagaatctgttccttgcctttcttctggtttcccgtggtggccaacgatgctcagccttccttggctatagacacatcatctggtctctgccttcatcttcacagggcattctttcctgtgtgtgtctatacgtcttcttataaggacaacagtcttgttggattaggggccactctaatccaatatgacttcatcttaacttgataacatctgcaaagaccctatttttatttttatttatttatttattttttttttcctttctttttttttttttttattatactctaagttttagggtacatgtgcacattgtgcaggttagttacatatgtatacatgtgccatgctggtgcactgcacccactaatgtgtcatctagcattaggtatatctcccaatgctatccctcccccctccccccgaccccaccacagtccccagagtgtgatattccccttcctgtgtccatgtgatctcattgttcaattcccacctatgagtgagaatatgcggtgttaggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtgtcagaatgatgctggcctcataaaatgagttagggaggattccctcttttcctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttaggctgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagtggctttgagtgagattcttaatcctgatttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatcctgttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccaagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagagacgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgctggaataccctgccgtgtgaggtgtcagtgtgcccctggtggggggtgcctcccagttaggctgctcgggggtcaggggtcagggacccacttgaggaggcagtctgcccgttctcagatctccagctgtgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgttgctcacgctgggagctgtagaccggagctgttcctattcggccatcttggctcctcctccccaagaccctatttttaaatgagctcactgtcacaggtactgggggtttaggacttcgacacatgtttttggatgacacaattcaacccatgatgttactcaacacggtgcccgccatatagcaaatggctgatgaatggcctcagaatagttgcaagtccgagaaagtggtctctctcccttatctctttcctgcttctcactcagctgcacactgcacccactggcttcccagggtctttatcatggctttttccttgtgcagtagcaatcactatagcaagagctaccattttagcatacatattatgggttgggtgctgtgtcagtcactttgtaaacattgccttatttaatttactcaacaacattgcaaagcaactcttattaattctgttttgcaattaaggaaactgaaatttgcagagtttcattatcctgatcaacattatggagccagtaagtagcagagctggaatgctctctgctgttgacatggcctccttcctctcttttgtccacactcccaaccccaggcttgtcctaacctttgctccacaccagctcctacccacctggagatttggaagatacacttccacgtgtggaaacgagcctataactgattggagcttgtggccctgtaataggctccctgggttagatcccctcatcttcctagcggttttgctttgtagttgtcagaggaattactttagtggtaaacttgggcgctgatcagcagcttatttgaagggctcttctggagggcaggaaggacaataaataactaaaacatgtaggcccaccgacttctcagcctgtagcagttctgtgtgggggttaattgtgcaggctctggggttagtgtggggctgctagctgggttcaagctcagctctgctgcttcctagcttgcatcgcttactgcagttatctgtgtgtgggattcatcctctatgatatgtatgggtagtggtgcattatcccatagggttatcatagggactaagtgagttatttcacataaagcacatgtctggcacatggtaaatactcaagaaagattagctttattagtaatctgggcttacccaacagtatatgaaaggagaacagataagtacagggccttgtttgtgacagtgtggaatcggcactggaagagacgggagcagaacagttgagggaaggcacctttgattcaggcaattcatcctcaggttagccaggtggagtcaagaaagcagctgaagacagtgctctttagcttccctgcccagaggtccactgtgccatgtgaagggcccattacaggaggaacagggagcctcgtgacccacaggctgcctaccgcactccaggctcactcccagctttgggatgtagaactcaggtgtttgtccacatctatcaaatgaaaatgaagcctcatggagttcctacaggtgtgagggaatgggggcacggaagagaagtggtcattctctacgggaggctccctcgagatagacacgctgtctcaggcttctctcaggcttgacacaccactcaagccttgctcaattcctacatgttgattactggactgattggtgactttcccctgtgctcctaccgagagaaactgaggcatggataggaggtaggagagagagatacacaggctgacatgacaatttggaggtttaattattgagttaaattccccgtcttcttggcgctaaatcctgcagaatataagctgtgtgagtggtacagctaaggccaaattgggctaatgccactataaggggaagggctgttaacaaattcctcaattagggccccatttgtcactgtattgtgaaatatcatctcttgttagctaaagtaaagcggtggcctttctttttttttttttttttttttgagacggagtctcgctctttcacccaggctggagtgcagtggcgccatctcagcttactgcaagctccgcctcccgggttcacgccattctcctgcctcagcctcccgagtagctgagactccaggtgcccgccactgcgcccggctaattttttgtatttttagtagagatggcgtttcaccgtgttagccaggatggtctcgatctcctgacctcgtgatccgcccgcctcggcctcccaaaacgctgggattacaggcgtgaaccaccgcgcccagccaagtggtggcctttcaagcctgggtctcccagaaaatgaaagactataattcccatagtcacattaaattcaaggacttcctctctctctgacaagcagttatgacagtaattctctggggaggctcagtcaaaggattccacaaatgattatagcccatcagaagtgtagatagggccctaattaaggcatgttctctattaacatgcattagttcagttttcgcccacaggtacatagtagaaaattgacgactactcttattgaatgagtaaagaaaataaacctgtatatagcacatactattccttttgttagaattctttttcttctccttcttttttttttttttttttgagatagagtcttgctctgtcacccaggctggagtgcagtggtgcgatctcggatcactgcaacctctgcctcccgggttcatgcagttcccctgcctcagcctcctgagtacctgggattataggtgtgtgccaccacgccctgctaatttttgtattctttccccttttttcccacattaaagctgttgacccagtatggtgtaggggagagtataatagtcagatctgattttggatctcactttcatccctgtgggattataaatcccattttataggctggccatgaggattacatttgataatgggatacgacataaagctggtagatgttttcttctttttcttactgttacaactttaagatttttttctgcccagttgttgtttcacttttaggagaaaatttatagttcataatgggaatagtcaattctgatgttcaccgaaagtagatataaatgacctattccagacagactgcagggtgtcgggatgtttctgtgtggggatatgtacacgcttctgagtcagtaggtgcgtcatgcaggagaacatgctcatatacaaacatacatatcctgtgtgatttgtagttcataatatgtgagacatgaggtacaagtttaattaccggcctggagcttctgagctacacacagggtctgacatctgaacgcgggagagtgtgtttcctgtgagaaacatgttaaggtgaggccgggcgtgggaatagttgagggagagtcttgtaaagatagatccgagttttagggtcagagacgttatgcagccctgactttgcagctgatgtgcttcgttgattctgtgagttgtggtgctgtgggcttgttccaggcagggttctggtcaccttctctgcctgctgtctccgggtgaccccatccactctctcagcgtcatgaccagttcccattctcagactgcagcccacatctctcctctgagatacgcgaggcatagctgcctgcctgcgggacatcttcactgagatgtctcataggcacctcaggttcgctgggttgcctccggagtcctgccctcttcccagctcctgccattctcacttttcttggtaataagtcaccaaaatcacaagcctgaactctgctctctcctttctccataacaagacctggcgattctacatctgaaatgtttctcctctttgtcctgaatctgtcctccccattccaggcccactgtggccgtccctgttcgtgtctcttcacctctggcctggatctctgcagtgatcttttagatgttgtcttggttctcctatcacagcagtgtgagtgcatattctagaatagaaacctgattatgcttctcccttccttaaaccccatcagtggcttttccattattcttaggatcatgacccactcctcacccgggctcaggagcccctgtgtaatcatgcccctgagtcctcttccatccccatttcttacaagcccttccctctgctccagccacactcagctgcctacctcccttcctcgactcgttgctcctactctctcttcaggtctcagtgtggatgtcgcttcttccaagaaggctttcctgctaccaccttcagatccaagtctcctcctatgttatcctatagtaccagttcctgctgtctcagcgcatatcgccttgtgctttatttccctatttcctcatctagaagtcaaccatcaactttgtgagagtagacactgtttatgctctttaccactgaaccccagcatctaccacgatagctggtgcctgctagagacttaaaactatttgttcaatgaactatcattggccacatgtacctttcctgtatgaaaaaaaatgttctatggatgctagcaattaaatgaatatttgttggtcccgttcttaattcagtgattgaggctgtatcagtcacagaggatcccactagaagagtatacctctgaggtcaaagccaccatccatctgacctaaagcaagtccgcagttaagctgtcccagttagatgttcactgctgaagagcaaagtcaggcaaagtcagagttgcagagaggtttttaatcaatgcaaactgagtaacagattttcgcatagacaagtgtaaccggcacggcataagtctcagaaagggctaggggagtgagggctttgcctgagacaatcaagaatgccctgtgcttaggcagtggcagcagagagactgtagggagcccctgaaaaaccttgcttgaggcaggagtattttagggtttggaggagccaatatattttctcccttgaccttatccaccattactggctgctctgagcagaagatgcagtgggggatgttctcagaccagagatctgaactgtcctgaggccaaggctcctaattgcgggcactcagggcctggggtcctgctctggggtggggcggctctgcagagtggacatgacccctgctcccagcgtggtccaggtccctttactcatgtgtgctgtgggtccgacacaaccatgaacttttctctttataataaggtctagggttctatatattgcactgtaggatgactgcagtaaacaataatatactatacagtttcaaataaatagatggaagatattgaatgttcccaacacaaagcaatgacaactgtttgagttaatggatgtactaattatcctgacctgatcactatacatcctatgtattcaaatattactatattccctatgaatatgtacagttatgatttgtcaatgaaaaaattaaattgaattttaaaaatagatcaaaataagttgctccctactcgaagatgtaaagaaaaccaaactaatggcttggactgccagtactgcagggcctggggccttgtccacaaggccagctccagtggcttttcttggaggcttaaccaaactgctgccagcctgtaccccaccccactttcttcttacagctttgcctcagcggcagaaatcagagttttcagaggtcttcaggtccacctccacctcgggagtgcactccacgtaatccagtcaaggcagcagggacctatcctgagccccaaggagtagctgcctcaactttccttacacattcactccagttcctcgggccctcagctgataccaagtaacatagaaaaagtcaagaatcaagagccagaacccgtgatcctgaccctgctgcagagagttacacatctgaaaagtggatgaaatgatccccatctatctcagtctgtaggcttaccccttaaataaatggagacaatgggcatgaggactttaagaggtaagaggttgtgtgcagatcttacattttgctcttataacctcacactttgcctgttataaccttgctctctcaggggcctccagggtagctccatgcctgtcttcccttatcatgctgttgatggagctggatgccagctccacatggctgccccttccagacatgcccatgggtgctgaattcgtgctgttgaaaatggagagatgtttttcccttaggcagcaaatggcatagaaggtggaggtttggggagcagcaggaagacttggacaaagaacgtaaggggctgtgacttggataaaggacttggacaatctgaactttctgggtctgtgacttggacaaaggacgtgactcactgcaggcagcctgctggcaattatttgtctggggaagaaaccttgctccagaaacctctgccttcacttttgtttctcacctgctggctcagtcttctttttctcttcccttcccaggcctgggtttctatgcatctaagtgcaagagctctttcttttccaacaggagagactgtgaggggctcactatccaagtggcagccccagtttttcggctctgggctgtgtgggcctgggtgttggagagaatccagtcccaggcagctgttctattggtgcctgcttcactgggcagttgatgcataaccttacataggtgtcaaggatctagactgttctgaatatgaaaagagctaaaggggaaaaaaaagcaaagatttgagtttcaaatccattaaagccatccttctttggcttcctaagtgtgtagtgctggaccattatttctaaagtgctggggctggcttatctcccaggacataggcctgagccaggatgctgtgttcctttgggtaccatggctggtgccagcagctgaacttcacactggggccttgggagtgtggggggcagtgggaagtgattccatggccatccctgcagttactttcctttgatgtggctcttgacagtggccttggagacccccttgtgactcactgcagtggactctccttggtctcatctcacctggccaatcagccagctacactagacactgttgcttgttgcgtttgacttgatacccactgctctgtgggcttctaagctctgctttctcctgcgtctcccacctccctgactgttctctctcaagctttcctgtggattcttctttctcgcccagggatgttgcctccagcctactgtccctgggtgatctcatcctcttctacatcttgggacatccagatctgcacttctggctggatttctcttgctttgtgttttgcaggcactttaaattcaacatgacccaaactgagttcctcacctttccttccaatttgctcatctgcttctctccttgtctgcctgtctcatggagggcactgccattctccccttcaccccagccagaagtcaggaatcagaccagaggcctcccttactctcaactcccctgccccaatctcagatgatttatgacaaaatcctgctaattctactttcttaacactgtttacgtccatctccttctctctatccacattgccctagatcagcactcattaactcttcttcccagctcttgctccgtgcctgtctcgtctccgcactgcagcacaatgcctggccaacaggatgacttagtggatgttggtggaatgaatgaatgaataagtaaatgaactatgggtagagattgcctgctcaggggagtaatgcagggtggttgttccacagctgggtggcattgtgagtaaccaccaggcatcaccattcttcatctcatttgccctcagtgagctgcttgtgaatgaacccactttagaacgaggtttgtgggattcaggagactggggctgttgtccaggctctgtaacttgctcatcatgtgacaggtcctttttgagactatttttgtccctgagagaactgcaacaccggggatcaaagggtttgagtgtctcagttgctctgcgtctaccatgcagcactctccttggaaaggaagaaggacaaagatagagatagagtgaagctggaaaagcggcggaatctgtaaggaggtatcttgctagtttcttaacgcaaaacattgttcaatcccccatcatcacccagtcgtctcagaaagttctctgttcctctttccctcaggacaaagagggcttggtcttggggattctggaagcctctttgcagacccctgacacctaaactaaatatacgatgtacctactgaacagataactcctatttcagtttcccttatattttggcttgaacagggattttatatctagtttgagtagctgactgtgtgggtcccagtaagtcccttagaccctttgagcctgcgtaatgacatcttacctgaagacagaggctggggcccatgattctagcacatcttggaatgtgttcctttctgtgtttccttctgttacttctactcttccaattgcagtttttagggaatgcgtgcgctccgtgagagtgcagtcttctctgtccatggtgagttccctgccgaattttctctacttcattgtatctggatccttttggaaagccagctatgtggttctttcatgtcacttttcctgtcctcagcccctttcaagtgttctggagatgagagccagaatatgggtatagagagcatcataagttaccagtcttggaaaaatgtttaataacaactattttagttcagttcattgcctcagcagatccattccctacagtatgttattttgtggtactttatcctgttcgattttagataatgaataatcacaattataccaggtactgctctagtgatttcctcctaggagcctatggtgacttagcacatcttggaatccttcttgagcccccggatactgaaggatcaggcagatccgggcagaggcagggggcaggggcaggatttattgtgattgtcctttggagagggaagctccaaggaggggactttgtcagggtcaaagagttggccgcagggccaaagtcaggctgtgagccctgactgttccatgtgtcaggctgccgtgcagatgttctagcctctctgaattcatcctgccttttttttttttttctgttacccctaaggtgctcttttgttcaccacagaatactgagcacttctggttcctctgaggttggtatccggttggctcagtgtcagagccctggctgggctggcaccaggaccctctggctcaccttgtgggggatgccagcaccagattgctgttggggtgtggctggcattcgggctgcaagacgtggtttagagaggggttgctcacccaggcctgcagagcctctccaaatccatccgtacttccactgaagatgtccaatataagcgggtcagggtcaccctgcctccaagtggaatgtaaatacataacacgtggagccttttttctgagtgtgccagcatcccacatgtgcccttccagttcactctgcacctgtctgcaccctgctctggagaggtttccttgcaaagctgacctttccggctgggttctgcctgtgggcgacaggagcaccagtgggagggcaacaggagcaccagtgggagggtgggggagggaggggcattgattccctcggcccctccctatgggggtcactgtcgacctgctctttccccgacctgaaactttcgtgtagcagaccccatactccttcatggcttctgggttccagtaacttctcccctcttgcctcctacatctaggggtcatcctggagctcctctcttaccaatcccaggcaactgccactttgcttcctctaagctatgttgacaaacagaaattatggatgccattcatccagcacttgctatgtgccaggcacttttcgaagctttctacatgaattctgtcttttaaatcctaaaaaaatcctctaaggatatactaatgtctccaatttacaacagggaaactaagacacaaatgggttcagtaaatttcccaggataacaaggtttcaaacaaaagcagtcctattccagcgtgcactcagcatagggtctggtcaacaggtgctggctgtggttttgattgtggtggcggctgctcattaggattgctagctgctcacatgttttggatgaattcagaaaagcagacctggtttgcaaagttaggtccaccctccacctgctcactggtgtggtccctgggccagtagcatcagcgtcacctgggaacttgttagaaatgcaaattgtcagagggatagccttaggagatatacctaatgctaaatgacgagttaatgggtgcagcacaccaacatggcacatgtatacatacataacaaacctgcacgttgtgcacatgtaccctaaaacttaaagtataataataataaaataaaaaaaaagaaatgcaaattgcctccccatcccagacctgctaaatcagaacctctggggacggggccagcaatctgttgtccaggtgattgtggacatgctggcttgacagccaccacactgcacagaacccacccacatgctctgtgagtagaagcacattgctttcctgcaggggtatttacggtctctgcactctgagcctggtgtggttgaactagcagggcgggccccattctctagcttgctctgcgaaacaggctgccttgacacccatgcattgtcgttagtgctggcagttcctatttcccatcttctggtgactgtggccagccagaagcccaggcttccctggtggttggtttctcaggtctgtgtacctatttgtcctggctctgtcttttgctgctcttctccctgatgaatttaactttacctgtaaggtctctggtagctccagcttatagtttggccttgtgtataaagtatccgccaatagttgacccagctttcttgggctctggagtgcccaacctccttctgagataaagcaaggcagggtgggccattcacatggtggagcatctcagagcagcattgagtggggccagggccatgcttgggcagttgaggaagcacttttctttaccataggccctagggctctctggtatggagctacctggcatgtggcagactgggtctccaggattggcttcagctgctctgtcactgtgcttctctgctgttttctttgcctggtcccctcttggtgatttgttaaggggttcattcattcattcattcattcattcgtttgttcatttactcatgcattgcattcaacaaatatttattgaatgttcactcagcgtaagagacagttctataaactgggattatagtacagaggagcctgatgctgccagcatttacagagctttcattttatgggggaaacagacaataagcaaatatatgaagtggtgtccggtgctgaagaaagttctgaagaaaactaaagcaagtaagaaaatagaatgtgatggaggtggcagtgtttgcagagagggtaatctggagagggcattctgaaaaggtgacatttgaataaagacttgagtgaggttaaaggaaataatgtatacagtggtccatttccaagacaaagggccttgatttggcctaggtcagcaaactacagaagaaacaggatatactaggcccctgcttcgatagccgatgcttgtttgttggcctccccctccccaccttccccctcgccccttagttgcgctcatccaaaccaaaaaactttcatctaaaataagaatttaccagtctgcaaaatagctcacttttgtccattcttatcagcctgcccagctacttaggtcatatgtcaaatactttaagagcccctgagctaactaggattgcaatgcattgtgggctgcaacaaaatgcagcaagacaacctaaaaacaacaacagcaacaacaaaaacaaaacaataaaacacctaaagcccctacccaacaatcaataggcaacgtccaggaaaattgtaaccccatagtacccagcctgtgaggaactgggggagggacctgtgcaccaggggatcagttgcttgttgaaactgttctgggtgtgcccgctcatcagacacccgatcttgtaaaatcgtcattaaaagtctcactttcgctgttctccgggtctctgagtccattccttgggtttggatgggtgactttgtttctcacaacctggtggcccgtacagagatctctgtgcccgcgtggagtgagtctctggccgagaggggagacacatcccacttgatttatgtggcccgctctgtccaggtgtcctggctccccacagaagccatagacaaacccaacactgttattcaggagacagcgaaagtgacacagggagaaaagcaggcactgcagcaaccaggcaagctcatgcatgagctaaggtaggaaaattgaactataagtactgccttggtggttgggcatctttggaggtcttgggggtggaagaaacctccggtaagcggggctgagtacacagaggtgtgcaagaaacctccattgagggaggctgagtacacagggaaaagctcaaacacagaaaccagctgaaaatgagaaactgaaattctaggcctagggaacaagggaaagagggaacttaaaaaccccttctaacattctcccagatagtccgctggggagaatgttgcaggtttaaagggataatcctcaaaccagggaaaaggaaaagcaaaaaataataaagtattgctgttttgtctggcctaaagagcctatttgtcagccttcagtcttttggtctaagtttggctcagataaggattgagtgtgcgaagctttaattttctatgtgaataataaaatcccatccccacaagaggagatgggttatgctctttgttggattagtgaactaacccacatgtttccccttaaagagaaaaaaaaaaaagcatagtaaacagcccttgcccagtgaaaagccctgggattccccaacacgcttgcccccctcaccatacatgtcacaaagtagaggacagggagactgggggcaacaggaaagtcggaggaagaggaatctgggggtcaagaagaagctaaacccaatgctcccttaaatccttacctaaacttgagggaagaattagaacaacgtgagaaggacattaagaatttccctcttccttgtaaacagcaggcatctaatgtgcgccctcctagagaagcctctatgggacagggaagagttaaatttgtgagtgtacctctaacaagtactagagttaggaattcttttttttttttaaaaaaaaggccactcttggaaaatcccctcagtttaacaaagcagctaaatcaatttttaaaacccaatttttgtacctgggctaaggtaatgtcaatcgtgaatattttgtttactggggaagagaggggaataatgaaaagggcagccataaccatttgggaaaaacggcatcctcccaggcaaggactcctgccagctgagcagaaattcccaaatgcaaatcccagatgggataacaataaccccagaaatcgggcccaaatgcaagaccctagaaagctaataataattaaagggattcaagagtccactcctaaaacacagaatgtctcaaaagcattcaaaatccaacaagaaaaagaggagactccctctgtgtttctgcaaaggctcttggggaccaaataagaaaatactcagggttaaatccagaaacccagtagggcaaggccttttaaaggttaattttgtgactaaaagctgggctgatattactaagaaactgcaaaaaattaacaaataaagttttaaaaaattaaaaattactaaaggaagctcaaaaggcttttgtaagaagagaaaaaaagtttagctgctgaccctgaaggcaggggagagccggccacacagctatatgtggaagctggctgctagaaagctgttaatagaagtgactgctaaatctttgtcattttggcagaactgtccgtctttgcagacggacagaggggagccagggcccagcacggctcagctcgtggccagagagagaaagaagaaaaaactaagtgtaagggaaaaaggaaacagggaatgacagagagagagagagaaaaagaaaataagcgagatagagactggaaataacagagaccaaagggagacactgaagatgagactggggagaaaaataatggaaaaggaagaaagagtacaagaggaagtgagaggatgcggagaggttggcagggctgggggaaggttctagaggctcaagcaacaaagaggtgccgggaaaggatgcagtgtggccactgaggcgggacagggcccaggaactgggggatgcaagtgagaaagggatgtggaggagagtttaggatcaggctgtttgaggaacagtgggttgcctatggcaaagggtagatggctgtttgtgaggtgggggtagaaagcattgaggatgtggaagggtaaatggatgagatgactattaaggttttgttgttttactgagaagctgtgagtccaccaggggcagctgtcagtaaggctgcagaaaggctggggggctacataaggaagatccaaattagggttgtaaactccaaggactacagggccagcaaatggtgagaaaaagggctgcagggttggatggggactgtgactaactcaagagggcacaccctgttaaaggggccatggttgctcggctgctcttacagtgccagccctgtgttgccaaattgtcaacaaaatttgggaaacatctaattttttaatgtaaaatataagttttaaatgctggtgatcagttcaaaaatcttaaaaacccaatacaggcgaaagaggatgccactttgccatctctgaaatagagagatctcatgctggggaaaagtctgccgagacgctttgaggtgggttgtatgaaagtttcccagagccaggctgggccaggggaggatccttgcagctgaggaggaggaaaagccactgagtcccctcccagagtggggacaaaccggagaccctttgcagttgctgggtcaccagaaggggcgatgtaaaatacaaacagtgcatctctcggcctgtcgggaaaaccaacggtgccttcaaagcaaagaaaaggaaaggagagtgaagccagggatgcctttgctcatgagagtgcccatcagggaaggagccacaggctgacagctcttcaaaccagcggctcttggcccaaagccagacctagcaggacccagccaaaggcaccctgggagcccagctgttcagtcccttgcctccccacgtttcccagtgcaccctggaaaggtgcctaacctaactccagccagtttcttataaaaaggagaggagaataaaaaggcatcaaactgtaactgtttaaatatcataaaatatcaaactaaagttaaaccaaaccttaaaaaactccactacataatggaataaggctgtttgtaagtgggtcatcccaagtaatagatggtaaaaaaacacaataactatgctgtcatcaatgaaaacaaacaatccttatgtaaaaaaggtaaattactcaataattgttcagcccaaatctgtaaattatatgctcttagccaggccctgaagctcctataaggccacaatgacactatatatattaattccaaatatgcctatggagtaatacacacctttggaaaaatctggacaaagcaaggcctaataaatagcaggtggaaagatttggtatgtggggaactggtcaaacaagttgtaaaaagccacctgctcccagcaaagatagccatagttcatgtaaactgccatcagaaaggaaacactatagaagctttagggaacaggcttgtggataaagctgctaagcaagtctccctggaggaagaagttaaactccggcctaatcccagatatcccaaggtggtattaaaaccccaattttctaaagagaaaaaggaaaagctgggcaaaatcagggccactcaaactgaggatgggacatgggtgctccctgatgggagagaactaataagcaaacccataataagagaactaacaaacatccactctgcataagggaagtcactggggtcgcccaggccatgtgtgatccaatactcaagaattatgggtgggccaggcatggtggctcatgcttgtaatcccagcactttgggaggccgaggcaggcggatcacttgaggtcaggagtacgagaccagcctggccaacatgacgaaaccccgtctctactaaaaatacaaaaattagctgggcatggtggcaggcacctgtaatcccagctactcaggaggctgaggcaggagaatcacttgaacccggaaggtagaggttgcagtcagctgagatctcaccattgcactccagcctgggcagcaagagcgaaactccgtctcaaaaaaaacaaaaacaagaattacgggtgtacgggaattgatacccttgctaaacaagcgtgtgaaaattgtgtaacctgacaaaaagtaaacgaaaaaatggtcagaaaacaaactactggagaaagacctcctgagttaaggccatttcaaatcattcaagtaaattttacaaaaatgctcaaaatagggagactaaagtatctgctggtaatggtaggccacctcttcagctggatggaggccttctccctcccaactgccactgccctgaatgcggtcaaaataatcttaaaacaaattatacctaaatttggcctggtagaaggtattaattcaaacaatgggagcgactttaacctcaagagcactaaggggaattacggaaagtttacacattaaatgggattaccacaccccttggcatccctcttcctttgaaaaagtaaaaagaataaatcaaagtctcagaaagtatattactaaactaatcttagaaactaaaatgcctttgaccaaatgtctcccaatagcactccttaggattaagacagcccccacaaaaaactggaaattgtccccttacaagttgttatatggactcccgtatttaggtaggaccactaactttcctactataaaactcaaaaaccaatttaaaaaaaaattgtatactggccatatcctccaccctgtcattccttaggttaaaaggacttctaactcaaaccctgtctctgaagttcacagttcaccacttccagcctggcagctcagtgctaattaccacttaaagaaaaacaagctcaggccgggcgcggtggctcacacctgtaatcccagctctttgggaggccgaggtgggaggatcacaaggtcaggagttcgagaccagcctggccaagatggtgaaaacacatctctactaaaaatacaaaaattagctgggcgtggtggtgggtgcctgtaatcccagttacttgagaggctgaggcagagaattgcttgaacccaggaggcggagcttgcagtgagcagagattgcaccactgcactccagcctgagactccattaaaaaaaaaaaaaaaaaaaacaagctccacccaaactgggaaggtccccatcaggtgctcctaaccaccaaaccaccgtgcaaatagctaaacaagggtaaatacattacactagggtcaaaaaactggaaaacaaacaaacaaaaaacaaacaaacaaaaaaaaacagaaaaaaatgaaacaaagggaaaagggtaaatgggaagtgtataaatcacctaagaaacccttaaagctaactctaaggaaaacctaaaaggaagctataagcaggctccgtcattgggggtggatgcggttagaattaattctactaccaggggtaagggggttcacaattattaaatggagcctgatagaaaaaaaaaatcccatcaaactaatagtcagcagaattaaaacctccaccccccaaaccataaagttcaatgcctgccaagtcttacagtgtgaaaatttaggaaaccaaaggcagctgtcacaagcgaacaaatatctatgtcctaaaacaggttgctattgggaaaagccctgtgctagctgaaatggggtctggtaaaccacccaatttcaaggctgggtgagtcactcttccaaaaacaaacccttaaaaaagaaaatacatttgtataagggccctacgccacctaactgtaaaaatttagaatgcaatcctatattaattaccataaacaacccagctactctaaaccaggaagcttggaggtatggattaggaataaatatctcaggaagggatcctgtaggacggttagcttttaggcaagtcaccatctccaccccaagcccacccaggattactgtcactccccatcccactacttcctttaacccaccagacaaccctaagagagtaaaaataattaaaataactaacttaaggcaaatttaaaaagttaagactgaatatgggggtgtaaatgcctgggttaaatgggtcaaattttcaatactagctcttaataagagcgactgttacgcatggtctgctgggcggcctcaggcacagggtagttctgtttcccctgaaatggaataccaatcccaaaggcaggcattgcatgttggctctgtactaaaacagaaatgcatggggaaataagacttacaaaagcctatcattgctctttcctgccttacgaaggtcaagttctagagcaatccccttgttctccatagggaatataaaccactccttctgcctctctatgcaggggcaaagttcaataagcctatgggaaaactcccaacttgtacacacatcctaaacgttactgatgagtcaaacaaaggcgactactcggctcttcatatgccctgggctaatgtctggtggtactgtgggaagagaaacctcagtaacctgttagtatccaattgcaccggaacttgtgccttacttagttcaactggccattccattcaccttgacattccataaaaatccccaagaatccacatggccaccaaaggtggaaaaatttaataagttcttttaattccaacatttatggtaactcaataggagttcctaatggagtatctaataaatttaaaaacgaaagaatacaaaaataaatgtggaaatgggaacaataagagtaaaaagaaaaagaagaaggaattaaaggaaacaacgcatacagtggtccatttccaagacaaagtgccttaaattggcttaggtcagcaaactacagaagaaacaggaaatactaggcccctgcttcgatagctgatgcctgcttgtcagcctccccaccttccccctcttccccgccccttagttgccctcacccgaaccaaagaagtttagtctaagatgagtttactagcctacagaatagcttgttttgtgggttcttatcagcctgcccagctacttaggtcataaatcaaatacttgaagagcccctgagctaactagaattgcaatgcattgtgggctgcaacaaaatgcagcaagacaatctaaaaaaaaaaaaaaaaaaaagcacctgaagcccctacccaacaatcaataggcgacatttgggaaaattgtgaccccatgtgtccagtctataaggaaacgggagagggacctgcccactaggggataaattgcttgttaaaactgtgctggatgtgcttgcctatcaaacacccaatcttgcaaaaccatcattgaaagtctcgctttcactgttctccaagtctctgagtccattgtttgggtttaaatgggtaagtttgtttctcagaaggtgaaagagtgaactattcaaatatggccaggtgcagtgcctcatgcctgtaatcccagcactttgggagaccgaggcgggtggatcacctgaggtaggagttcgacaccagcctggccaaaatggagaaaccccatcactactaaaaatacaaaaattagctgggtgtggtggtgcatgcctgtaatcccagccacttaggggactgaggcatgagaatggcttgaacctgggaggcagagattgcagtgagccaagaccatgccctcgcactccggcctgggtggcagagtgagactctgtctcaaaaaaaaagagaactattcaaatataagggaaacagctggtgcatagtctctaggtggaaacccttagtttgtgggtgtcagatagcagaataaagatcagggtgacagaggctgaagagcaggagggggctgggaaagttgcagggccttgtgggtatgcagaggatacaggagtttgaggatcaaagtttagaactctggagcactgaggggatggccattgcattctgaatcttcctacttctccatttagcatatggccttcctttgcttctagagattgccttttctaggcttcaggacccacagatattccttgggaaaatggtcttttagacttgttcttctctctttcccatcattattggaatatgctttccccctccttttaggagtgaagaaacctcatgagtgagttcacacttagatgtttatatgacaagtaaatgcttaaaagtctttgatttgagagtttgggaagtgatagaaatgatagaaagggaaaggctgtgtctagatttcacaggccttaagtctaaggattgctgatttcggtggtttaaaaccaccaaaataaatacatttgtctatttctccttgtgattctatcagatttttttctccaattgttttattttgataaaatacacataacataaaatttaccatcttaaccatttttaaatacactgttcagtggtgataagtacattcacattgcagtgcaaccatcaccaccacccatctccagaactcttttcgtcttgcaaaactgaaattctacccatcaaacaccaccaacccccattccctcttccagcccctggcaactactgttctgctttctgtctgtataattctgacgatgctaccttttataggtatagtcttaccgtttttgtcttttcgtgtctggcttatttcacttagcatatgtcctcaaggctcattcatttgtagcatatgtcagatttttcttcctttttaaggaagaataatattaaagtgtgtgtgtataccatattttatctattcacctatcaatggacacttggtttgctttcccattttagctattgtgagaaatgctatgtgaacgtgggtgtacaaatatctctttaagcatgtgctttcaattattttgagtatatatctagaaatggaattatgggatcacatggtaatactatacttaattttttgaggaacggtcatactgttttccacagcagctgtgccattttacactctcaccaatggtgcacaagagttccaattttccactctcttacaaacacttgtcattgtctttcttttaaaaaatatatattagccaacttctgggtgtgaagtggtatctcattgaagtttggatttgcatttccctaattattggttctatcagtttttgtttcatatattttgtggctctttcattagatgaataagcataattccaaacataacaattggaattgttatgtcctcttgattgactcctttatcattatgaaatgatctttttctcagtgatagtatttgttctgaaatatacattgtttgatattaatatagctattctaggtttcctttcatcagaattaacatggtatatatcttttgtcatctttttacttttaagcttttattatgttaaagtaagttttaaatagaatggcatatggctgtttgtaaaatctaaagtgataacctctaacctctgccttttaattgaagtgtatagaccatttacatttaatgtaattattggtgcagttgggttcaaacctaccatcttgctatttgtttctctattacttatctgttctttgttatgcttatcttctttttctgcattttgggggcaatctataactttttgtacttttacaaagtggccacattagggtttatggtatatgtattgaacttatcatcatctaccttcaagtaatattatagcaccttatatatagtaatccctcttagctgcaggagatataatccaagacctctagtggatccctgaaatcaaagatagcactgaaccatatatgtactattttttttaatctgataaccaagacagttaagctactaagtgactaatgggcgggcagcatatacagcatgaatatgctggacaaagggatgattcatttcctcggtaggtggaaagtgagatgatgcaagatttcatcttactactcagaatactgtgtaatttaaaacttatgaattgcctacttccggaattttccatttaatattttcagacaatggttgatatctggtaactgaaaccatgaagagcaaagccatagataaagggagactactgtatagaaaccttcaacgatatatcaccattcctccccttttggcctttgtgctattgctgtcattgattttattcctatgtatttataattcttacaagatttttaaaaaatttaaatagttaatgatcttctaaagggatttaaataataagaaaaaaagccttttatatttacacatagagttaccatttccagagcacttcattcttggtgcatacccagatttccacatggtattgttttccttctgtagtatgcgcctgtgaatgataaaatctttcagtttttgtatgtctctaaaagactttactttaccgtcatttctgaaagatattttcactgggtatagaattctaagttgacagttttttcttttatctttttggtcctctgaagatgttgctaccttatcttctagcttgtgttgtttcttatgggaagctggctgtcattcttatcttagttcctttgtaatatatctccccatccccctctacccctgccacttttaagattttccatttatcagtggtgtagagcaatttgattatgtaccttggtatagtttttttactccctcacgattcttgtgttcagggtttgttggggttttcagatctgtgggtttatgattttcatcaatttggaagatgaaactctaaagccgtatttctttaaatatttttgtgtctcctcttccttcaggtgctacaattacgttcatattaggctatgtgaagttgtcccacagctcaatgatattctgtttaacttttgttcagtatttttttctctgtgggttttttggatgatctttattgccttgtgtcaagttcactaatattttcttctgtaatgtctaatctgctattaacctcaatcagtgtatttcctttttatttcacatagtttttatctctagaagttcaatttcggtcgtttaaatatcttccatatctctacttaacatgctcaatctttcctccagcttcctggaggaaatagaatacagtttaataagtactttaatgtcttatatactaatttcatcatttgtatcatttctcggttcagttttgtatgattgattttttttcttctttataggtagtattttcttgcttctttgcaagcctagtaatttttgactagatgccagacattgtaaattttacctcattgggtgatggatatttttagatattttatgcttctaagctttgttttgagatgcagttaatttagtttaatccttttagatcttgcttttaagctttggtgggatttgaactatctttggagctaattttccactattcaggggaacaacaacaaaacacctcttctgagtattcatgaattatgaagtttttactctggctggggagagcaagaactatttctggctctgtgagccccacagagaagtccctgtgtcttttcagtagttcttttccgaggctgtggtagttttttcacatccatggtttgatcagtctcagctgaaggcttgcagggaactctttacagatctctgaaggctcttctctgtatagtattttaatctacaagactctgcattgcaaactttatctgtcttgctgtccccagattcccaccttcaactgagagagattactgggtctgcctgggttcctgttctctgtatggtaggctggataatccttctaggcagtaagctggggtaatcttagggtttacctcatttatttgtcatctctcagggatcatggttttctattgcctaatgttcaatatctcaaaacctattatttcttatcttttatctgtttttttaactcattgttgggttgcttgggagtgctttaaaaaatccagtttcttggaatctgtattggctaatatgaggccacctttggagcagacccgcatattacccagtggctgacgttattccctctctagccagaatgccagtattttcagtgagtgtgtacattggaatttctggttaaagaagtcagtcacttcttctaaaaatatgagtggaaatataatcatttggagtagatgggtttgctagaattaggtggaagatgtctagaaagagtctatggaaaccaggtgagaatctagattaagttggtatggctatgattttggccagcaacttgtgattttctttctctcttataacatgattttgtagttcatttttctccaccttcagctcaatggccagatgatggagcctgagaatctatgaggagtcagctcctggatcctcaccagttatgctctatgggctgaatcagtcagtcagcgtctctgaaccatggcatcattacctgcagagagggcttgtactacacgggtgcaaagagatggttggaaaatgtctaacaaatacacttagatctgtatttgaagccacttgtagtgtgtggaattatggatgcttaataaatgcattctatgtttgcaagatatgttcttctcctagaaatctccttatctcccaggagataagacacttcttggtaaagacattttgagtaccactgaaccctccaaagagtattgagtattattgagattctgatgattattattcccaattttgcttttcttctgccacctctctgccctctcaagggaagtgaatgctctctgatcacatggtgggaaagggcctccttcactcgactataataataaatttatgaagggcaacattcacccagttgaagtgtaagtgtaccattatcacatctttcttatctagctttatactaagtattaagagggaaacacagacatataaaatctggttactagtctgaaagaatttacttcttgttgtagaagtaacacctacaattgtgagataatcttcaggagacaatttgccagcaaaataaataggaacatagcccatagtttcagataagcagatgccataggaggtcaaaataggagcaggagagacccaagcatcagcggctggagaaaatgactgattttcaatgatggctaccttcctaaagatatcaatcccataatgcccagaaagctcagaggacgaagggcagaaccaaaggcttgagagtgcacaatgtgtaagggaggggccagggccaagcagccagcagaacagggctctacgggcagccaaagccactgtgtcctgtgccacgaaaggcccagagagcatctaaagatagcaccctggcacagagtcatacggcgagagcgggaagcctggtactcctgtaccacacgctcgaatttcctctgaatatttacacgctcagcgtcttccagtcatcaccatagccccacaaaagaggcgggacagaaaatcattgccatttggagaagaggaaaccgaggatagggaaggctcaatggcctttgcacagtgacatgaacagggaaggagagaagcaagtccagaacccaccggtgctgtttctggctgtgtgcctacgaagcgggtacagggaaaactcctctgaggactccagcctggggtaaagagagtcatgaacatagcataggtcccacagggatgatttgacccaaatctggaactaaaagtgtagtctaactccaggcaaggtgagggtaagagaggacactggctgtgtgtttctacacatctgcccataaaagagagtggagagggaagccagggctccgtaacccccttcaagtcaaaggaggggaggaggctcccttgccttggggagggaagagggaggaagaggaggggaatgcatagggaagtctgcttttaagcccattaatgaggaagagccaagcatccaattaacttgacatctcttgcagccaaaatatctgaggatataagaagcgaatttaatatgtggaggcttgggagacaagtgactaatagtggaaaacagccccagtttatttaaaaaataggtcaggcccaacaaatccaatagattccctctcagcacttacggatccaggagacagagggagtgctgtgtgggtgcaatgccattttgatttgaagcagacattgttgttgtaccaccaagagacagccagggctggcaggaggcgcctgtgcacagcatgcagctgctgagggcggccttcgcgtcaagcgtctcagtgaccctggtcaggacagcgagtccctaccagtgaccggcccaaggtcacgaagcctgaaggtggcggcgcccacacccaatcccagcccctctactctcagagctaaagtgctctctgtggccttgggtgcctctcttccagatgtccttggcccggctctgggaatcttggttggctctgagatggcagcaccaggctgccatctgagagctatggcagagctcagggcttcagcgaggaagagagaaggcctgaagctgtcctcggcactgtcaggacagggttcctaggcaccagctggagagcctgttaacatgcccagtgttgggtctcagtcccaccctgatttcattggtctgcggtgggctggagatccaccagcgacggccgacatggattataaaacagaaacactgtttgaagtcggagcccaggttgtttctttcagaacgttaatttctagagatgtttatagatctcaggaaaaagtgtgtcacagccataaatgtgatagtagtagatgccctaattcctcttagaaatttatattatataatatttatataatatatttaatacatatactataataaaatcatttattttagcattttaaaggcttaaaagtattgcaattaagaattctctttatgtaatcccagcgctttgggaggccgaggcaggtggatcacctgaggtcaggagttcgagaccagcctggccaacatggtgaaaccccgtctctactaaaaatacaaaaaaattagcctggcatggtggcgggtgcctgtagtcccagctacttgggaggctaaggcaggagactggcatgaacccgggaggcagagcttgcagtgagctgagatcacgccactgcactccagcctgggcgacagagtaagactccgtctcaaaaaaaaaaaaaaaaaaaaaaaaaaaaaagagctctctctttagcttatctgcccaaacctacttgccatggaacctttttctaggagtaccaattatacagtatacaatgtgggaaaatgttactctagaccagtggttttcaaactttatggtgtatcagaatcacctgctgggacccgtcccaaaatttctgattcattggtttctgtccttcaaggcctgggaatctgcatttcttaccagtccccaggtgatgctggtggtctggagaccacacttcaagaaccactgccgtagacccctctgcaagccctggctcagccgagggtcctgggaggcctcccagagtgggagggtggagactgagagcagtgggcagcaggagctaagagaaggggtttccaggaaacacagccttgagaaggcttgactctaaggtaagaaaaccctatgtagggatgggctctgccaagatcccagagttagagtcagagattctataaaacagggggttccaaatgggggacagccgaccctctgtgacaggcatcagtggcttgcccccaacatccaggcctggaaaaggcagatctggagagcgtctgtgcctacgaagccaagtcttgtgaagggcatgaggcagacgactgaagaataaaccagagcaagctggggagcccgggaggccacatgcagaagacaacaccgtctcgcaggactggcaacacctagatcaagcttgtccaacctgcagcctgcacaccgcccaggatggctttgaatgtggcccaacacaaatccacagactttcttaaaatactatgagattttgtttggatttttattttttagctcatcagcaatcgttagtgtattttatgggtggcccaagaccattcttcttcttctaatgtggcccagggaagcctggacaaccctgaccctcctcccctttgcccccagactctgggcttccagccccgagggtaagaagcagcaagctagagctacctaccctagcacagtacacccctctgagggggctgacttcatctgccagccccgatgataagacaggggtgcaggagagtagagagagggtgcatgtagggctgtcttggccaaaggcaggcaataaagctgtacttttgctttcttaggtgataggagaggtcccaatgcccagcagagcccttgcttgtcttgctgctgcctgacatttcacataagaatgttctttttttctgcaaacctctggtccctatctaaaggcaggcagatggttctggaagagctaaccctttgtgtaattatgcagaacgggagccacagcttagatcacagcctggtgagtaaacacaggttgaagagaggtgtggtgagtgtctaagggcgacactgggcagaggggctggcacgaaggtgggcaaggagggaagaaggtgaaggcggtgggcaaaagagtggggtgaggcccaggctggaagcctcctgccacccctactctgtcccctcccactgcgatcctctttcttccctccgtgggccctccaggccaggcaggcggctgctgaggacagacgactcaggttagaaaaagctctcttgacatttggagaacagagcaggatttggctcctctagtggagcctcttgttctcagggaaatcattttaaagcttgggctggtgccagcaggagccatttatagcccaaagggcttaggttcactttggctgcctggtgcagagagtgctggcttccctctcccctctgcaggctgccttcccccttcagatgtccagcaccttcactctccttccttaaagcttctttttcctctcctctaccacctctttcctattctcttggaggttccagttccagatccacctccggacctagattcccctaggtgagcctaaacaaattcctttccttctgtgggcctcagtctctccatctgcaccctgacacctattgtctgctctctttaaactctgtcaccttggagaggtgcctgcctgtgcctacctccactgaagcgctctcctctgtctagttattgcctgttgactctctttctgccctcaacactgggcttcctgcctgggccagctgtgttacccttttctgagcacagggcctggctcctggcagtagctcagttaagcttggttgggccgaactgagctaaccatggcatcagtttcaagagcacaggttttggcataaaacagatactggttgacatcttggctgtgctgcttgctatctctgggccctggcaaatgactggactttgtgagctttagtttcctcatctgtaaatgtcagttactatgaggatttcacgagatggtgtctatctataaagtgcttggcgcagcgcctggggcgcagtgggcccttagtcaatgttaggtctcatcaccatcatcatcctctgccatctacctgcattttcaagggatgtgggttaggtcaaacatgctcccccaaatccccacccctgcttgtggaaatccgacccacccttcaaggacgagctcacaagctcacatgccccttcttcaggaagccagcttcctcctgtctccagctctgctgcgtccataacctttcatctctgcatttagtgggcccgaggcctgttcaccccagtagagtgggtagactaagacaatcgcactttatttattagggagaaaaactgtgctgaagctgccctgggtaaggccagtctgggggcggaacactgtgttgggggagtcctgatcagccgctggcgtggtgagtcgaaggcaaatcacaagtattgacagtggagggtgattctcaccatatcagggaggcagacaacatcgggagacctccagcaagtaacagggccctgggcctgggcctttggacggaggtggggaaagagcaaggcagggtgctttctctgccctggggcccaagaacccaacaggacaaggctggaggcgatggtgcagaaacaggtaccagaaccgactccagggcagagcaggcagggccagacctccagggtgatgtgggcacaggaaccctggaagggactgggggcactggaatgtccagtggggagggacttgggcacagggagcaaattggaggtgagaaagctgcagccatgagcagaccaagacgctgatgttgagagtccagctgcccatccgagtgtgattccaaatccttttgctgacttctcagactatgtatacaagattggagtttgaaagtcaccttcactcagagactctgcttgcctggtgtggcttagggaggagttgagccttctgactttacagaggagaccactgtcatcccccaagacctatcccctgtgctcctcaagtctcaagagccttcagttgtggctgaacaatcatgtatatctcttggagatgcatctggattcctataagtgttccaatttgcctgcataggatccatagaatacccatatgtctcttgtttctttcacagggctggcacagtgccttgctgttgtagaagttcagcaggtagttgtagaatttaaaagcatcaccccatgtagctgaatgttcagggatcacaggccacggctgcttcccacccactcccagccttcagggagagggtatgcctgtcagccaatgggcagagtgccaggctgcagaccagggtctgggccagtcatttatttgtccccatgacctgtggctattgaaatgaatgcccccaaatccatgcatccttttgcctcctgcatggcacacggcagacacttcataagctggctgttggggagagtctcagggagccccatggaaaagagaaccttggaatcagagttgaatgacagcttatgggtgctggaggcccctgtgaccttgaccgtgcacaatgcccaggccagctaggactttttcctctccttaatatatttaaatggagtcaatactggggtcagcttcatgcacacagccttcttcagccctagaggtgaggtgatctgcacagcttcctgagcagggtcctccctggtggctgaggtgtggagggccccagccaggctggatggaggttgactttgtttcggagcccttgcttggacaccggagtgcaatgctcgggccacacatccttggaggaagggcagcctggaagtggtggaacaatctgtcatgatcatatttttgtgtaatcaaacactcttcccataatacctttaatggccgcatagtgttctattgtgtggctacaccacagtttaatgtctcactttgtggaacatttcagttgactcctaccttttgtcactaaggacagcattgtcatgaaattctcaacagctacatcattatgatgatccatgattctcttcttatggtaaagtccacagaacttcaattgctgggttaacggatttgtgctctttaacacttcaagtacattttaccaaacggcctttctaaaagtcttgacctattttcattcccactagaaatgtgtgaaaggacctatctctctgcaactcttacatatgcagagctgtggttgttttggtgggagaagagcttatctggtatttaaaagctgtaagttttctatttgaatttgaatttacctgatttctaatgaggttaaacatttttgttgcacatcaacctgccatttgtatttcacatgtacttgcctcatgtggacagattatccaatcctttccccaatattacattgtgggtgttcatctatttttgtattggcttgtaagagctctctacgtattaagggcattaacctttgtctgccacatatgttaaaacgtacttctcggtttatcatttgccttttaattttgtttatgatatttattgtctggaactgcattaatgtcttcttgctagacatcttctcttatatgactcaatgacatttcaaactctgcatatccaaattgaaattcattatttccccccaccccaacctgctctgcctgctgactggcttatttttgttaatgtcaccaccatttccctagtcacccaggcttgaaatgttgaagtcatctttgattccagctcctctctcttcccctacattttgtcagttgccaaagcctgtagagtctatttctgcactttctctggcaggcagcccctcggacaccccagtagttcaggctctcattatttcttgactggactttgaacatagcctccaaagttcatactttgcctctcttccattcccttcttttccttggcccctcctgtgtgctgctaccacatctatcttcctaaagaggagcccaaacacagaagtcactgcttccctggttacaaaccggcaatagctccccgttgtcttttgtatttaattacgacctcttagcctggccataatttcctttcaactgaatctctcactgtctcagccaagctgctcccaaacaaactcactgctctcccgccttttggttgctcaagccgtctcttcctccacctgccaaaatccgttcaaaaagctcccacctcaccccacctcctgctatcccagggcttcctgactctctgcattaaagtgaattctctttcctgtgaacctccagaacaatttgcttgaacttctcttgtagaacaaaccttattccagcatctatcagagacaataagggtcttagaatctagaaaacagggtcctgggagggcacagttcccacacgtctatttcttccacaggacctgcacgctgccttgctgttggagatctgtgcagtaggcagttgtggaattaaaagcaacaccccatgtcgctgaatgttcagggatcacaggccactgccgtttcccacccactcccagcctccggggagtcttagcctgtggagtcccaggaagcacatggaaaagagagccttggaaccagagtggagtgacagctaaggggtgctggaggcccctgtgaccttgaccatgcacaatgcccagaccagctccgactttttcctctccttcacatatttaaatggagtcgatattggggtcagcttcatgcacggagccttcttcagctttagaggtgattctgcagcctgcacaggagtgtgcacttgacacagtctatttttagcctcccagagaccgtgaccaacatcccaagctgagagtgggcacacctgctgcattctaatgaggcagccccactcgcctttgccagcccgcccgggatctcaccgacgtgaaatctgatgttgctaaactgggaagtctgcttatttcccaagggcggtagcctaggtacactgggaagatgggaccatcccactgcccccagctcactcccctgcagccctggacacagaacagtcttgggactgcgcggagtgattccacggaggggttgaaataacttggctttcttgatcttgctgtgtcctaggattcccctgtttctcttgctagaaaggagacagtaagtctgagctgacccagctcacagacaagaaaatcgagacatagaacaaggacatgatgtatgtaataatcataagcacttactatgtgccagcctgttctaaagtctttccatatatcaactcctccaaacttttggacaaatttttcaggtaggttttattatgatttgtgttctatagaggaggaaaagctgaggcacagtgatgacaaattatttcccaaggtcacacagccaacaagcgctgggtttcagagtcaggcactgtggctccagggtttgtactttcagccagttcgctatctgcctcctagtatctatttttaattttactagagccaggataggacccaggagcctggattcccagccctagaggactgactactagataatactcctttttttatttttctagttcagccctgctttgaggcctttactgtgccttgtacatctgggtctcctgcactccaggcagaggaggtctcctggcataactgcttctgttgcagtgtttgagcttctgggctccaattgctgtctctgggctccagaagctctgtggacccccatctccttctccctgctccgcctagcctgtggaggaccagggagcagacagtgatgggcagcagcagtgggtgtagagctgggctgggcctcaggattggggcacccagaaatagcaataattggttgtgtggaggccatcagtgtgggtatccacagtgctgaattcagggtagaactgtgaatcagaaactagggggcaagacaacaggtaggagacaccagaacctaagacatctgcattttgggggccgtatcctcttctagcttgatgctgcctgttgagtggagagaagcccatgggttcacgttcctgaggatgcaggtgggacttcgtttcctctaacaaactcttactatatgcctggcccttttctaagcactttgaaatacaaacttgtctaatcctcaggacaactctaggaggcagggaccattttattcccattttagagaaaaggaaactgaggcactgagaagttcataagtttgcccaaagttgtatagctgggaaatggcagagctgggattcagctccggaatctacactctcaggcaccatgctgtgctatgcatctttccctttattgaatgtttcctatttgccttcaaaggaagatactattttccccatttcacagatacagaaactgaggcctgcattgctcaggtcacctagctaataagagctgaaggtgggtgaaatctaggtgtgtgtggctcctcggtggactgccatctctggacagatcacagccatgagcccaactgctgggagctggaagggctcacctacctccctttcaggaagggctgctgtggctgcttgaggccgggctcagggagggggaaggaaagaggaccgcaagcctccgagggcgggaccccgttgtctctcctaacacccgacccccttctcttcccctcaggtgaacagccccccctcccagcccccccagcccgtcgtccctgctaagcccgtgcaatgcgtccatcatgtgtccactcaacccagctgcccaggacggggcaagatgtccaagctgctgaacccagaggagatgacctcgagagattattacttcgactcctatgcccactttgggatccacgaggtaaagtgtcccgagtgggtggctaatggggcgaggctgactctgctgttctgttgttttcagaggcagcatagtgtgttcaactccttaccatggtaaagggagtgctcccagtgttcctgagtcctctgaccctttctccaatccggggggcccctctgggagggggccaggccaggcctggagcaggggagcaggtgaaagtgtgtgtctgtatactccacagccagagagagcacacaaggtgcttacggtccatttgttttacattccagctcccgtgtctctccccagccataaacccagctcatccattgtgggctggatagcgctggtctttggaccaggagctcaaatgctgcagtcagagtcctgaggcagcaaggacctttcagaggtcatgatgtgcattcttttgaccaatgagcacctccgggggaagagctgcaggaagctttcttgggagcttggcccaggtctgacaccctgattgattgtctggaaattcttatgtctaaatgccagtttaccccatagcagggaagactaatgttgactatggaacagaacagaacctcctaacaagaggcatcctggccatagtgggggcctaatggtgcccctactgtatatctttcattataatctccagcactctctccagccaccccaaataaacaagtaggatttactgagtgcttgctaagtgacaggcacagttctaagcacattatacgtatcatttcatttaaactctatgaagaaaatatgtccgtgatcctcttacagcataagaaaaaattgaaaaaggaacaaaagtttgcttgctgtgcaaatcggttttcaaaacaagtcttgaagatcttccttccacgtactcactgctgtaaactcttcctatgtggaaatgatgaccctgccattgccggaagggtgtttagtaataatagccagctcttttgtttgtttgtttcgttttagtgcttactacgtgctggtgttgttccaagcattttatattattggttcatttattcttcaggtcaatcctgcaaggttggtgttattgcttgtccccattctccagatgatttaggcccttaagaatcaaatcaaccctcattcatccttgacggtttttttgtgtgcgtgtgtgcgtgtgtgaaaggccacaagctagtagatggcacagctagcaatcaaaccttcaccttttgttcctaaccatcatgccatacagcccttaaaacaagtttcctttctttccatctggaaactgtaaaaattaaattgccatatttgttcctgctggttcttctgcagccctacatggaggtagagggtggaaggaggccccccagttacttctagactcaggggctcagcctcatttaatccagggaggctcaaggtttgggtccctgagaactgttcaccatgtaaaaccattaagcctggacctgcaggggaggaggactggggcctgtgttcggtccagaaggtcctggcccaggagggcctggacagctgagcctgcagcttctgggagataaaatgccatctcagggcagatggatgaactcttaccccttccttgaccctgctctccactgggctagggattcctggagccccatccttggcctgtgagaggctcttgggggcaaaagagactctgcgaaggccccttcctcaagaccttgtccctaattaaaagtcatgttctccatgtgacaagttctaacaggcctgtggctctgggtacccatttcaggacagattcttgggaaaagagagcagttccagggaccccaaaatgtctcctcttgggcctgcccagaactcccccattagaaaccaaacaaccatgaggtgcacctcaagctgggtctgcagtctcccctccccactcggagcctccgtgatcggcttcttggacacctccctctgagttgctaggttcctgctgagccacacctttggcgtttagagtgtgctccactaggctattaccgatctctataattcctttgggacttggtgtccccagcctgttacctacagcttggcacattgtctggagagcaaaggcttgttgacatggctgctaatccagtcattcaggcgatgcctggtcagcaccatgacccagcacccaggggagaggacatcaagtttcaccaaataaatactagaccagtttccctcaattgtgtgtacttatggaaaagtcaagcttgtgcatacgtatatataaacatagtgcgggctgagcaggggacttagagtataagacctgtgagtcatagatcacattcctgtcctgggagagtgcttagcagccttcccattgggaaatacttctggacatctagcttaaatccctcctgctgctgctatagaccatctcataggtcctttaatgcaggaacagctaggtaaccttccttccccccgaggtctccttttaccctgttttcagtttcccagatcatctgcatgaaaggaggtggggggcacgtggaagaacttttaacaccattcttcgcagagagaaggcctacccagttcttgttatcaagcaccagggatctctgttccatgccagatggatcgtggtgatgcccttgcctccttggtctgggcaagacccatatttctgcatccatctggagccacgctggccatttggcagtcttctccccatcattaacaagaccctcacacggtggggagcagccccaccggcctgctgattaatagccatcagtgagtgttgaggaaacgtggtgcggatagactgggtttgattgatctgtaaatacaaacaagaaatgctgagtacaggggactattggggctggagagcacagcagggggtgactctggacacttctgttctcatcccatgctccattcagagacaactctatccccagcctccagagggcaggggctagcgagaggaagaccctagccttccaatttaggcctctctgggaaacatggaatcttgaacaggagctgaagtggaagatgtgtgcttcctgaggccgccacctagagaggaggtggtaggctccatgacctcccagaccccagctctgaaatctcagcgtctctaacagtcggcactgggcttggtgcctcagccacgagaagaatctttgccaatgcggctgtccctccagcaccctgagctctgggtgccaatcccactcccggccagctcccttcctttgacactctcgctgcaggttctgttgaaacagactctttggggccttatagtccaacaatttgtcaatgggcagtcatatatttaataggcaggaaagccaggacacaagtgaatccacagctagaggctgggaactgttttccacagggtggcatgttccttcctgaaatgtcttgggagttctttgggctcttctcccaggaaggggatagaggacctcttcttttggcaagtcaggtaggggaagccttgctaagtcacaacttctgttctcccagaacttgtaccttccaacctaactcctggggcctgggacctccaggaaaggagacttggccaaaaaagcgacaaaggcaatgaactaaagggtgaccactggggggtctccccattagcaaacatactctctgttaggttttgaagggaaggcaagggttaaagaaagacacgcccacagaaagagtgcagctcgacagcaaatacaggcttcatgtccagcataaaacctacagaagtgggggaccgcctaatgccagagccccctgctacttacaggctgggggtacttataggtatgggcgggaggggtctgggcagtgtggctcgctgcctggcaggatattaagatgttcccgtgatgaggcggttctggcccttgttccggcaggatgtcgtcatggtgttccttggacttttgtccccagcaagataccatacggatgtttctttagttgggcctttgtttgccttgcggtcaagtggttaggcaggatgtctctcatggcctgaacccccgtgaaatgcttcactttgaccaaggtctgcacaatagctgggagcttacaaaatggtgcagtttggacgaacaggctctccgggggtactcagccaatccacttccatctactaaaggcacttcagacttttaactgtggttatgattgaaacatttctgcagcctttgtcgttattttgcctccattccctgctcatctcagctatttccttgcatggatgaaggaaagggttgtagttatcactaagagccagaactagcattttcgtgaaacttactacatttgtgtaatcatcataacaaaccctaggaagtaggtgatgttattaccagtttccagatgagggaactgaggcacagacagctgaaagctggtctgggtcagagagctcacaaacagtggaggtatgatctgaatgcgggaatttgggatttgaatgctctagagtctgtgtacttaaccactgtgctgtatggttttccggcttactgagcacctgctatgcgccatgccccatgcctggttctagatataccatctgtcttgttgtctttggtccgagatctcctaaagcgaaaggcttcagctcaccttcaaagtatttaaagccagaattgaactgaatccaaccaaacccccaccttattcaacttctaataagatcaaagatatcagccctggggcagcacaggaagtgatggctgggcttcagaatggttcttgcctccttttcaccttctgtatctcacctgaatctcctctgtgactcaccctaactggaaacataacagaaagagaagttgggaaatgtagcaccacctggctgaggtgacacgttacaaagcctcccaacgtggtacccagaactccagaaaacatggagccaaacctacagaactaaaggaagaaaaagggaaatctccagtcatagttaaatatttttaacacttctgtcttggtaagtgatcacacaaatgcacaaaaaaaatcggtaagaatgtagaaaatttgaataatacaatcaaacaacatgagctaattgacatttttagaacatttcatccccaaactacagaagacatgttattttcaagtgcacgtgggaacattcactaagatagatcctctgctgggtcacaaaacaaagattaaagtcatgcagagtatgttttttgatcacaatgaattgaattagaaactgagaacaataaactatccagaaaatctccaaataattggaaagtaggcagcactctgctaaatagcccatgggtcacagaagaagtcacagaaggaaagagagactatcccaaactaaatgatagtgaaaatacaacatattaaaatttggagacggaaattcaagcaatatttagagggaaatttacagcttcaaatgcttatggggaaaaaaagtcataaaatcaatgaccaaaacttctaccttatgaagctagagaaagaacaaataaaactcaagtaagttgaagaaaggaaataattaagatgaaagcagaagtcaatgaaatagaaaccaagcagtggagaaaaccaacaaagccaaaagttgccttttgaaaaggctaattaaattgataatatctagttagattaatcaagaaaaaaagagaaaacacaaattaaaataacataaatggaggcaaggacctcctgacgatcacacagatactcaacaggcaatgggagaatattatgacaatgtcgtgctgataaatttgacattttacataaaatggatacatgccttgaaaaaataccttgtcaaaactgacataaaatgcattgaaagctaaaataaccctttcctaattagagaaattgaattcatatgaaacttcctataagagaactccaggcatatatggttttactggtgaattataataaacatttaaagaagaactatacctaacacaaacttttgcagaaaatatatgagcagagaacacttcctaacttatgtaatgagcccagtataactttgattaccgaagaaaaggtaagacaaagttacagatcaatgtttctcataattatgaatatgcaacaaaatattagcaaaaaacacccagcaatattttaaaagggtaatacatcatgacaaagtgttcatttaacattaaaaaccaatctgtgaagttcaccccattaacaaaataaaggagaaaagtcatataccatctcaataaatgaaaaagcatgtgacaaaattaaataccaattcatgataaaatctctcaccaagttaaaaatggaagggaacttcttcagcctgataaaagacatttatagaaagcctaaattatacttaatggatatattattggaacaaaggaaggatgtctgtcctctgtaattctattcaacattttactggcagtctttgccagggcaataaagcaagaggaaagaaccaaaaaataaaaggcatacagataggaaaaaagaagtaaaattgtctttattcacaagcgacaggatttttcacacagaaaaataaagaaatctaaaaaaaaaaccctactggaattaatatgtgaagagagaaaggctgcaaaatacaaggtcatgtatacaccaacccattgcaaaatgaaaaattttaaacaccatatacagtatcacaaaataaaatagttgaatggggccaggcatggtggctcacatctgtaaccgcagcaccttgggaggccaaggtgggcagattacttgagccccggcattcaagaccatcctgggcaacatggtagaacaccatctctacccccaaaatacaaaaattagccagtctcataacccagcctcaaaataaataaaaagataaatttttttgaaaaactaaataaaatagttgaatggaaatgtaagacctttatataaaaatctatacaacattccagagataaatgaaagatctacataaatggagagctgcaaagtgttcttggattataaaactcaaaattgctaaaatgtcagttctccccaaattgatctatagatttaatacaagtctgatagatgccaggagcctattctgtatgaattaataagttgattctaaaatttatatagaaatgcaaagggcctagaaaaatcaaaataatcttgttaaagaagtacgttggcagactctcactacgttatttcaaagttaatataaaggtgcagcagtcaagtcagtgttgactttgtttatcagtggaatagatcagagaggccacacatgtagagtcaattgatttttggtaaaggtgacaaggtgattaatggaggaaatgtttcttggaccatttatttgcaagaaaaaatgagctcacacccctaacttacactatacacaaaaattaatttgacatgtaaaagccacagccataaagactctggtaaaaaacaaaggagagtgtctttgtgacttggggcagacaaagatcagacagggcacaaaaagcacctatcataagtgaaaaaaatggaaaaactggtctttatcaaaattaaaaactgctttaaaaaaagaaaaaagaaaatgaaaaggcaaatcacagattgggagaagacattcacaatatatatgcagtatatctgatgaaggactagcttccagaatgtataaactgcaattcagtaagaacaagacaaacagttcaagacaaaaatgaacagaggacttgaataggcacttcacaaaagatgatacatgtgaatagccaataagcacatgaaaaaaaagatctacttcagtaaccatcagggaaatacaattaaaactgcaatgaggcatcaaatcagtttacatccactaggatggctaaattaaaagatcagtaatgctaaggtgtctggctgtgaagcaccttgaactctcacattgctggttggagtgtaaaatggtacaactagtctggaaaactctttggcaatttcttatgaagttgaacatgtacctaccctaagacccaggaaacttacttctaggtatctacccaagggaaatgaaaacatatcctttgctattatgaataaatagcaaaaaactggaaagaatcctaatatcccacaaacaagtgaatggataaatacattgtggtatagtcatagaagggaataccatacaacaacaacaacaaaagaacaaacctcggatctgtgtaataacatacatgaatctcaaaaactttatgttgcacaatttatataaagttctaaaataggcagaaggaagctttggtgatagaaatcagatcatttgtcatcttgggagaggctgaagattgactacaaaagggcatgaaggactttctggggtgatagaaatgttctagattttggttatggtggtgcttacacaggtatacatttgtcaaagcccttttactgaaccagaagcttaaaacctgggctttttgttgcatgcaaattataccttaatagtgttgatttctaaaaaaaaattcaccccaatacttttgatgatgaattaggtaaaagcgtttgctaataccttgaatggccaaagatccctacctcactaccatacacagaattaacatgttctccttgggtcagagtccactgtaacaagtaatcttgtttctctctcactgcaaagccaatatgctggacagagaaacacattttctagtctttttttttttttaaaaaaaaggcaaacaaaacaaaatatacactcacaaaaacctctttgaatgacgtgttcaatgacaattctctcaccatgacagaaagttctgcttcgtgtttaacttaaatctcttatgctatgttgtactgatctttcctttggtcctttagtaaatcagagctttcccaggtctgaacatgagtttctcttctgatggtgaatagctatctttctgagtagagttttaaggcaggggaagtttggaatgatgctgttagcacatggcccagctaccccagttttgtcctctgtggctctgcctgatgatattatcgggtctcctgaagggtcacctggggtggtccaggggctcatagccatggtgtacacccaggtgtcttgaattcactgacatttcctttcttttccctccatcacaggaaatgctgaaggatgaggtgcggactctcacttaccggaactccatgtaccacaacaagcacgtgttcaaggacaaagtggtactggatgtggggagtggtactgggatcctttccatgttcgctgccaaggcaggggccaagaaggtgtttggggtgagcacgccgcttcctcctgcatgctggcttccacagagccagcctcttgccctctgcctccacccgcccttctagaagtacaaaatttggtccatctcttttgctggggtcacaccttcgaggagtagaagaaatcaggtgtgactctcaggaaggggagcaggctgcctgtcccctgtgcatggctcctggatccttacaaccactgacatttgcggaggaactgtggctttcctgagaccattccaatgtcatcatgacctttcagtgcttagccccaaggtcagcttcagaggcagtgcaggtggttactcgggggagctctggtttgaatctctgcatttccattcactaggcatgtgaccttggactattcacttccctgcacctcactttttctccatctataaaatgagcttaatagcagtcccttgcccatagggtgattgtgaggattaaatgagtataatacatatgtaaagtgcttaaaacagtgcccagcatatggcaaatgctcggcgtctattattatagttgagatggggccctagagataatgggaacatctccttcttgttttctttagagggcaagtcggtcaacttaaattctgttgctttggctgtggcagcgtttccaggctagatgtggaggctgaccctctgggaagcctcctacctatcccctggctctcccaaggcagctttgcccagcctgatgacagagggcctgggaaggtccagagctggaaagaaactaaaaagaagagctgcgagatgctggctgatatttgaaaaatgcagtgggcccagggctggagcacaagcattcatcttggtcaaaatgaaaggcaaaccacaatgagattcccagtctgcatgtgagccggcccatttgcagaggcctcagcgacctgagcagcattcagtgggtctttgctcccatgcatttggttgggccatcccatagccagccctggggacccccccccgcccactgactcccaggttgactagatccccctagatcctcctggccacctgctgcctccagaggtctgctcctaagtcacccagcagggcagcattcctcctccaagcctgacttggaaaacccttgggccatggctgccgagggtcttctggaagcttgggctgccctcaagctgcctcaggtgcagctttgaccaggaaaagctgtgacgttctcagccgaggcacttgctgagggcaggggcccatccggaggcccaagggcaggtcatgtcatcatcactggtataactgctggttctccaggatggagacctcaggcaagggtcttagtgaggtcacagggcatcagagctggacttgagtcctctggtgacccccacgtgctttctttcccagcaccgaggccccgtctcagtgccggccttggtgggggacagggctgagcatggtgtccctggcgcctgagtcatccgggggctccagccaaggagctgtcaggaggaggctcccacttggcgccttccagctgcggtgacttggcgcgatctgtctgcctcccgcccttttctctaacagctcttttataaatggctccaccacatttagctgggctcctttccggatggctcatttcacagtttctcctgttccagacccccttccacccactgctgtcctccagtggggagacgagatggcgggagagagagacagagagagagggagggaggaagaccatcgtcccagagtggagacaggcacagagaaagagacagatgtgacaagagcaatggagaggagacagagacagagaaaggtgcagagaaaagctagagaaatgggagaggggcctggaaaagcagaaagaagacaaagtagaaagcacaaaagaaaagaatcggcagaggctggtggatcacctgaggtcaggagttcaagaccagcctggccaacatggcgaaaccctgtctctactaaaaatacaaaaattagccgggcatggtggcgggtgcctgtaattccagctacttggagactgaggctggagaatcgcttgaacccgggaggcggaggttgcagtgagtccagatcgcgccattgcactccagcctgggcgacaaagtgagattttgtctcaaaaaataagaatcagaaaagtgaagacaggtggtaaagagagaagagggaagaaatggaagaggagaagatggaagaaaggaaaatgaggagggaaggacaccgccccgcactctgagtgttgagcaagcttcggctgagtttaccctcacacactcacgtgcattgggggcttcgacttctctcgggaggacactgaggcgcagttaggaagggcagtggccaggcataaatccaggcctggctccgggtcgcatgctcctcatcactcaacatggtcgcctcttgcagatcagatgatgacatggccagagggggagaagaagaggagggaatcacaccccacagacagtgcagcctgaaggccagggacctggcagcccaggaaagggctggttctcctgggacctgcaccctggctggagtcggcctccttggatgcagctctaaccaagtgaccccttctgaccccgtaggtgccctcacccttcctcaaggcgtggccagaggcgtcagaaactccctcagtgcccctttgcgagtacttctcaagggaatggtccctgcccgaggcctgggggtagtctgaggggcccccaagtgtggaggtgagtagagcccagggccttagcacaggccagcctctgtaagagagccggctccggaggtgaggacggctcttggcagctgcccctccatgtccagaacccctggcagtgtgcctgagacgctaaccctgggctggagcttggcttccaaccattcccatgagggcctgctctcagggaaggtccactcatctctcaaataccttggccctttgcttaggaggtctggagagcctggaaagacgtctgaattaaaaggaataatttctttcaaagatgaagcggcgagagctaacgtggggggtgggaggggaagagaaagatcttaaaccagccctgaggtcttgacctggctttttccagatggtcccatcctggcacgcggctcgtttaccctggaagggctgggctgcggtggggaggatcatgtcgagggaggctcgcaactctggcttggatctgccttcccgcgtcccccacggtggggaggacgtactgcctcctgccattctctgctggccaggagcatgaggtctgccagccccttttgagtctccagcacagagatcaatccctccatcacgggtggtgactagacatcagtcttttcgcaaaggcagcccaatttcgtggaaggccgctggccttgaggtgggggggctgggtttcggttttcagtctgccacaaagttgtgatgcagccgtgggcaagtcaccacccctgtctgggcctcagcgtctctatccattgaatcggtgtgggtcttgctgtgattttttttgacgccttgctcctttgtcctatgccctttccagatcgaatgctccagtatttctgactactcagagaagatcattaaggccaaccacttggacaacagtaagacatacctctgagtgttttctcctggatggaggggacgggaagctcacactttcttgttgggatggcatagcgggaggagcgcagagcacttggacttggggaggtggtgcacccagctgaggcccccgccagcaagactgcggccatgggtactgatgttccccccgacaccaggccagctgaggatcacagccaccccctctccgcttttggcaagccctgcttgtagctaaatcccgagttgccagaccctttgcttgtccccagctgtgggcaacctattgccttctgcaaaatggccacattcctcctcctcctcctcttcctcctcttccctccctctccatgagccccgacccaatgtttccccaccacctgcccaggggcatcatggcagaccccaggctgtggtcctccactgcccacgagccctgtcactgctgggctgttttgggaatgaggctgcttttgggagtgggcccttcttcagctggagtctgattatagagaggggcgtcccttcccttcctcccctctcacctttcccatggacagcgacatttcccagtccctcctctctggagcccatcttggaaacagacccgcaagggtccctgatcaggagacgtccttggagcttgcatctgacagcaggattagatgcagtcccgagccctgtgctcagtgctggggagaacatcagaaaggcagacagggcactagccccctgtaggcatcctgtcctactgcgccggggctgcagtgaggccgagagaggaactggtagacaggaagttgcaatacagacagggaggtgagccacagtgagacagaggccgcctgcagcagagggctgcaaagggtcagctccaaaaggcagagctcactgcagagttccaaaaggtgggaaggctggagctgggagggaaggacgttcccttgaggggtctggggcagggggaaaaagaggccaggttgggaaggaatctgatttcagtgtccctcctgagggagcctgggcagggagttctggcaggtgggctttgtcaagtccgaggcaccgaggagtcagctcagcctcccctctctgtgctgtgcgaccctttgctctatggatgcagcccttgccatgctccctgctgacctgccagaattcctctgccctcctagagggtgcctgctgccctgtcacccctctgggtctgacctgagtccccaggcccaggtggtacctgcctgcacacaacactacaaacctgtgtccatgtggcttcagccctgccacctgtcctctctggtgcttgacctacttgctgcagactctttgcaagggcaggagcattactgactcaacaaacttctctgcaaaccaccatgagccaggctctggggacagagcagggaacaagacaggtaaagtccctgacctcatggaatccacattccatttaggggtaggggttacagataataaataaagaagcagacactcaaagaaaaatatcaggtggtgataagtgctttgcagatcacaaagtcagctgacaggacggagagagaccccatggctgcgttaggttagctgctctctgagcaggtcacagtgaagctcaaatttgaatgacagaaaggagccaggctgacaaaggtgaggggaagagcatctcagacagaagttacagccagtacaaaggcctctgggatggactgagcttggcatgcccagaaacacaaagaagatcatgccgtgtggccagggcatggaaagcacagggatcagagagggaggaggggaccagatcacacaggatttgtaaccaggaaaacaaggttagattttattctccaggtgctgcagtctgttggaggatttcaagcaagggaggtggcttctctatggaggatgggttggaataagtcgcaagcaagaagggtgtgagcagacacacgggaagaagctattgcagtgctccagtgagaggggctgcagcaggaactgaggcagcagtggagctggagagaagtaatccctgtgggacatgcttggagatggaggcacaggacctgagggtgcattgagtgtggggatgagaaaaaagagagaagcaaggattctttttgacttgggcaactgggtggatgggacctgaggatgcattgagtgtggggatgagaaaaaagagagaagcaaggattctttttgacttgggaaactgggtggatgggacctgaggatgcattgagtgtggggatgagaaaaaagagagaagcaaggattctttttgacttgggcaactgggtggatggtggttggctggaggtgaagtactcatgggggtggcaggagtgagaaggaaatcaagagctcctttttgcatgtgttaggtttgagatgcccatcagacatccaggtaggtgcgctgagtcagacttggatacgtgcgtccagaatttcaggaagagccagaccaggagacttccacttgggagtcatcaacctataggtggtatttaaagccagaggatgaggtcacttagggatggtgtgtagctagaagaaagaaatgggccaaagatggggctctagggcactacactgcaacattcggaggtcaagcaggggagaagggcagcaaagaggtagagaagatgcagtcggttgaagggcattcaggagagaggaggaccatgaagcccagggaggggggcttgctcaactgtagggaatgtggagggatctggtccggtaagaacagagaagtgaccaccattgactttggccacatggaggttaccagcgctcttaacaagcacaggctcaatgtggggctgggagagaaatccagttagaataggttcaggaaagactgtgaggcaaggaccagaaatgatggaatagaaaaatggaacagtagctgtaaaggaaggtggcattaagggaagaagtttttttaaaaaaaaaataggagatatgaaaacgtgtatgtgattcactggtgtagtagagggacagagaaagattgcaggtgcaggaaaaagtaaattcagcagcaaagaccttgagaaggtaaggtgtgtgtgtcaggggtggcttttgccctgcccagtggaggggtggtctttgccttgcacaggtggaggggtggtctttgccttgcacaggtggtggggtggtctttgccttgcacaggtggagaggcggcctttgccttggggcagggacagttcagccatagaagtgggggaaagtggggagtgtgggtccagatggaggtgccagtggtgggaagcccttgttttgctgctttcatttgcttagtgaagaatgagacagttgcatgccaaaaagagagaaggtgaagggaggtgagtcctggaatgagagggaaggagggagggcagcagataggctgggggagtgaggattgctgcgatgtgtctgatgcctgtagagatgtgtgaccatagaggctcagtgagtcccatccttgctgttgtgtgatctttctcttaccactctcaggagctcgagtgcgattggagtagaaggttgccgggatcagggctttgctgggagcatgcagcagagggagggggagctggaagttgatgacagtgatgggccgtgggatctaagctgggccaggaaggaagcggagaaggatggtggtggttgtgacaaaggctggggcgaggggcgggcagcatgtctagtggccacaagtggagctgcgatcctgaggcccaagtagggggatgctgctcagaccccttggcctctggcttggtgtccagcctttcttggctcacccagcggagctgggtctcttctgtgccctcctcagagaagtgcttgacccgggctccctatctgcttactaaagacagataaagaaaactggtcgattctttctctgggagggtgacacagcctggcctccttctccccaacctgtgaaatagggcagatggttttccccattaacaggtgtggaaactgaggctaggagaggtgggtgactgagccctttgctaaggtgtgtttgtgtggatgcagaagcaccaggagtgctgctgagcctgaaagcctgttgggaggggaggcagtgtgtgggcacagcaggatcagatgtcctctcagtggtcctgagtctcatccctgagccctgagaggcttccaaacagcacctagaccattcccctccctctgcacaggtttcacctgtgccgtaattcctgacctctgacccagcccctgactcttcgtctccctctcagtgccagcccacccccagtaaatgtctggggctctggaaacacagcctccctggtctccctcctccctaggcttgcaggggctactgccctgcagccattcatagcagagtgtggggtgggccggcaggggaggtggctaacttcccctgaggcatctctgtcctgcttgccaggaaaggaaccacacagccccctcatcatcctgctctgtctcacaccatagggctctccccttcctccccttcctccccttccttctcctcccctttcccttctttattttaacctttgaaatactcaatatacagaaaaggtgcgcacacagccgggtttttatggaatcctttgagagtaagtggttgatgcaatgctccgtcatccctgaatacattagtgtgcatttcaaaccaacgaggacattttctacaagccacatgcaaccatcaaagtcaggaaattaaaacgtcatcattacctaatgcccagatccttttcatgttttgtcaattgtctgagtaacatcatttgtagcaaaaggatttcgttcagaatgacacgttgcatttagttgtcatgactggttcccttcaagctggcctgctcagactttccttgactttcatggtcttgacacattggaagagcacaggccagtgttttgtaggatgtcccccagtttgggattgtgcgctggttcctcgtgattggattcaggttctgcatcttgggtagaaatctcacagacaggatgctgtgttctcattgcgtacaatttcggcttgtctcattactgacagcatcacttaggccacttggggaaggcagtgtctgctgccagccttcgccatgggaaagctgctcttttccctttgtaattagtaagattttctgggggaggtactttgagagcatgtaaatatttcattattcaccaaactaacatttatctgtctatctatctacctatctatctatctatctatctatctatctgtctatctatcctgtctatctaatctatctaatctagctgtctatctgtccatccatccagccagccagccagccagacagccagcgttcatccatctactgatctgtccattcatttcactatagattcctattttatgtaataggttacagctgttatcactacttgcttcgatactcaaattgtccctgatttggtcactgatgccattccagctggcttctgtatccctttgaaatgccgttttcccttttcccgagccttcttactttccagcacaagacattccaggcttgtcttgtgcctccatgcctctgttctggaatcagtcatttctccctgattccaattagtggaccacagcatttagaaactaaggtcggggctagatgctcgttgattttagaacgttgatgctcccaggctgtttcactggggagagctggggattgtgtgtctctgagtgagtggacacatttacacaaactttattactgtatctatttatatgtattgtcaagtaggagctcacatgatacttcagtgttaaccaataccatggagtttcctctcatttcctccctttccatatttctacctcctttctctaccagaaaaaccagactcttattattggtaatatgtttgcttactactcacttataatatgtttacatacccctgaatgtaaccaatctcccattgtcaccacctcctgccccaggcagatgtctgtcaccccatgctgggatctgacacccttgctgggcagcgtcccacatgggcaccctcctctgcttgagccgggctgctgtggtccatgctgacccgttgtggcatccgcacccctaccatttcctgggtttgctcagccccacctcatggctttagcatggaatcgtttatgctctgggttttgatggctcagacttgattctatgctaccgaggcaaaggcttgaagagtgcaaacctttgtccccaagggaatagctgccctcgtgcccattcctcccttcacacacctgttccagggaggagggacctccaggtccagggacctccataaagctgagtggtctttactttttcctcccagggtttgcaacaggtgggtagagccagcgaggccacgcagggccctggctgctgcacctgctcactcacttagccttggtgtgtgtactcagaggaggacagcttggctgcacggatgcttccatggaaatgcttttgaaatgctgcaacagccagccatgtgggtctcaggagcgtaggtgtagagacataaataacaacacggggcatagaatacctgcttcccagaagcaatcagcctctctccctctccacctccgtacagctcccgtgatggagttattcacatgtagacacacacccacaggaagccacctgcggcaggcacgcagccttcacatggcttcttccacatgtgtggcccacacgcgcgcttcagtgactcctctttgacttaagcactaacaactattatttcctccccatctgatgaggaaaccagtgggctgccgagatgcttaaaaaggtagattcatttgtgaaggttgacataggagctcagaggttgattgcattggtttaactctagaaacaaaaaatgtataacccgtttacttcccagaaaactcaaggaaaaaagcatgcccctccttgtccttctcctacttttgcatgacctaaagcataaatgtcatagctacaagaaactttaaggtagcatgacatgaggtagtggcaagggacagctgggcctctgcaacttaatggtagggaggactttgtcaaatctcttcccccttctgagcctctatttgccccctttagaggagataggccagtgcacagctcgtaaggttattaggggctcagagactgtggaggtcaagtgcctgatatagggcctcacatacagtaggtgctcaaatgtcagctacaggtcatttcaggtgtaaggttctgcaccttgatgattcttggccacacactcccagccttatataagtgctctgacagtaatcctctgtgctttgcaaccacccagtcctgggatgattctcctggtggggattccacaagtgctacacatccccagttccttcctcttttgcttaggagggcagtggttggaacattctcctctggccatgttttagcagctctttcaccaacagagggtcgtgctaagaattaaacacagccagtcaatgggaggggcccagatgctgcacttgtggcaatgcacctccagtttctgcctgccagcggttgtggaaaacaccatgtcacactgttcctagctggagaccaaatacaatctgttgtctattcacatactgctgccaagcgatacctcctaacctatatctggttggtggatgttttgaatcaatccaaaccaagagtcacatgtttttattcatattcaacaccaagttgttagagttggtcttctatcacaaatgactaagacgccctgcagatgatcactctcctggggtcactgctcccggtttgtgatgggtgtcctacggtgagggtggaagctcctacaggctgctctacattaggctcttaaccagctccttggaatagggtcatgcagccaagtcatgaatccacacagtactttgtcatcttctcccttaggatgccatggcggtggggccttgtaaacgtccttgttgaagtcccacatgatatactgcaagcatgggctctggaatcagactttctggctcacacccagctctgccagaattaggctgtgctcttggatgacttagtttatgtgccttagtttcctcatctatgagacaggaattagtggtcatacattccagggccattgtggggatcgcatagttgctgtttgtataactgtggcactctggagtcagcaccttacaggatcctgagagctgactgtgaaagtttcagtaaatttgcagaatggatgccatcattggccatggtggaagtatctataccacagaattcagcaaaggcgacaaaccagggcttctatctcctggagagccggttgttaagtatctccagcacaccactgtataaaacacaacagcatccggtgggcactaagcaaccaataaacattagcggttgttatgattattccgtttattaacttgactaataaccatatcaaaaaaagaaatgagaccaatcatatgtaattatttttaatgagcctgtagtagtgactgctggcaactgctacttccttccctaacagctcgagaaacaacccattaataatcttcaaagtgagtttcatgtattcatcctttcgagtattattgagccacgtactaggtcctgtgtcgggcataggggagttcgtggtgtgactagcacagacaacatctttgctctcataaagcttacagtctcgggggaagacagacatgaaggcaagcgaacaaacaaaatcacaacatcatcacaaactgtgaacgtgcttagaaaaaaacagcatggaataattgagaaaatggggatgtgttttttccaattgggtggttgcaggggcatgctggctgtcacacactgcctgccaagagccaattgcgtgcgctcatctcttctcaactctgccttgaatgacatcatctgtgtcgttagcttgaaattggctatggtggaagtatttacaccacggacattggcggatgctacaaaccggagctgttttgttttcccttctggagacctaaaggtgaagatggggccatgctgagagcagtgggaagagcgttttacctgcctgtatacattccctcaggtgggagatactttctgtcccatggaagcttctgctgcagggagagagtgaaaccattccagatagagaaacttggaatggttttctgaatacctgagccctggggaagctttggttgccctttacattcccattgatttcaaccactctacccagtaccagtgccttcttgataacccctgctcccctttggccaagcccacatgatcatctgcttgtggccatggtgctgggtatctgccaggctggaccacaggtggggttctaagtggtgggtgatgatctcgggtgggaagagtcctggtattgttctgattcactgagtactccagccactgcctaagggaggagagaaaccaggcagggtctctggccagggaatggctctggcaaagctagcagggctttagagctccagccaagcacgttgggccctgagccctcaagagagccagagcgggctagaacatgaagccaagcagattacacagtgaggacaaagcagaccctcgagtcctatgttctcgggtgagtgggggatttgggcagggagaggggtactatattgtggaagcgaccaccctgaggcttcatgacaccgggggctcccttatgccactgcagcaatagggtcagtttgctgcaggacatagtcccagtcccaccattcatggagggtagagatatcgacatcctttttcccatcactcctgaccagccgcaggagaagggtaggttagtcctttgccttctctgatttcttttctctcaacatcccaagcagttgctccatgtccacaagaatcccaggtggtagggaggtcagatatacacccatttgccgggtgaggaaaggaaccacggagaggcacaaacatgcacaacaggcctaggttcagcccccacaacttgacttctctaaactccagttcactccttaggcaaaaataataataaaaccaagcacacaagttcctaggaggattactgaagtaacatacggaaaatcactctgcaagctgctattcaaatgctagtaattttttactgtcacaattaggactagtttgaatatcttttgtctcttaacccaatgccccccaccttttttccttcaacattgctcattcatccatccattcattgagtaatgattctgaatgtttgtgaggagtcaaatgctccgctatatcctggaaataggaagctaaaatagacaacgaagagaaggaatgcatacgctggaggtgagccgggccctccgcaggtgcaaggcagccagcatgggtgtcaccaaaataggtgtatgagcaaggaccaagggagtggggagggcgagcgaagggctttgctgcagtggggttggcaggggggtcagggggcttcataggctcataatatgttcccatgcctgtgaccctcatgcctcctcttgtgtggcacaggacctgctctctgaaagagtgaggacctaaaaatgatcactaacttcagatcctacgggcatcagctgaccctgatggatgcactggaggctcaaatgaggttgagctggcctgatttgtttaaaaacaaaaatgaccattaatgagaatgactagatttctgtaagaaccactcaaaccaaaaagaaaaaattccactcaaaaccatttttaaaaatctggatgtctcacttacaaacttgaagctacaggagaagttttcccaatttagagtctattgctccctgctgtgcatttagttctgattaatcattctgtaatttaccagccagagtcctgtcatagttcgttgaacaaactttccatcatccttctggaataaaaacatggatccggacggtgacctcagtgcaaccttgagttgatgcagttttagtgacttggggtccagattgggcatggagctctgcagcctacggctgctcggaatcttaatatcaatagcttagacccccttgaaaatcctttgcatggaggagaagggaagactgctgctgtgtgtgcccacacacttccttgagccagcctaatgccctatgttggccaatagcccctagtaagttggcatatgccccaccatgacaggtagcattttgtagattggaaaattgaatctggaagtttaagtggttgctggtggtgactacagactgcaggaagaatattcatggtgattcagctggacagttgtatttggctgcacagaaagaatgtgacctcttaaaaataaaaaataaaaggacccaggaagtgttgaaaatgacagtcaaactggaacttggaggcaccatctttttttattgatgccagctgtctccaccagtgaatcttgcagaatgccttacacataacaagtgctcagtacacatttgaagaaccgcagctttctggcactgcaaagaatttcagattcaacctcccttctttttttttttcctaatgaggaaaataaaagagaggagatgtttgattgagattagctgtcacctggaacaagagcgtaagttgctgccttttaggattccagcataaagttgtgcaggttgagcacaaaagcaccggagaaaggggataaatggagtctaaaagccagtccagcactggattgaagggagatgggtccttttcctttgacaaagggctcatctcctcaccaagccaactgtggggccatgtccacactgagaaatgtctgcacttgaatagatgtagaagggtgatgttaagagaacagaagtccagactgttgaggattttatagggttaactgattccttctgcctttttgcaagcagagattgtgatttttgctattctgtgaccccctatatctagctatcatctatctgtcttctatatcgtctgtctatctatcaatcatctcttgtaatccatattgatgaggttacagcaactaattgataagagggctaacacagagaacatgagcagcagtaactctctttgggggacacctgaggaatatttcatacatacctgtttgttagacttgatgatggattactccttgtctgtttcctgcagctcctaatagagtcctgtccacaaaaattgtcatgggtggagccttgtactaaacactcagggtagaggtcatgaggccccggaggcaggagaaaacatcttctagggctacagagaggtcatgatataaatgcaggaggaggaactgacccatagccacacagacacaggcagacattagggaagaaccttcaagaaacgtgcaaagaaaaaaaagtaagggaggccattaaagacaatttttaagtttacaaaactaaggcaagccaggctttgcatgcaaatgattaggcaggtgagtcatgcatatatttgtcagttctctttcaaaataagaaataaattaggcacaatgtttgcattttaaaaaatcctttactttgccactctatgaattttcttagtgcaccctgggccctgctctcagttgagttcctgccctggggtctctgagacccagagaaacttcaacacctacccctcccactcccaccaaaacttttggagaatagctcttcctgctcatactttttaatggtaggggcttttgagcagtaaccagtcaggagggccacccaagactgaacctcactgtagagtgaccagggtcaatgcatgtgtacaaagtgtcttactccttgtagagcaggctgtatccaattaaagcttgattaaataccacatagtggagagtaaactgttattagaagctgctaatggacactccatcacctgcattattcactgtgaagaaactaaataaagccagcaaacggtgtgctctttgccatccaggagcctcagtccaaattaattttcatgaaactcagattctaggcagatgtggttcttttgatttttactcctaagtacaggccattgtttgtttttcccagcaaagctcaggcattgtgtgagtttttttcagaggatattgcagaatgagagtttcagagcatgaatatatgtaacctttcaaaggaaatgttcagaaagaacaaaccaaccaatacatcagcctgccaatttaacagtggtatctaaactagcttgctcagatctttacagcaacaaatacaaaaagggactccaaaattatgtgtatgtctatgtcagtttatcaaaaactcaactaagaagtgtctcctcccacagaggaaactgaagttcttgaaggtgactcataagaagaagccactggggacaggggctttgaccctggccctatctgcttcccctctccatctgtggatcaacaagcaggaatatgtcagataatgtccaccttctgttgagctttagctatgggcctggcactccacatgtgttatttcatttgatcaatacaatcaccctctaaattgatattgcttttcatggttgttcacttgggaattggagtttagttaggtcaagtaacttgtctaaagtcgtacagctaatggtgagaagatctggcacttaaacctaggtttccctgactgcagagcccatgctctcatcaaaatatcaatttcctccctcacaaacactagaagggcacccatttggtattgagcctggctgtgaacaaatgcaaaagcaatagaggaggcatctatgctttctttgagtttgaattgtcatggtaacctaacataggggtgggggccttgagaagagttttagagtcatgtcatatcagatctgggctctgtttccactgctgctactcaacctctctaagcctcggtttccttagttgtaaacaaaaataacagttgaccccgactaccacaggggttaggggtgccaatcccccacacagttgaaaatccaagcataatttttgactcccacaaaagtaagctactatcagcctactgttgaccagcagtcttgctgataacttggtcaattaacacacattggctggctgtggtggctcatgcctgtaatcccagcactttgggaggccgaggcgggtagatcacctgaggtcaggagtttgagaccactctggccaacatggtgaaaccccgtctctactaaaaatacaaaattagccgggcgtggtggcacatgcctgtaatcccagctacttggaggctgaggcaggagaatcgcttgaacctgggaggcggaggttgtggtgagcagagatcacgccactgcactccagcctgggcaacaagagtgaaactccgtctcaaaaaaaaaaaaaaaattaacacatatctggtatatgtattatatactatattcttaccataaagtaatccagagaaaaggaaattgttaagaaaatcctaaggaagaggaaatatatttaccactcactgagtggagtggatcagcatgaaggtctctgtcctcattgccttcacatggaataggctgaggaggagggagaggaagggctggccttgctgtctcaggggtggctggaagaggtggaaggggaggcaggcacacttggtgtaaataaaaaaaaaaaatctgcgtgttcgtggacctgtgcagttcaaagccaggttgttaagggtcagttgtaatgtgcttacctcacagggctgttggaaggatgacgtgataccacgcatataacgggcttagcgctatgccaggcacatagtaatggctcaatttattttacagggaaaacatgcaggtagttttcaattatgttggtataaactagtttggtaaagggtgagctacatcatatcctaaaagtagaatcagaatagggctgaaacctggagatctggccctgaagtgaggtgcttgtggttcctgggtggggtccctgcaaagtatggccctggggttcttattttccagtcatcaccatatttaagggtaaagtggaagaggtggagctgcctgtggagaaggtggacatcatcatcagcgagtggatgggctactgtctgttctatgagtccatgctcaacacggtgatctttgccagggacaagtggctggtaagtgtcctgcatgctgtccccgcgttggccggctggctgtcctgctcctctacccaaggcctgcagcctaggaggcatacgaagacttcagagaagactgaggccaggaggtcactgccccaagcccctctctctagagcagatctgtatcagggaacagaatggttgccccgggtccagcatgtgtaaccatcagagtggacttccgtgggtctcaccgcagcctcttttgcaataacagacatccgttctctcttgtcgagttaaaggtccgtttcggtcagcaagtacttaggacttgcatggctgccagagccaggtgtgctattcatctgggcttctccaggccaaagtcgtaacatctctcactgctcctcactggatttaccttcacctcacctcatttgtcctattgactccacctaggtcccttaaattttccttgctccaaaataaaaattgagcactgctgtcctagccctcaccccagacaaggtgacagtccactgcatgagagatggtggcaagggggtgcttgtctggtgactctatgtgcagttcaaaatgtgatgtctttgtcaggtgaatagattacgagacccatttccccacaattcatcaacagaaacctggagggcttatgtttccagaccgggcagctttgtacgtggtagcgattgaagacagacagtacaaggacttcaaaatccactgtaagtcccctcttgcttctccggtggacttccactgcacaattggggtgggaggcactccagtgggcccgagatgagcaggcagtgacatgaacaccattgctgtccctgaagaggagcttatctgggaccctttctggagtctgctctctaaatgtttctatctagtcccaagggtgttaggtctacagacagaaaataagccatatggctgggatgagagaaatgtcctggggtgaaagaatgaatgcaatgtgaattaaaaattggactgaggcagcagaagctgagtttttgcagagatcagcagggcaagtggcttgaaacctgtcaaggttcagttagcccaaaagtccaccgcaggggtctgaagtagcaggtctcttgccaggccaattgttttgaatcctgcctccattccattcaaacttatcaaaataatattgattctcttatgcaaatacatattatttgaggttcttttgaggaatagatagcagagggggtgggaaagagtggagattttgctttgaacaatcaaacgaaaggcgagtgtgcatgtgtgcatgaggcaggggctcgtatctaaacatgtattcttaatgccttatcagctaggcgtgtgtggttctctgagaacaataaagccaaaaaacttctcctcccccgcaatgttttacctggtctgaaaagggctgttatcctatttctcgtaaagggtgacacttctctgtgacacaggcctgatccttaatgagattataccaaacatgtttttgtaaagttgaacatggctgtgtctcctcaaccagaaccaaatacaacaaaggagcaaagaacccctcaaacaggcaaacacccaaaaatccaaattaaagcaagaggcagaagctccaacctatccatcagactgggcacatctgcggttcctgccccaacagggtggtccattcctacttggcaagattactgtggaggggttcacagattgagtagaagaataaatgcctccaagaggctaagactccatccacagttcaacaaattgtggctctgtggatttaaacaattgccatctaatcgtcgttagtggcactgatgaaaactcggctggactctgctatggatgtgtgtatttgtgtgggttcatgcctttctggaaatataaactcaaagtgtgaagttcagagccaggttcagaagaagacaaaagtgggacagctgtttgaagctctgtgccctggaaaccgtctctggttgctgtctgcctccagccaatctggtgtgatttccactatttgacctcctgggggaaggaggcaaaataccaaatgaggacagtgagaggcaggggggcccaggttaaatgctttgcacactgccagccctgggtttaaatcttggctttgccatgtcctaactgggtaaccttgagcaaattatctaatacctttgggcctcagttaagggataattttctcaatcccacagacttgtcatgaggattaagtgagatgacatatattaaaggacgtgacagttcttggtcctataatgggactagatgggaactagtttctgactgtgtagctaagcccctttctgcccctggctctggcaagtgagcctgactgccaagcccctggtggctcagaatctaggacagatgtactctcatggaagattgcagacacaactccacagtgagtgttgatcaaatgcatgtataaataggacatattttgccctggagctgcattttggagttcttgctgtgcaattgtactgaatagtgttttgaggaggaaagcttctaggtacattcttcattgtcaagttcacttagatatttattgagctccaacccgaggcacacctctttaagaaactttctcatggtttccacaacaaagatacctgtgtcaggagcctttgcaggtatgcacattgcaatgagccagcctggggcagggaggggctcctaaggcactggccccagactggagatcatgtgatttctttgattctcattgcagtgttcataccttttggaaaaggaaaaaaaaaaatctgaaagttagcaccatgttatcttgtgcttgttctagagtctctgaaaaataccccaacctcctccccaccccaaaagaacaccaagaaacagacacttaaaatgtatttaaaatacattttctatttacatttttgaaaataatctatttttttgtaaaggaagcaaacccacttagaaattcatttcaaataaatggagactttggttactatgagttctaaatcagaagtaaagcacaaaggttgctggttgctaaggcaacaattgtaagcaattttctattggctcaagaaccagctaagaaggaaaaattttgaaatgaggcaggagagtgagacatgttcagcccctttcagaaagtaagttgttagagggagagctttctttcctttcctctcctttccttttcttttatttccttccctctccttcccttccctcccctcctttcttcttctttctcaaccacacacagcaacatgggagtgcaagaatgaggtcagtgcagaacctgccctccatttgctcaccaatgaatagagaccacatagagacagagataaatatctggcatatactaggctcacaatacataattttaacgaaggaaggaaggaaggaaggaaagtgaaccagcagagggatgtgcaaggtgtagtatttaactcttagagaggagcaatcattttacacacattttctactataaaggaaatacacagaatttcaaaaatggaaggaaactcggtggatgttctattcaatttcatgcacaacccatgaattgtacccagtgcatgaatctacaccctgctgagaatgagagagatgggcaccagtttcttggctgatgagaagactgaaagaaagacctcatgcagaggtggcagtgcttatagcttgatggttgaagggcggccctcttggatggctcagctgctgtctgtgggcttcacttccactcatgacatccagagtttcctctggttccagcccattttatgcaaggattccactttcttcatgagagcctaaaatgtgtcaatctagtgtaaacactttcccttctgcacagaggagaatctgtaagtagcatctggtggcacttgttctatttttctctgacctcattctgaggcagtcccattagcctcatcagagaaactcagatggttggggctggggtggtgagggaggatgtagctacagctctctgcaatcagaaatcacatttctcccctggtacttaattttctttcctcagactgtttttgagatttctgtctttattgattttctgcagtttgattctgatgtgtctaggtgtgtttttctttttatttatcctgcttggggttacatggaattcttggaactgtggatggattgtttcgttagtttagaaaaatttcagccagtatctctacaaatatttttttctgcctgattatctttctccccttcttcaggaactcccattatatgaaataatgtttgatattgtcctatggagcttggatcctctatttttttcaccccttttttctctttgtgtttaagtttggatcatttttattgccccgttttcaactttattggttattccctgatatattcattctgttaataagttcattttaaaaagtcttctttccttatattgttatttcgatttctaacatttccactggcttttttaaaaagtttccatctcgctaatgaaattctccattcattgatgcacactgtccaccttttccactagcttctttaacatacttagtatagatactttaaagtcttgttggataattctaacatctgagcatctctaaatttggttctatgacttttttcttatgatgataagtcatatttttccctttctcatgtgtcttataatttttcattaatgctgggcattgtgagtaaaaggaccagtagagacaggtgaatcacacctatgtccagaaaagagcattgcctctgccaggctattagaatgagggtgtgtgtgagtcaatctagtctgtattaatagtagatttgggctttgttgttgctttaattacatacattatgccatagtatagtcctttttaggagtctgttttcatccattaacaaaagcttcacaggcctctctgatattattttttaatttctagataatcatgatatttcttgatgaccaatggctcttaccccacatacacttatttggcatacagcatacaaataattattgcaacaaataattaatgtgatttatttgtatcctactccatctctgctccacttctgataaaaagggctactgggaaataaatggccagcagaaagaagaaaaaaaaatctaatcccttgggtgatctgtgctctgaatgattgaaggtggggcagtccagctgaggagataagacccaaattaacccatataaaggtaactaaaacaccaggcattgcaaaacagtgcaggcattaaatgtttgggaatgaatctcaattcaaaaaacattatctgtgagcctattctgtgctaaatgctgtactatgggtgttgagggtacaggagaggttatatggtcaggagcgtttagagaaggtctcacaaaggccatgagacattaagatcaccatttttgggacttgaagacagtaaagatcatgtaccccaaaggtttccaaatggttggaattgtctgtatagatttgtaaaactccagctccctggctctcaaatctggagattctgattcagtaggtctggcgtgggccctggagtctgcattttaaaaactgttccaagtgattcgagaacacagaaccactgaaccaaaatccttataagtaagcccagaaaaaaggattgatttgcacatggccgcacagcttgcatggcagcaaagccagagctcaaaccacataatgataaccacttttatgtatcaagtgctttctgtgtgccaggcaatgtcttatgcactttacgtataatcacatttaatcctcatagcaatcgtatgggattaccatctttatcatcatttccattttacagaatccttagaaaccaaggcttagaaaggttatattcgtgcctaagattacacagcaaatacgtggcagagctcagatttgaactccaaagcctaggcctttaaccattacatgcattgactctcaggcttttgcttagcactagcagtgaactcaaactcccggcagagtccagggagaaaagagcaggtgcatagctgcaagtctcttgagaaagacacagaaggcaatgtgttttggcgtgtacgttttatctggggagagggtggatagctatttccacattctagaggggagtcttctctgaaacctgccctgttgccaactaagcagcctcctccccacgaagtaggttttaattgggagtttggcaccagcctcgggtgatttaatgggatttgatgggcatcttttcctcaaactggaatttcacaagcactcatcctctgggattaccttctctgccttcttttcgcaagaaagaagctctttgtgtgccttataaaagaatcagagtcaaaggagaaaagctgtcgctgaccgttcacacctcctgccgcacacacccactctcctaaacacacacaggaacatacgttccctaaggtcctgtttgtttggtgaatgttttaaaataaaatttaatcctgtaagattttagagaaaagcatttctacttcaaggcattttgaaacccattgaaaaaacagatgaatgagattcaggtgcccggaaactaaagagtctgctaaagctgtcctctctgcactgtagggagagaaatcttgcattcctggttgctgtcacggctgggccatggcaggtgaaggatttaggggacatgctgggcttgagccctcgcccccctgtttccctgatgtgtgatcatgggccagatattatatgagagccagatgccaacttctcccagccacagttttctcatctgcagcatagcaatatcctcatgtggttgctgggtagattaaatgaagagtctggcctggactgactgatcaatcaatgactgcaattattggccaggcatggtgactcatgcctgttatcccagcactttgggaggcctaggtgggcagatcacctgaggtcaggagttcaagaccagcctggccaacatggcgaaaccccatctctactaaaaatacaaaaattaacccggcatggtggcgggtgcctgtaatcccagctactcgggaggctgaggcaggaaaaccacttgagcccaggaggcggaggttgcagtgagcccagattaggcctctgggcgatggagccagtctctgtctccaaaaaaagaaaaagatagcaattattaccatattaagggtgatcctgggccatcagacttgaattaatttctcaccaaccccctagatctttctccctcccatacaaagtatcttatgagtagcccaaaggggacaaggagcacggctgacaaggagagggtttgtgctccacttgggggtagttcctaatggggtggatccttagtgagtgcatcttggcatacaaggaaggcagagatgctcctggacccacccaggtgagaaaactgaggttcagagaggttaggtcatttgtacaaaggctgaccagtaagtggtggtgctggaatttaaactgtagttgatttcacgttaaaagcccatgattctctgtgctgcattaaaggttcagtggatggggacaggaaaagggagagagatgggccttctaggtcttctaggtgtggagaacagctcgagacagcataggaatgggaacgtagaagacagataagggagttcataggagacgctgctggcttggggaggggacaggaaggaagagtcagctagcctgggttctagtctttgccctgctgcactctagctataggagcttggagcagtttcccagcctctctgagctctagtttacctaacaacaaagtgggacttaccttttcccgaggtagaaatggaaatgggagtgagcatttggcacattgcaaagtgcccccaggtgagcagttctgcctctatttcgatgcaagggaactcgagctgccactcagccctcaggcacgctgtgctctaggactcaggagggttgggtgagcttctgggggtcctgcgcctgccttcacgtcttgctctgctcccacagggtgggagaatgtctatggctttgacatgacctgcatccgggacgtggccatgaaggagcctctagtggacatcgtggatccaaagcaagtggtgaccaatgcctgtttgataaaggtctggacactcatccggggtggacctgggtgtgctgggagccccgctgtgccaccctggagtccaggcaatgccggctcctgcacagcccccacctggtgaggcaaggctgccttggccagagcctgtgatgctccctaagctcaagtcaaaagctggcagtccgcctggacacagccactgagagagtggctccatggtggcacggatgtgggagggccccagcacaggggccctggtggcgtgcagaagggtgggggtgcagggaagagaggggcattgcaggagaggacacctggaagaggagagcgtgctcaggtttggggcagttggtccattcagaggtagacgtctctcttagggaagaaatccaggacctcagtatgctgtgtaatcatcatcatgctcttgcctccacacacacctttgccccagcggcctgccagatagagcttccagctgccccttcctgagcgtccctgttcatgctctcgcctccacatacacctttgccccagcggcctgccagatagagcttccagctgccccttcctgagcgtccctgtttgtacatgctctaaaccaagtgtgtccaacctgcatcctctgggccacatgtggtccaggatggctttgaatgcaacccaacacaaattcgtaaacttaaaacattaagagacttttttgtgggattttttttttagctcattagctatcattagtgttagtgtattttatgtgtggcccaagacagttcttcttctaatgtgacccacggtagccaaaagattagacacgcctgctctaaacacctttgcccgaggcttccttcagtgcagatgaagaacagctgctcagcgtctttgccacaccaatccctagtatattcttattattaaaaattcaaacatgtccagttagatagaataaaggtgaaaggtgccctccgcctccctccagccccatcctcctccagaggtaaccactgttcacaggctgggttgcctcttccagtcctttttgtatgcatttgcattatatatgctaatatattatgttgaaccatataaaactattgatatttgacagttttttaaaatagagacatcaatttcatataattcaagccaaaaaaattttttttgagacagaatctcactctgtcacccagactggagtgcagtggcacaatcacagctcactgcaatctcgactaactgaacagtttcatgtaccacaagctattttttttttgagacaggatctctttctctctctgtcacccaggttgaagtgcagtggtgtgataatagctcactgcagcctcactgaggctcaggtgattttcctgtcttagcctcctgagtagctgaaactacggctacgtgccaccaggcatggctaatttttttttttttgtattaatggggtttggccatgttgcccaggctggtctcaaactcctgggcttaagtgatccacccacctcagcttcccaagtgctgggatgacagacatgtgctaccacgcccagcccaggttaatttttaaattcaaaaatcagcccacctgagtctcatcttgctaacatgccggcctactgtgctcctgcacgcatcattctttttctgaaagtatcggggcagggtactggactggaatatttatagtaggataaagggattggagttcagggccactaaggacgggggtgggggaggtttctgaaagactgacacaactgctgctttgcccatgtgagaactgtcctttgtcctggacacaagccttgctaggaagaactgcacccgttgggctggagtatcactgtggactttagaaaggtcctcacagggcaaataaacctagaatgaacctcatcagaccccatcagatgccccctctctttagtagcatcctgcctgagaggtttggctttgagtctaagcctcagactctccattcacagggttctcactacttcattcagccttttctgggtccaggcaggattaattgtgagcaaatgtgtccttttgtttctttctaccagtccctctgtccctgaagcctcttcctccttgccatcctaaacaagaacaaggaaagtatgcccccagcaagaagctcacccatagtacaaggcacttctgtaaatgtagaatagatagaagtccactagtgcaactgaatttgccaaaatgacatgtggcagtgatatttaccattaggcatctgcacgtactggcttcagcttggggataaaattccttcaatattcttggaccccaggttgctctctgcccctgacccaggccccattggcaggtgtagccactgcatttctgtttgcactgccggacacgtcagccactgtcctggccctctccactccccaggcaagaactagcaggggcctttcagttggttagacctgagcatatccaggggcaaagcagccaaggagcggctggaggggtgtgtgttccgtacactccttatgaaaactcccggggctctggttctgtctcaggactcgtgacctgtgatgattttctgtcccacgctggtccctttcttcctctgtgttcctgagaaggatgacgattgtctgtgtttgcttctgcttccaggagagcccttccgccagctctctcctgctgatgtgctaggcaacatcttgccgagcctgttgggaaaacacttgcccttcttcacacacttaattgctattttcatcgctattaacattgcagagtgtgacactttattataattaaggttctattttaaccagacttctgctccgagacatccatttctaacattgtttaacggtggggatcgcagcggccaggggcacttctgagtaatttatgctggtgaagccctctgcttcaagcgggtcacctgaggccaagtcagtgggtctccctggggtctcagagctgctgtttctgctgcagaaaagaggaagcctcctagtcgaggggctgggctctggggagtcagggtaactggggctgatttggttgggggttggggaacctgagcccagaggacctttgtgtttttgaagcctagctacagctgatcccatcctcacagatggcctggacccccattccaaaagaccacctgcccttattgttgccattataatgtgcggcttcaatacttttggtcctaaaggcttttgttctatcagaggcctctattaagatgcaaatgtctcagggatctattgaaagctgtcagctacaagagttgatagctgacattttgttgatggacatctgacagcaagatcctttagaggtggaattcctgccagatggggggtgcgtgtgcgtgtgtgtgtgtgtgtgtgtgtgtgtgtgtacgcgtgcgcatgcgggatagaaggagaaagtaaccacgtctagattgtaagccataaggaatcattgaaggttatagatccagagactgacacagtctggatgaacctgagttacgaaagaggggcctaggcaaagaagtaagtcttcaagcagggagacctgttctgagaagaagattgatgagtcaacacatattgctgtgtattaggtgctgctgtgcactgaggatacacaggacaatgaggtgtaacttctgccactgaaggcttcagtgtatcggccagggcaagggcgaaggtggtgagactgcgatatgagccagaagtgagattggaaggccatgctacactggtgacggagggaaccaagaaagaaagataccagggaccttggaaagagcctggagcctggctgattggccctgagaaggtgatggaaaagtcagtaagggtagacactgtgatgccattaacaacaatacaggcaaccaaggcttgtccgaagagtttttgagctggaggacacctgtggacagcatgtggccatgtggctgggagggataatgagcattatgaaggctgacatatactcagtctaaaacgtttcctagatttgagcaatggcccacgctaacagatgacatgtaatgaaggacccctccccttgagggatgtggtggaggaaggggcttggccgacctaaatgcaagctgaaccagcagtgtgctccttgggaacacaggctgctataagtatgtgccaatggaaggacgtggaggacctgatgtggtcagtataactctcagttttgcaagtggcaggacccacccagaggagaaaggccagggtgatgagcggtcagacatcacgacttatgaggaatgaataaaaagccagagatagcttgcattggagaagaaaaggtttaagggacctgtgtgaattggaacacacatttggcttcttctgtgggtggaagttacagagggatgagtgtgaactttcttcattagttttgaagaaggacctaatgactggagatgccaggacgtggactgatctgcctggcagatggtgaattctccatccctaaaggtgttcagcaagcactaggtgggtgctcagcaagcactagatggccactaaagaggaggttcttgccttggataaaaggctcagcttaagaagatgggctttataatcccatcaaattctgcatgcttgaccaagggctcaccattcaattagttcttgttccccttctctgggctctagaaacacagtgtaattggcatttgaatgtgacctcaccaagggcctcccacattcccctaaacctacaatctcaccttcttcccaatcaacagtcagagagcttcagcttccacagaagatgtcatggctacacaccccagatcctaggaggactctgatctcattggttcccttaaccactttttctctgtccatccctgtggagttaggacttctctttgaaggccccaggatagtttgcgtctgtttttcctttatttatcctggaaatacattgagacaaaagccatttcatcgctttgctggtcttgttttcctaccctctggtccctctctcctaattcctactaataattccatcttccaggcctcaggaggtccctgtggaaccaaccaggcatacagatggccttctggctcttacagagttttcaggacagaggtccttgctgcgcaaccttgactaatgggaagttcttccttgggcctcactagaatctgtcaggatgcctcttgggccctagtaggtttgccctgcctcacggggccagcaagcagcaggccagcattcttccatagaaaagaacagcacagtgcagacgtctttcaattccacctgctccccatgcgagattgattttcagccactttccagttgaaattcttaagagttattagttcttcatgttccacgttccccagccagaactgaaaattctcacttcttattttccccttttatttatttttgaaaacagtccagccttgttaaaaatggccagcagaactttcctaagctctgtctgtgactttgtgggctcaggtccttactcctaatgtcatccttgatgcctcctattgctgggaacttgcgtatcaaaaaattggggaaggagtagtctggttcatctacatcactggagggcctgataaaacacagattgctgttttggtccagcaggtctgcccccctcagaatttgcccccaggtactgttgatgctgatatttcagggaccacattttaagagcgatggatggagcagtgcctgggtggaccactcgaggctgctctgacaggtgaagggatgcattgtctaattaaccctcctgttctctcccttccccatcatccccctgtagccccaaaccctggaagatttatcttccgaattctgctcccctcaggttttgattcaaatccatttgcaccattgcttgagcacactccaccctagaaaggatggaggaggtgattgggagggcggtggggagcctgggaaatcaccccaagaataaagatatccctcagagagctgacagaccacagtctctcacagaacgaggctgctgaccgggacccagacttggtggaggcgataagttcccggcattctctcttctctgggctgcaggaggtggacatttacacagtgaagacggaagagctatcgttcacatctgcattctgcctgcagatacagcgcaacgactacgtccacgccctggtcacctattttaatattgaatttaccaagtgccacaagaaaatggggttttccacaggtgagctgtttgttgcttcccagagcctcctccctctcccatgcttcctcaagtctttgtggggtgaccagagctggccttgacttggggagaaggggctgggtgttagctgggtgacacctatcaaccctctccagccatggaggaaccatgcatccctatatttgtgctgtccaaggagaaggtaaataatgttgtggttgttacagcacaagttgagagtgtgttggatgagggagaggcaggaggtagggctcatggaggggccccaagccctttcaaaggcatatttgttcaggtagcattttctgagcacattctgtgtggtgggtatggatggagttgaataagcctagtctgcactgccatgcctctgtgcaggacacagcctgtcttgcagcagcctgcacactggtctctatgtctccttcccttctcccttactttcacaccaacccatccttcattaaatctctgttggtgttcccccaagatcaccccactgctactcccactcccaaatcccagccccgcttacgaggtgcctcgctgcctgcagtagataagcctggcaaatggggatcccatggcctggccctggcccactctccagcctcattcctcaccacccctcttggccgagccctgtcccgtcgctgctaccccacaggtggcccagctacaccgagctccttgctgacttctaaactcagtgaggcctcttcattctctgggccatggcttctacacacaccagcccttgcctatccaggtgtgccctggaggtgggaggggccttagtcagaggctctcatcatcccctcttctcctgtatcagtctgtgagggcagccataacaaaatacccaggcttgggggcttaaccacacatgcagttctggaggctggaagtccaaaggcaaggtgtcagcagggtggatttctggtgagggatctcctcttgccttgtagttgtccaccttctcactgtgtcctcacgtggtctttcctctgtgctcatgagcccttggtggctctatgtgtgtcctaattgcctcttctaaggacaccagtcagattggatgaagttaatcacctcttttaaagcccttttcccaaatacagtcacattctcaggtactggggattaggacttcaacatgaatttggagggggggacaattcaggtggtaacaccacccctgagccatctcttcacctggtttcctgtctcagctcaggggttacctgatccccgctttccctttgggtcaaggttcgatgtcctcagggtgaacctaacatctcgtgcatgtgcctggcatggtgatgtttcaagtgagacacatgcacaacagcaagaagaaatcaggacaaaagagtataaaaagtcaaagaaagcattctcacccccaacccatcccactcccactcttcagaggcaaatattattattaatgatttcttttgtatcattccaccaaatttcagtgagtgcacaagcacatgcatatccatagatgcctcttttttggctttttattttgaaataattatagattcacaggaagttgtaaaaatagtacacagagttgtgtgaaccctttgcccagctgccccattgatggtgtcttacgtaagcatagtacaatatcaaaactacacctttttaaaaaaacttaggttggatcctaccctccacactgccctcagctaccttttctttatttaacaacgttatcttggtgatactctcatagcctcacagagatacctagcttctttttttaaacaaccacacaggattccaacacagggcttgccattatttattcagcattttcaccctttcttgcaactgtcagtctcctgcatgagtagggatcatatctcagtgatctctgcattcctgtcttctaaagcacagttctaaacaaattgctctaagaagtgtatgatgatatgacccctgcccttaagaatgtgttcctattgagtcttcctgggaattgggagcatgtcatcagggggtgaggaggtgagtagttgtatgtctagtagggggagtgggaaggtgagttctaccagaaatcgaggacatgattctttacttccagaagccatgaagaaaatgatgctttttttttttttttttttttttttttctcagagacaaggtctcactctgtctcccaggctggagtgcagtggcacaatcatagctcactgcagccttgacctcctgggctcaagcgatcctcctgccttagccacccaagtagctgggactacaggcacatgccaccatgcctggatactttttaatttttttttttttttggtagagatggggtcttgcctcattgcccaggctggtctcaatgattctcttttacctatggaaagagagggcaagagacagatttatctcttcatagaaaggcttttcccagaaccagtgcctcctgattactaagattgggacttttggtctccgtcagccaggcagtgctggtgctttcctgccctgatctgggtcattatcagctgctgccctcctcacaggagcagtacatgtcttcccagtgggcaggagcagccaggagggggaaggtggattttactttgatcttgaaggattgggaagactgtgcctagcaatggtgagagtaggggtagtgagggagctggggaggagccttcttggggacagtggctgtgattggaagctaaggatgaagtcataggagctggctctgcctattccatcaccaggatgatgtctaacccagagcctgccctgctgatgagaaagtccatgggcaaggatgctctgggaaaagttctaagtttccaaaccccaggctctatccctgcagctctcagccatagttttattttccttgagatgatctattaatatttctagtctccaaagtcaagcagacagcctgctggaccctgtctagagatggctccctggctctggggtgttagggatgacattcttcatggtcccatgtggaggagcctggattaagctcacatccagaatcaagacatcggctctgggctgcctgaaagatggcgaggatttgccctgagtgttgaaggctctaacccagtggctttccttcctagtctttggtcacacccccaccacagtcctacgtggctcaaagaccaaggatctaaacccagttgtgagcctactcctctttttgcaattatagtgttatgcctcctcccttttgcacagaattctacaaacttaggttctgaaagacatttggaggtcctacagtctccagtttgtcatgccttggggaagtggttctcaaagtgtggttcctggacgggtaacaccagtatcacctgggaaattgttagaattgcaaattcttgagcctcaccctggacctcctgaatcagaaactctgggggtgggggccagccgtctgtgtcttaacaagacctccaggtgattgcgatgcatgctccagcttaaggaccactgcctctgtgcaagactgccctgaaccagagggttgagaatttgaccaatgttgactttcttctggaaaggctattccatctcctcactcaggtataccctcaggcctcaccaagactctttgctttctggctgacgtagatccctcttcttggcacatgcctatatgggtagcaatgggggtgggagaatactttgttgagttgctttctcagccaccttcgcgtgtcagcgtgggggctctgtttctagcaggtagcaaacttctttcccagttcatgtgggttagcagtggggtatactcagaccatctatattctgacaactgaccgagtaaccctttctgtttttatggatctcagatgcacagacttagattaatcctaattcttggctcatgccatatgtcattattggaccattcatggttcactttttttgctaatttatatattaattatatataattatattatatattaatataatgaatatccatgaactcaccacataactcagcaactagaatataaattaattactattaactagaatgtaaatagtaactagaatgaattaataaatactaacaaaataaattaataaatactaataaatttattagtattactattagaaggtaaatacattagttaatattaaaaataaattgtttttaactaaaatataaatattgactagaaagacatggtaataactgtaatataattataattaaatgtaaatcaattaatgcatatttgcattaatttgcttacacttattgattcgagctatgccctgactcaatgactgaaatgctgccaacacctctgcatcttcctggatgccccaccccatcccacctcccgtatcgcctccagatgaacattatcctgaattttgtgttccttattcccttgctatttatgaaaagttttatcacatggatgtgtgtgcctaaacaaggtattgtttggtctcagctgtttttgaacttgatgcaaagtgtagcctgctgtgtgtggtccctctgcatcaacccccaactgagtcttctgttctcagcccagtggtagcgcgctctgcgggccacttagaaacacatcccataccgcacagcctgaaaaatgatcccttctaatgactctgacgtctctgcagctccaggcagaagctgtcacaaataggcacagacagccagggttccaggctgtggcagccagtgggcacggtgccccccccaccacaacacatcctcagtggggtgggggtagaagtgggaactggggcccctggggctgctgtgtaatccaggaaagccaggtagcaggtggaagggcaggagccccagcagaagcaggcctgggtgcaagccctggttttttcaggtatcagcaaggtaggcagatcagacattggaaaggactttgggcaagtttactttctgcgccttgggctcaggcagctcctttctgccattgacatcctgtgacattgagtcattttcccacattaaagaagcttcttggtgcatagtcctcaattctccaaaaggcctatgaattctctagagaatataattccaaacttacagctagaaaaattatatcccagaaaggacgaccagccacttagccattggtcagtgagatgggaagcaggattccattccctttccaaaagcaccaggaaaactctggtgagaggccagtccctgccatttgtaccctcagctccctgtgttcccaagccccatccttggtcatagtgcccaccctacttctcactatttgcctgaatgtcttctcactgaggctgtatgatcgggggaggaggggacaaagtggtgttcatcccgtttgctgttccccaattctacagccatacccggcctgtggcaggcatcctaagtggaagtctgtggaatggtgaatgaatgcactgcactaggaatgctgcaggcagtactggtcatgctcacttcaaaatgtagaagaaaagctgcctaaagcctagaatcagagagactgtgatggggaagggaactgtgggagggagaaaaggggtatgtggggccagaatgctaagagcagggaggcatcttcagaatggggaaggctgaaagccagttgtacaatctggatggtcatagatggggttggggcaggggaagggaaagctttcctccctgacaaggagaactctagatgttgtccacaaccctttcctgagcgcccacccttgtgcacggtgacattctggatgttttccaagacattctccaccagtagagagaggcggcatatctttgcagaccagagccatagttgatggactaataaaatcatataccactctaatgaccaaagacttgcctgatgcaatggcttagtaagtccctaacatgggcctaatatgttttaggtagggtggccatgtaacgcatctttccattaaggacacgtatgcaggtgaaagggagacctattaatcattatgccaggaaaacagatgtgaactggaactgtcccaggcacagcaggaggtttgatcacccttagtctatgatcctttccctttctcatctcatctcatcctcacaatacgtcaggaggtgaatatcatgagccatattctgcagatgtggaaaaggagccccaggtcacatcgcatgtcagtggcaaagtggacactggacacggggctattgtcacctaattaatgtctttcccactctaccttcccaaaggaggtcaggagatgcactgcgattcagccatggctgtgtgtctacgtcacctgcccctccacgccccccagaattactgacttcaaatctcttggagtagaatcaaaacattgacttttactcagcttctcctgggcactttgatggagaatcaggattgggaaaactggtttagacaattactccatggctaatgggcccatcatggaaacgagatgtttatggatgttcttaaccctttgatgttgatatcaaggaaaataatcatcttcctccaactcaaagtcggcatgttttggggactaccatcagaggcagaccccatggctgacaaatctgggccaggaagtctctgggggtctcataaggcatcggattaggtgacagaaggaggctgcttgaaatccctttgcctgaaggtctttaggaacaggagagagacacctgtctgagctggtgtaggtggaagtgggggcgagagtgctgtcagtcatacactgacagtctccacacataaccaggaactatcttttgactatttagaggtagctgggagagatggttgttgggagcaggtggactttgtctgcagacagcagtatgccctgaaggccagaaaggctggatgtgttcaggaacccaggcagggtctgaaagggatagactgcacattcatgatcctccttccctttccaaatgtgcaggctgcactttctccccatgaccttgagtttgcatcgatttcccaaatgcacacacggagggctacttgagtctctctccaaaccactgacatttgatcaagccagttcattgtgaagggcagagaaagacagactcttcagtgctgttaaaattggccttggggttttgaaagctcttagaggtcacctggtctgagtcagtgcatgatcaagccccagttggcgctgtgtgaacacctgccagggtggacctcaggtggctcatatgattgtgggacagctctaattcttggtaaattaaaaatctgccttctaatcatgcctagtgactagcctttgttctgcccccaaagccatgataaggccacatgtaagtctttccatgtgacagcttttgaagtgttttgaagacccttatcttatccccaagtcttctcatctttatccttagtcctaaaaaaaaaaaaaaaagaaatcctggtagaggaatgcaacagcccaaaccaagaggaacttcctgtaataagatgggttcttctgcagtctgtagattccaaaggcccccagggtaactggagtacattgaactccagtacgagtacattgaagcactacagacatttgctctttgggttcttaccatcattcatttattcaatactcgtagatctaccaagcacagaggcaggcaccgaggaagcaaggctggcccggtccctgccctcatggagcttgcagtccatggaggatgcagacaaacggggatggggggaaggcatttatcttgtgtgacaggcaccgcaataacaggagctcagggtgccttgggagctctcagtccaggttttgcgggtcaggcaaggcttcccagaggaaggatgaggaagagagaggctggaaaggagggagaggaaggatttcagagacagctgctggcaaggacggtggcctctgaggcagaactcctcacatttaactggagaatatatcgtgtgctgagaggggagggaagagactcaatggcagatatgggggaggcgcaagtaccactatggctttgggtcatacaggatgaatgagctgtgggccagcattagggctgtggaacaagaaccatccctcatttctttctgatctggttaggaagatacacctgaaaccctacagcaggtctgggccaaggtgctaggtttagttccccgtgcacagagaagcaggcagggaaagctctttttttttttttttttttttgagacagggtctcactcactggtttgcacccaggctagagtgcagtggtatagtcacagctcactgcaaccttgaactcccaggctcaatgcatcctcctgcttcagcctcctgagtagctgggaccacagatgtgtgctaccacactcgcctagttttctcattatgttgcccaggctggtcttgaactcctgggctcaaccagtcctcctgcctcagcttcctgagtagctgaggttacagctatgagccactatgtgtgcccagcaggaaaagctagttgtaagattgaggaccaagtacctgccatatcagtggatctggggaaactggtttagctgtggagtttgcatgaatgatgtcatttaaggggagataggagggcctactctacaaatctcttccccatactgtctgaagatcttcattctgttgaactaattaaaaacagcagcatgttcagatgcatgtatgtccatgcatttagtgggtgacagggtattcctcatccatcccttgctatgaacttgtagtatcgggttgtttgtcttctgatccccagcactgaggagatggggatgtgatgggaggagaggccactgggactgagagggagttctgatggggcttggaggaaggctataaggactatgcacctgacccaacaagagtactggggtgggtggtttcagtgagtcccaggggaagcccagcaacttctatgcagggtcccagcctcatccctttggagacttcgtctctgactctttcttcccacctcccctgttctctcacccctcagcccctgatgctccctacacccactggaagcagaccgtcttctacttggaagattacctcactgtccggaggggggaggaaatctacgggaccatatccatgaagccaaatgccaaaaatgtggtaagtgccgagggacataaggacataagggagaagggccccacagagctggctcgctcaggacccacttgcccgggttcttaagtgtctcatgaacagtcagaaacttactgaggcaggcagtcggtagccacatgtggacatgactaggcctaattgagggactcaggcttgacccctcaaaactccgcaaatagaggttttccctgggtccaattctggactgccttggctttgaagacagcttccagctcttcctgtgaggggctttcaaataaatgggtcctacctcatttagtaagagctgggccaggagataagctcctggtggctggaggatgtttggcgtgcatttcttcagctggcctggtgcgagggagacttgctggcactttcggggcagccccaggtgtgggcatgagcgctaaaaacgtctgcagagtgctctgaaggtcacctcacagaacacttaaccaccccaatcagtttacttccaggacgaactcggaacgttttgttattagagcaggaaggatttagggagaaatggaagaacttcctgtgaggacaaggaggcagcagaatggattcctgtgggctgttcaggggaaccccttagccagaaagccttaagacgctggtgctacccatccctgtggttccaggagcaggtggtgccagagagtggggctgtggcttcatacccagacggccgcctgacccttcgctctctctctgccttgcagcgagacctcgatttcacagtagacttggattttaagggacagctgtgtgaaacatctgtatctaatgactacaaaatgcgttagcacacgtgggaagctgcagagagcaacgagaaaaggaactctcacctcgatctgccgtgccgtcccaaagaataccgtttgcaggactacacacttgaaaaccagagttttcaactctgccttgaagattggtgaactccccagggctcccgtgggctctgccactggacagaaggcctccagctcctccgctctgccctggtagcccttcacgaaggctttgtgttgccaacaaagagcgacctggcgtgctgtggctgggccccgagggtggaaacgtattcgcgtctccccgtctcctccttaactgtgactctccgggtcttctgagttttgcatgctgcgggtgtctaggacagattgcttccactagaacctggagacatagcatctttgatagcataagccagattatctgtgtgtgcggtggtgtgcgtgtgcgtgcatgtgtgaatgtgagcagcatagttgatatttacccacaaacacctgtatatgcgtgcatatacaaccaagtgggtagacctaggtgttctctcagaggggtgtgtgtgtgtgtgcgtgcgcgtgtgcctagaatatatattactctcagaggagattctgttgcttttgaataggaatttgttttgtgattagttcgccccttccccaccccttaccagatgttaagcagctatgaaacattctctgtactagttctggtctccttttgactggactgtggctctgaaccttgagcatagtaccacggactccgtgggcgctcaataaacacacatgagaacaaa

SEQ ID NO: 113 - DNA, 12238 bp, Homo sapiens
gggctgtccggccagggtggttggtggtaaggattcaggctccgtcctaacgaggccgtggcctgaggctcagggccccccgcccctccctcccagcccaccagcgtcacctcccagccccgagctggaccgcacaccttgggacacggttttccacttcctaaggacgagccccagactggaggagaggtccgaggaggtgagtgcgcagcctgctcctccctggcccgcccaggcctgggaccctgctgtgaggtggagagaggcgacaccccgcccttgccccccacctggctctcctctaaaccccgttggggcaggctgagggaagaaggaaaggtgagagaaaaggtgggaaattccaggggccgggattagagcaaaataaaggctccgtttttttcttccttatcatcaacaaacctccacccaaaaaaggaggctaaaaaaaaagccacccacaccaagagacggttgggaccaggtggtgggaagacacagaggcgggacgcacccacctagagtctggcatgtgcgtgggccccaggggccagatgggtttagctggagcaggaagggccgccacctcggggctgtgcccacgtcctgtctcgggccgccctcggggctgcgcgcgcggccgctccatcgcgccctccttccatccaggtgggcgttggactctttgcgaggaccccggcggctggcccgggggaggcggccgaggcggcggcggcggcggccgggggcgacatggcggaggagcaggacctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcaggaagctcgcggaccagtacccgcacctgcacaacgctgagctcagcaagacgctgggcaagctctggaggtgagcacccgaccgccccccgggctcgggccctctagcttcgggtggattcagggtagccgaggcggcccggcctcctgcacctcagagcgggactgtctggcagtcctccttggatagggctggaagaccaggtgtgggggccgcgcccgcccttccatcacaaggaccctggaactcggaactccagcggcctaggccgggtctccctacggggcggcgggcaggaaggcgccccctcgtggttggaattttgcgggtggcagaccgtggggcctggggctttggagggagggaaggaggccttcactaactcctgcccacagatacgcacactatgccaccagctgctgtggtcaggaggatacgagggaaacgcttggaaagaaccaaagggttggctggagattcagggaaactgaggcagtcagatggagaactcaggggaggtttaaagaaaacggaattcagatgagagtctttggaagagtgagggatgaagaactgcgggacaaatctgctgctgcgggacctcatcctatcctagggctcttccctgggactttctgacgccaccctcctttgagttgggggcttcttcatcctcctagggagaggacacacagtaaggggctccccctcctgccctgccccagagtcaccaagctgatctctttcctccctctcccagttcggcgccatcttccctgccagggccccaccccaacgttgagcaacctcttccccactgccccagagctggagctgagcactctggccagaaggaaaccttggcctccttcctgcccaggggccctcagagtcccaggttccctgggaccagcccacacctctaggaaaaacatcccccgcagggagcaattatcccaccctcgactcaggtctggggttcagccaggcctcctggggatgtgtggaacaagacagtcccccactcccacccgggagtgccagagcagctctgaaagagaccagggactccaggagatgtgagccggtagcagtcacctgattctcgctagactgaccaagagacaggcccagaaaggcaaaggaatcacaaaggtcacatagaagttggtagcagagccagggccagaacccaggactcccatactctctgtccagaggacttcccctgaccctggtgacagtggtggatcacctacactttgaggagtggtcaggaggttggggggaagcaagaagatgagaacaagagtgaggagcatctgggttccagaaaattagggctttgtcagaggagcccggctctcttccgctgccctcccccttgccagccacagttgggtagagattgggtctagaggcttagagtggtagaaggtgcaggaggatctccaagagaccaaaagattcacatcccgccccctggcctgttcttgccatgtgtttgctgaagacctggtgccccttcccctgccccttctcagccctcagtgccctgctcacccagggcaggcccagggctcagcgaccagcccgctgtgtggacccagacagcccagttctgcccaagagcagaggtcacagctagctcctccacccaaggtccatccagatctgggtggggcttggcccaggccagtatctttagtgccaggggacaaagagcaagtgagaaacagacaaccaggagagacatacagatagggcagactctggggaccatgagaagaccacagtacgagcccaacgagagtcaaagcaaggacggacctcattttccctccatctcccattgccaagggtttaagattggctcctccattgtccctgtccccaggttcccccagcccagaaccctgggcttggactcccttcaggaggacttattcttggccatcactcaagctgtgtgcacaggggccagcctgaggtgtggcagtcaggaaaactggcactacttgctgaggacccaatcccaatgggaggatggggccagaaccatggcaaggatcaaaggcaatgccaacagagggtggctccctggaccctggaggggggtcctgagagacatttggatttgggctgggctggccaattgctccaggggcttctcctgaaacctccccaagctgtgactcctgggatgtcaagaagtggggtggttaggtaggcagagctggaaaacaggtgtcttaaaaccaaaaagagaaagatacacacagactgtgtggagtgccccaagggagtgtgggatcagacacactggagcccaggtcctaaggggccgtgtcagccccaacagtcattctaacctttgatgcccatctggggaggggctagttgaggctgatcacagggtggtgcctgtgggttggctgatctgcctggaaagaaccagagccaagaaactggaaaggcggacacaggcaagagtccctcctgtgtggtgggggtcacccagcctctgttcccagtgccacaggccccttccccaagtagtcttcttatgcccctggcctagcaggacacaggtagcagcaatcagtgccccactgtgggaggtccccggttggggtttccagtttgggtgaggaatcagcctacctcttcttgcccccattccaaacctgggagaccagggagaaagagggctgacaggaaggtgcagatgaggactgggtttggagttagagctggaggcgaagttgggggtttggggctggtaatgttgagtggggactggtgctggagattgggtttacatggtgggcaggctgggcttggggttggggtggaggtggaatcagctgtccggcacagctggtggaggagggagctggggtcggggatggcagtggccccaggcttagatttctgtcagggttaggctaatgctgggaactagcttaggaggtagcagcggaatccgatgttggaatcctctctctcttctggcccctgtcactttcttgctgatgctggctgccagctgggcagggggcaagggaaggataggtgaaagagtgagctctgtgtcccatgtccccagccatcccagaagcccctctgttggggtccactgctggcggagcagctctctcctctgtgggttctccccagtcacaccctcaaggcctgctccaccccctcccctggtcccagccgtcagagagggtgcccacatcccactccctgactctcaaggccctgctccggcatctttgtcctaagtgtgtacactgactctgacagagtctcggctggagggaccctctgagaaagctggggctagggctgggctcagggccggggtggggggagtagacagggaggctaagccgcagaggaatgctgctgccggctaggaggtgcctggcatgaccacccccgcccagcctggggagggagggctcggccttctgctgactgggggaagagggcactcactggggtgtgaggggtggggcagctgaagagacaagccctctggactgacagacaaggctgctcccacaaagactcatggattctcagtaccaaggtctgggattctagaatctggactttcccctcgaccccctctgtaaggtaccccatcctgccctcctcaccctggggcagccaaaccctaaatgccctccaccctccaaccctggcctaaggctggagtcggtggcaagggcgctggcttcagggcttcttctctccatgtgttggtttcagggactgttccagggtctgaggagaggctagcttcctctactctctgctattttctggacaaggatataggatcccccacaggaggcagtaccccccacccagacccatggtaaagaggagccacatctgccccctcagtcccaccacactggaattcacacaatcaggacccagagttaagagtccaaccctagatcctcctgtccaaccacccccgcaagcagcattagaaaagcacctcttggggccgggcacggtggctcatgcctataatctcagcactttgggaggccaaggcgggtggatcacctgaggtcaggagttggagaccagcctggccaatatggtgaaacctcgtctctactaaaaatacaaaaattagccaggcatggtggtgcgtgcctgtagtcccagctacccgggaggctgaggcaggagaatcgcttgaactcaggaagccgagattgcagtgagctgagaccgcatcacggcactccagcctgggcgacagagtgagactctgtctctaaataaataaaaaattaaaaatagaaaagtacctcttgggctgggcacaatggctcatgcctgtaatcccagcactttggaaggccaaggcaggcggatcaactaaggtcaggagttggagaccagcctggtcaacatggtgaaaccccatctctactaaaaatacaaaaattaaccgggcgtggtggcgcatgcttgtaatcccagctacttgggaggctgaggcacaagaatcacttgaacctgggaggcagaggttgcagtgagctgagatcataccactgagctctagcatgggtgacagagtgagattccctcacagaaaaaaaaaagaaagaaagaaaagcacctcttcctcaaggtgctcagcccgcttcccaggccctggtgcaaggcatctcacatccattattctggccaatcccacacccaagttaagccaatgttatcatccttttataggtgaagaaactcaggctcagagaagtaatttgctcaaggtcacacacacagctagtaagtagcagagactgagttctcccccagccatgctgcttctattgcccaccctcagtcccagggagctcacccccactgaagtagccaattccacttgcagacagctttgatgatgagaaagtttttcctttccttgaactggcatctgccccttgaaacctctactcctacttctaactcctcctcaggggctgccaggagcagcgggctgacccctctctcaccctccagcccatgaaagatttgggggcagccctctgaggctgttattccttgggcctcacatctctcagtccacaaatcatagggcacagcccccaccccgggtcctgtcctctgggtgccccatcccagggcctcacatcttccaagatggacactcagagggaggccaacctggagtgctctggcattcacgccagcccctctgctgtcctctccgcctcccaccacaccccaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggaccaccggcacccaggagagggctcccccatgtcagatgggaaccccgagcacccctcaggtgagtgctgatgacagagctgagggtggggcaaggccagtcagtggagacaggagatggctggatggcaatgagaccctggactctagggagagcgtgccaggctgtgcagttgccccagcagagctgcaggggcccagagggagctccatgggggttccggtgccaggggaagtggctgggtgagatggctctggccagggctgatcctactgggcaaagagggccagttaaagactgtggaggccgccgggtgtggtggctcacacctgtaatcccagcactttgggaggccgaggagggcagatcacgaggtcaggagatcgagaccatcctggctaacatggtgaaatcccatctctactaaaaataaaaaaaattagctgggcgtggtggcgagcacctgtagtcccagctactcaggaggctgaggcaggaggatggcgtgaacccaggaggcggagcttgcagtgagccgggatcgcgccactgcactccagcctgggcgacagagcgagactctgtctcaaagagaaagaaaaaaaaaaagactctgtggaggtcatggagtgagaggtggctggggcagttacaagtaaagggggagaagacaggatggttttgagaaatggaagagcaaatggaggagaggaaatcactgcctctttcccaccagccattcttttttttttttttctggagacagagtctcactctgtcgcccaggctagactgcagtggcatgatctcggtgcactgcaaccttttcctcccgggttcaagcaattctcctgtctcagcctcccaagtagctgggactacaggtgcacaccgccacgtctggctcattttgtgtattttagcagagacagggtttcactatattgcccaggcccagtctcaaactcctgagctcaggcaatctgcccgcctcggcctcccaaatcccaccagccattctgacagaggagacatggcatgtgataccgtgtctggccatggatgggccagacataagctatcttgtttaattttcattaatgataataacagctaaccttaattgagcagctactctgttccaggcactgtgctaggtgctagttgccttatgtatactaactcaatccttgcaaacaatgtgatgaggtacccaaactgcctgggctcagatctcagctgtggcaagttactctcattttactgatgagaaacaaacaggaacttccccagtttggctcccgggcatctgcttggcaccacagctgccttgcctgtgttcctaatgtacagaaagtgacacacacaggtctgccacatgggaagtgctcagtgagcagagctctgccttcagaggacacgctctgagtcctactttgtgtcaaacactggagtggacaccaggggtactaaccagagaagcctacagtccctggcctcaggggcccatagtctagagagaggagcagggatgaaaacgagtgaattaagtacaggaagaaacaaagctaggcatggtggaatgcgcccgcagtcccagctacacaggaggctgaggtgggaggatcacctgagcccatgagtttgagaccagcatgggcaatgtagtaagactctgtcttttttttgtttttgtttttgtttgagatggagtcttgctctgttgcccaggctgcagtgcagcggtgccatcttggttcactgcaacgtctgcctcctgggtttaagcgattcttgtgcctcagcctcctaagtagctgggattacagatgcacgccaccacacccagctaattattgtatttttagtagagatggtttttcaccgtgttggccaggctggtctcgaattcctgacctcagcctcccaaagtgctgggattacaggcatgacccagcacgcccagcctcctatctcttactatatatatagtatatatatagagagagaaacaagtgcacaagaagtctgtgtgagatccagaggtggcatggccgtctatcccatccagtcaggtctccaagaacaccccactgcccaccagactcttgtcaaggaaggcttccagaaagaggcaatgcctgggctgcttggtacaatctctattttactgataaggaaactagttaagagaagactggggatttgtccagacacagaaccaggattcaaaagcctaggcaggtctcttgaagtacagagcccttggccaatgcaggacttggcgctgcctctggtctgatgaaggaggcacaggcctgtccttggggagctcctagtctcttaagaccatggacatgttctgtctccattgggatgccaggcagtcatccctcccacacacgtgtacatactcttcaccttcaaagattcagggacacacacacacacatcaggagaccctggaccacatacagagcaaccacctcagaatgaaactggacacagactttttctcacccttcaaggccccaccccactcagacatccttccctgatcaaaccttccccaaatccctgaggcagcgggtggactcctcctctggtctcccaagtccttgcatattgtcaccacagcacttccaactctgggtgcatgtggatctatggatctatgactagactatgagcttttgggaacagggatccattttatttacattagtatccccagcacctggcacagtacctggcattttgtaatgctccctaagagtttgctaaattaatatgtgaataggaaagtgaacagacaaaggaacaaggaccagttttctaagtgccctcccatggaggaaggcagctcaaagaacaacagggcaacacaggccagcgtatgacggggctaagggcttgccagtgggctgggaagcagggtgggctcaggaggagggaagggttggaaaggacacaacatgaggccaggacagggagcaggcccaggcaaccagcaaaggtgaaacagagcactcaggagcctgggcgagcgaggctcagcaaggaagacagtaggcatgggtgtggaagcggggctggcagagcgcaaaggctgggccagaccacctggacagcagagaagctgatgagaggaagaactttccacaggaaaggttttttcagaatgaggcaggcctccccaggacccatccctaagatttgagaatttcataaacaactagagatcaatctaagacaccagtatttaaacaaatgctgtggggcgcagtggctcatgatggtaatcccagcactttgggaggccgaggcaggtggatcacctgaggtcaggagttcaagacaaccctggccaacatggtgaaaccccgtctctactaaaaatacacaaattagctgggcattgtggtgggcgcttgtaattccagctactcaggaggctgaggcaggagaatcatttgaacccaggaggcagaggttgcagtgagccgagatggcgccactgcactccagtctgggcaacaagagcgaaactccatctcaaaaaaaaaaaacaaaaaaaaacccgactcatgctgccaaaatgtgaaacttacaaggttttcccagaggcacccgctgcctgaaggtgaaccatggaagttcacgtgcgcccacctgcctctaacctgcttcccccttgcgctctctctctctgtctcccttctacccaggccagagccatggcccacccacccctccaaccaccccgaagacagagctgcagtcgggcaaggcagacccgaagcgggacgggcgctccatgggggagggcgggaagcctcacatcgacttcggcaacgtggacattggtgagatcagccacgaggtaatgtccaacatggagacctttgatgtggctgagttggaccagtacctgccgcccaatgggcacccaggccatgtgagcagctactcagcagccggctatgggctgggcagtgccctggccgtggccagtggacactccgcctggatctccaagccaccaggcgtggctctgcccacggtctcaccacctggtgtggatgccaaagcccaggtgaagacagagaccgcggggccccaggggcccccacactacaccgaccagccatccacctcacagatcgcctacacctccctcagcctgccccactatggctcagccttcccctccatctcccgcccccagtttgactactctgaccatcagccctcaggaccctattatggccactcgggccaggcctctggcctctactcggccttctcctatatggggccctcgcagcggcccctctacacggccatctctgaccccagcccctcagggccccagtcccacagccccacacactgggagcagccagtatatacgacactgtcccggccctaaagggggccctgtcgccaccaccccccgcccagcccctgcccccagcctgtgtgccctgttccttgcccacctcaggcctggtggtggcagtggaggaggctgaggaggctgaagaggctgacaggtcggggggctttctgtctggctcactgccctgatgacccacccgccccatccaggctccagcagcaaagccccaggagaacaggctggacagaggagaaggaggttgactgttgcacccacactgaaagatgaggggctgcaccttcccccaggaatgaccctctatcccaggacctgagaagggcctgctcaccctcctcggggaggggaagcaccagggttggtggcatcggaggccttaccactcctatgactcctgttttctctctcacagatagtgagggtctgacatgcccatgccacctatgccacagtgcctaagggctaggccacccagagactgtgcccggagctggccgtgtctcccactcaggggctgagagtagctttgaggagcctcattggggagtggggggttcgagggacttagtggagttctcatcccttcaatgccccctccctttctgaaggcaggaaggagttggcacagaggccccctgatccaattctgtgccaataacctcattctttgtctgagaaacagcccccagtcctcctccactacaacctccatgaccttgagacgcatcccaggaggtgacgaggcaggggctccaggaaaggaatcagagacaattcacagagcctccctccctgggctccttgccagctccctcttcccttactaggctctatggcccctgctcagtcagccccactccctgggcttcccagagagtgacagctgctcaggccctaacccttggctccaggagacacagggcccagcacccaggttgctgtcggcaggctgaagacactagaatcctgacctgtacattctgcccttgcctcttaccccttgcctcccagtggtatttgaataaagtatgtagctatatctgcccctattttcctgttctgcagccccccaaatccacatgtaactcattactgtctcctgttatttatctcagtagtcccctctcctagccactctagcccctattaactctgcattaagcattccacataataaaattaaaggttccggttacctgcttggtga
